United States Patent 10,724,096 (METHODS AND COMPOSITIONS FOR INHIBITING AND TREATING NEUROLOGICAL CONDITIONS) - sequence listing, part 110

SEQ ID NO: 2004 - DNA, 2304637 bp, Homo sapiens
cacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccggcgttgcactggcacacagtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcagtgctggcaccctgatgtgtttgtgtctccgctgtcacacacttgcagccactgcagtagacaaactcgaaacccagcgtttctgttttggaagagacagggttgtgacgctggtgatgtttctggaaagttgttcctggtcttggtgatcggttggcaagagcttggctagagagactgatgtagatggcagcttcttaggagttgtttgtgcagggagagttaactgcatttggcttaggtaggtcagtgaatgaaaagtgaagaccatggcaaaaccaagtttcttatttttatttatggttataacttaatgagcacggggttgaggttaacaagaggagcatgttttaaacagtttgggcacctatagggtctctttaacctctcccgttcccttaaaaagttaatgcccatttagtacttgcttattaaaatggaaggcagcgaaattgtaactgaaattgctttaattctttgatactttgatatcatggatatgactgatgcagtacggtacttgggacactcagtgcaaagcgtcgttaatgtagtaataaacagattcttaatagggttttcaggaaaataattatattcaatatgtatatctctgcattttaatcaactgtgtgtgtgtgtttgtgtgtgtgtgtgtttaagactgcccctgttttcatgaggtttagaaagaaatggaagattctggcccattttctgcattcctttagaagtgcatactgtgcatgtagagaggaaatgcatgattgttcctttggttcagaaagagttaaacactagaaagactgcctataggaatcttaggataatattcataagcgcatactagtttctgagaatgagtaagttgataaagaattatcgtggagatttcagagtttaaaaggaagatttttttgtccatttaggaaaagaaaagtttaatattttccagaattcgtcatatgcgaagtagtctttgtttctaagattttgggatgtattaatgcatctttgttaataatgatcttattgtagtggtaaatatcaacaggaatagcattgaaaaaggacattataagttgtaataaggaatctactatataatatccggttatgagccagtattactgttttgacatatcttcctaagtacagtattagcttttcttttcccacaatgtgtaaagataaggagataaactaactggcaatctaagtttgtaatgaacttgaaaacattgtatagcattttttataacacaagttaaatcacaaagagttaaatattgttaatatttatgtcaattttataaatttaaacaaattttggggatataatgcttgctgttgatatttacacaaatatgtaactctatcactgggaaactagtttgatgaaatttctgtttccatttcaaggtctggttgtatagaatttcctgccacttttcctggaaaataaactcctcatatattaaatttattatattcactgattgaaggtcctcatatccagggtttttcctgggttctgtgttccatcattctgtatactttaattttgatgggtccatctgaaacatctgccatgagtagcaaatggaacactggcagcccttgggttaatgcattttaagataaaaaagttgttatttcataaatattttctgagttttcaactttatagttagaatttgaagacagagaacatagaaacaattacttttaagatggttaatagttatggccattaagattttttattaacttggctttcattctctattgtttaaaaatgtgtaatggcttaattaaggtggctttttatttcgtttgaatttaaactgtgtgaccaaaatgcaaagttgccctatatcctggaaatgaattaaataataaggatgctacagaactttattgattagaatgagtttcatggattcagtactttaaatatcaactgtactttacattaatgaacatttttatttacattatatatagctctgaagaaaagtatgatagttatattcttaatataaaacattcaaaggagaaaaagatggaaactacatgaatctaagataatgagcaactcaaccaggagaggtcatcacaagacaaaaagtagcatgaaaatctaaaactatcatttttctttggtacacatttttaaaatgtgatgagtatgctaaaactttctgttcctaaatacctttttaatatgagggacagaagatgtttatttcacaacaactgcatttcaaatatgtatttgcttatgacttatttctttttctctgtcgacagacatataaaaactgttaatactatgtgttgtacaagcagactagaataaacttgaaaacaaagctcatcactatggttatgtaaaaatataatctaatttctttgcagatagcgaaaatgaactgctgctgagctgatgtaacaaatcgtgtatcttcccttcctgtaaatgtagatacacgggacacacgtgggaagtttaaagaaaatatttcactcttagggagttgcatttatttgaacatattataaagaccttgatggtgcagttctaaatgatgaggagattaagctagcgcttaataaattcactttttagagttaactgaattttcacttaaataaatgatctctcataaaggccaatttacatcatttagtagaactattaacctataatttcattgaccaacacatttgggaaatgtgttttgaattaattcacatattctctaacaaatacgattttatacgtgtatatatacacacacatgaatatatatgtgtataaatatatatgtatttgttcatatgttttataaaaacatttgaatacatgttataaagtacatagatacatatttaatatagcacatatattaagtattatatgtaaaaatgtgtatatttatatattttctaaaacaccattcaaggaatttaagttgtttacaagtttatagaaaggtctttttccagtgcaattattttaagtaactaacgcaacaatattaagcaatagtatattagtctattttctcttcctcaattcatatacttctcccaaaatggtgtattttaaatgtaaaatatgtaaatgcatataaaagcaaatactgctggtttatagagaccttgaacataataatgaacttgtcttaatgaaaacaatttaaacttaaaaggagctttaggcaagcaaaattcattggttgataaagcatagcacattatttgcttaatgcaactaataattattaactaattggagagaaatgtataatctcgattttattataggcacggatattcaggaagtaagaatcattgttcaaattttactctttaccatcaatatatggcaaaattgggcaaaaaaattaatccacaaatttaatttaggtcttattaacctttatgcagttataaacctacaacgtatcattttagatgatatcaaagttgtttggtgcatatcatattttaaatcttacagttatgtgccccataatgacatttcagttcaatgatggaccacgtgtatgttggtggttccataaaattataatggagctgtcatatataggtgtgccatttttcatcttgtatattatatttttactgtatcttttccatgtttaagtatgatgagatacacaaagaggcattgtgttataattgcctatagtattcagtgtaataacatgcagtacaggtttgtagcccagaagcaacaacccataccaaatagtctatgctatgtgtgtagtaggctacactgtctaggtttgtgagtgtgtactctatgatgttggcacaaagacaaaattgcctaaggatacatttctcaaaatatatccttattgttaggaaatgcatgatgatatatgttttttgtctattttaagtgggaaaacctttcaagttctataatttctttgagatttaattcactgttccttattagtaaattcttctagacaaaaacttactcaaatgtcttaaagtttacataaagcttcctttttttttttttttttttttttttttgagacggagtcttgctctgtcgcccaggctggagtgcagtggcccgatctcagttcactgcaagctccgcctcctgggttcacgccattctcctgcctcagcctcccgagtagctgggactacaggcgcccaccaccatgcccggctaatttttagtcttgtgaatcttttttatgattgaaagagaagaaatgtgacatgtctacacatgtcatctgtttttaaaaagtagatttttgtatttgttgtaaatggtatacagaatcaggagagaatctaggctcagaaattcttaattcaaatgtgcttttctttaaaatattaaacatatggagatccaacttgtgcaagttgtctgtttagtgattgatgtcagtgggatgaagaaataaaacatgtactttaaagattttcccatctctagtcctgatttgtgaagtgctttactttatcattttttactacttgcaaagttataaaacagcgtatatagtaattttaagcctcaaaaccagtgttgtgtgaaataaaataaatttttatatttatatctgtaccagtatctgaaactggctgttacctgtttctagagagacacatattttaagataagtagttatcagaaacataaggtatatttctacaaccagtattgggctgctgaaataaattatatgcttatttttgccattttaataagtaagaataatgatgcaatcatttatatacagctgttaattttcaaatgaaagccttgaaaataatacttgtaacagagtgattcactaaaacactggattttcccatctcctgggctctgtagaagctatatgttttagttctgagcagataaggatgttggaatgtggaggtgcttcctctttctccatcctaacagttcattttatgggaagaaatgtccgtctatcacactcttagagtctatgtctacagttcattcgttccttcctatgttaggtagagttacttatctgtttggtgactatgggaaaaggacctagatgtgcttagctcagcccctcctttctccttccaggctgcctgcagaaagaatagattctgctgaacgatagataaaagtaggctttgcctctgcactaatagtgatagcgcgaagagccttatggtgttcggttcttcctatggcttgagactctgtttaattttagaaataaggttaatgaatcccactgtatcacacatttaagccttattcttttgtatcagcaatacttatataaagaatgttatttcctctctgtgagttattttctaatctagaactcagagaagggactgagattgactgtactcagtaaaaccacaaatatattgaaattgccaaaaataagattgatattaaactaaatgaacatgaaataatttctgcatagtttagaaactagtaaagaataagacttggtttttccattgatattgagttgaagatttggtgttactctggttaggacttccaaactctcccattcattcattcattcattcatattcctacccagtgctatccgtggtattattttacagagatgcttagaataccgtttctttatctgtggtaaataacattgccatttaaaatacagcctatttacaaactttagccagtacacatccaatttcatcctgtccatgtaactatttagtaaattatatatgcctttagttggctgttacatcatgatccttctgtaaaatcctgaaggttaaatgttttaagccaattattctttccaacaaagcatttgcacttagaaaacaaaattgattctttcttcaattgtaagttttgaaaaatatcttcttaaactcttctttagttcactttggaggtagctattcataataacagcttgaagtaactgattttttatgacactgcagattttaaagcctcccctgatagtaggaaatctagatataaagatgtggttgttggctctgaatttgcttgctgaagatcacatattttgggtatactgtaaaaatgttgaaaaaatacagaggagctcctgggggccgtattctgtatttaccttgtgatttaggtttgcttgaaataccctcataaacataaatagtgatatatgctttaatgtttttatgtttaggaaagaggtgaaattagattctgagaatacttttaccaggaaaaattccccaaacatatataagtttttccttaccttttctagtacattcacaaccttcttcatctgcactgggatggtgatctggaaatgtgaatcatagaaaatggcaggcaatagaggtgtgactggcatacgcactgtcaaaattactaaacctgtgttgtctggaacatctaagatggaatcaagttacataaagtttagttaaattcaggaaggatttgttcacctctatgcattagatgtcatattgaaatagtatgtgaaaaggaaaatcttgcctggactcacaatttttatttactgttataatgtcatctatgctgttcaattatagtattatttgaaaggaatacatgaaaaaaataataggcacagtttgtattgttaaaaaaacagtctgttaagtggtgaaataccatgatatgccaaataaaataataactctaagaaaattgtcttaaaattaaaggtgcttctatttttaatagaaaaggcttgaaaccaacccaaatgcccatcagtaatagactggacaaagaaaatgtgacaagtacacaccatggaatactatgcagccataaaaaaggacgagttcatttctttgcatggacacggatgaagctggaaaccatcgttgtcagcaaactaacacaggaacacaaaaccaaacgttgcatgttctcactcataagtgggagttgaataatgagaacacctcagcacagggaggggaacatcacacacccgggcctgttgaggggtggagggctaggggagggatagcattaggagaaatacctaatgtagataacgggttgatgggtgcagcaaaccaccatggcacatgtatacctgtgtaacaaaccttcacgttctgcacatgtatcccagaacttaaagtaaaatttaaaaaaaaaagtgcttattgtcacttctatatcatagactgaagtagttattttgaactaacagaaaacacatgtggattaaattttatcactgttaactgattttttctaagcagtcacctcttaatgggaaccaaattattaagtaacataagtacagactgtctatatatatatgtctttttcagacattggtcaaaaatttataaacagaactacatgaaaaaatttcagcctaattatgtcacatagtgaaattatagcatattttatgggtcttatttttaaaaatttattaagtacgtgttaaataatggcctatgatgcattaaattacttaattgctaataaattctaacttaaaatgtaaattgttacgtagcatatttgaaacattttttggttcaaataaaaatatgtctggactataaaatatgactatcaggttttcagattatgaaactattatactagcttagtgtttttaatgccaaccaactgaagaaaacatgattcgggtgtttttttctatgtattcatagcaacaataacacaatgagttcgatgctgccatcaatactaatgttactaattctcatggtattttactcagtggatttgaatgtggccatagaatctttctccacacaatatgccagacagccacgtataatcccatgagatttggtattcaatataaaactttacttttttactcaagttatatatattgccaccaccagcagtttttcagctaataaagtatacttatgatttaagtcacttggttaatgtcctcatccctaaagaatatgttaaaacgaatgcttaacttatagtagaagagattttcaatggcagtaatgaaatttccaaaaatgaaatttaatcatgcctcatgcacttctgtagtatatgtaagttttatttatatatcttaacgtaagcatttaagttattaagttatgactagttaaaaggaaatagtagcatagttaattgtgtttttgtatgtccacagtacagaattaagaataactattttggccaggtgcggtggctcacgcctgtaatcccagcactttgggaggctgagacaggcggatcacgaggtcaggagatcgagaacatcctggctaacacggtgaaaccccatctctactaaaaatacaaaaaattagccgggcgttgtggcgggcgcctgtagtcccagctacttggaaggctaaggcaggagaatggcgtgaacccaggaggcggagcttgcagtgagccgagatcgcgccactgcactccagcctgggtgacagagcagagcgagactccgtctccaaaaaaaaaaaaaaaaaaaaaaaaagaataactattttattgtgtcagttgacaaaaatagtaccgtgtcagagataaaaatgtgccgtggtggggtattaacattgcttctaccattaagaacataaacaaaaacaaccttattccaatattctagatactgagggggttatttttgtggaattgattccaaagacagggatgcttgatcaaagaagatgtttagtttttggctaataaatgttgcctgattgagttccacaaattctgtaacaatttacattttcagcatcaatcaatgagtgtccttttctagaactccaggcagcagtacatattatacttataaaacgttctgcttgtattacgtaaatagctaatatttgttgtgttgacttcttattaaatgtttcttcccagcctttcaaatcaggcactactctttatgtgtactaggtcatttatttcttataacaatgcttcagtttgcaaatgaaaaaatcagagacacatggagaagtaacttccctgggccaccagcttggcctatttccaggtccagtgctcttcactgtggcatagctggctgagagtgaagtgctgtctctgtgttcaagttctctaactaagaagtttcagcttacatctaggcaacattttaaggcttgattgcttgtatataaaggaaaaagcctattggcataatgtttctatctttttgtttacttattccttgatgacactgtcatatgttctggagacttaaaaattacattggtaaaaaataaagaaatatatttgaaataaagagaggaatgcagctctttcaatggtagcacattaaatcataatatatatgtcatttttgttcttcttcacaataaggtacttttgcagtgtagttctatcatttgagtactattgaaatacatgtaatagtcatgtagtgaaaacatttatttaaagctatgtaaaatatttcttaaaatgctttgtcaggtatacataaaagctgtctttaaatcagttctcaggaaatgttgaagtctgtatcgaaaactgtaaatatgattgctattactaaagttaaaagatggtaattgtttaatctataagcacagttttgagtattcatttcatacaatagctaatccatgaagcttttcttgagagtgctgttgagaaaataactttttcctttgctttcatggcagtgggaaaatatttgtctttaaaatatttgccagtcctaatgcttaaatatttcttgtatccatccgctgctctccattcctatcacagcttctatagttaagattttcagcatttccctccaggcattaatttagtagcctcctggtatgtctcccggattctaatcttccccctctagcttatcatctatatctatgccagaaatactttcccaaaacacaaatcttgttatagtactgcatttctctagttcttccctgtctcttaaatttagtctcctcctaacccaacatttgcaccctataatctaaccgaccatactgagatctttgcagtttctctaacacaacatgctgtttcgaatcatatttctcttataccttgttacattttgtcccctcctttcatttttcctgttttatctatgctgttttagaggaaactcatttacggtccaagcctcagaatcttggagcagactgatgtatcaacacctccctgtggcaatttgctctaatcacaggtgaaatactaagacgcagcaggcaaattctttggtttctgaacttataaggaacacagtgatcacaaataatgaaaaccacctccaattatctgatattaaagtgagaaattaccccatagtatcgacaacagaaggaaggcgagaaatatattttcaaagaataaaccacaaatattttcctcattttataagtaaatgtgtatctatcataagggaaatttgaaaccatgctgtgaaagcttacaacttctgcaaccctttttctaccggattttattttaaaagattttctctgcttttcttaagccacatgggtgatcacgtgcctttaaacccaagcctgactgtcctttccacaagctattatctgaagaattatttgttatctgcatgcaaattaaagacgtgtcaacaaaataattattgcatctaacaagtactttaaatagagtacttaagatgtcaccaaatcttctaaatgatagctgtagcttctgaaaaacttgataactatatatatttagtgtgtaataatccagcagatgcgttgatattgttgaagttgttatgaaatgtcaatgaatttcatttccacttttaatatgacaaaaatataattttataagtataaaaatagttacttctattctatttgtttatattttaaactccgtcttcatccttacctttgcaacttagtacacacttctgaaccatttcaaagttggccagtctagcgaagcctgtttcaaattttatattcttcacaatgatccctgcagtgatgcctactaaaaacacattactctcttttctattagtccacaatctgcatgagcagagcctgtattttttcccttaggctgataggtattagggaatggttgtattaaaggaactagactttagtaaacatgtttcatcatattaggtactgtactggttgcattataccattacatgaaattagcccaaatacctctgtgctgtaatattcaaagtataaggatgctcaagcattttaaagctcactggttccatctttatacagttcttacttttgtcaagtccttccttgcattgatacagatttacactcccataaattccagccagtagttctagttgggcttctcaaataaaagcttaatatttacccaatattctactgccgtaaaatacttgaagacaaatatagaatctaattaaatataatttaagacttagtcgctactacttttatagatagccaactaataccttgaagacaaacacattccttaaaacactgtgatttatatttacttatgtcctccaaattacccaaatatttctaggtacacaaccagtgttaaataaatacaattgaaaatggaattgaaatgggttagctctgtatacaaattgtttcttaaagtgcttatagctaggttatagcaacaaatatacattgttgtgttttgatagctaaaagcatcatactaagaagtattataattgtaatataatgttagttgcaaacaagtgtgtctgtaagtaatcttggtattacagaaaaaaaaactgccttaaaacttacatatctgtatgagtcaaaaccaaaaatgaaacagaaatatttaaagggactgttgtttaaaagtaataggacaactacagttattttaaaagatagtttatacttatttgctcagtgtgaaataaaacatttttaaattttaatttattatctactctttgcccaaagtatattagaaaaatgttactgcaatttgagtagtcttcatattgtgataaaataggtaattattatatgcaataatctgaggcattttcgttttacagagcatataatcacccacgtatcaatttttggaatttaaaatgtgttgttggcacaattagaatcatgtatctactttcaaagagagatttcagaatattgcaaataaaaatgacattgtttcttttatcaaattggcatcaatagggcctttttttcaaaaaaagcttttagatctgctatttgttcatttatatgtgtataattacagtattcagaggatctctcatgctgtgtttgtttccacatatggattttcaaatgacaaagtctcaagtggtggcgctaaagacaaaccatgctagctactcaagcatttccttcctggagttgtactgtgtcaactgctccctaagaaatgggtaaagagggactactcagaaacatgcattgagcatcagcatgtttttgaaagattaatcttctagacctggaactaaaagtatcttccagttattttctttattatccactttatcagcttccacataacacattcagttttctacattttagtttaaaaattgccatttaattctatgcttctatgaagtcacatatcctacttatgctttcttaatttcaaaattatttgcactgtccattttataatattttatctatcttaataatttaccttaaagttctcttttattgaataggtatgacaacatagaaattaaaattattgaatcattccaattagtccacaggtaaggtcatcagtgagtgattaaggaaactctttctgttataacattttagctaaaacctaaagaaaaagccaagcaaacagcaggaaaagactgttccaagaaaaagaggacaacctcacaattccaacattggccaagtttggaagtcactttgatgaggagatatttagtggttttggaattagtcttctgttaaacgtgtaatgaaaagaaaattttgaaagagtaaattatcccgcttaattgtctatcagcaaatagaaaagaaattttcactggttagaaatataggcagtcgggccgggcgtggtggctcatgcgtattatcccagcactttgggaggccgaggcaagaggattgcttgaggccagaagtttgagaccagcctgaacaacatagcaagactttctctctacaaagaaatatttaaaaactagccaagtgtggtggtgtgtgtctgtactgtagtcctagctactggagaggctgaggtggaaggattgcgtgagccccggagttcaaagctacagtgaataatgattgcaccactgcatttcagccagctgagacaagagtgagactctgcctcttaataatttttttaaaaagaatttaggtcagtattaaagtttgtgataattcaattatatttagcttagagaattttgctaataaaaataactttgataatttaacacatatgtatgttattgaaacagcaagcattttgaagaggcaattttctaaataacctttatttcaaagtgtattgtttattgctgtgttagtttgttttcacactgctataaaggaataccagagactgggtaattgataaagggaagaggtgtaattgactcacagttctgcatggctggggaggcctcagacaacttacaatcatggcagaaggcaaaggggaagcaaaggcacgtcttacatggtggcagatgagagagaagagcatgaagcgggaggatccccacacttaggaaacaaccagatcttgtgagaattcactcactatcatttgaacagcataggggaaccatccctatgatccagtcacccccaaccaggtttcacccttggcacttggggattaagagggttacaattcaagatgagatttgggtgggttcacagagccaaaccatatcaatcgctgactttaaagaaaacgaataatattgtttccaatctttacatagtttcacataacatttttgagagtataactgtaacccaacatttacaatatatttgtagttattttttaatgtgaataaaggtaatatgactcatattcttaagaatttccccttggcattactatgttctactgtttcaaaagtttgcttactttaataagatttcaattatttggattgttaatacattgagatagcgactgaggtttattctctcatttaacttatttttcatcctataaatgtaaggtgtacaatataatattttgatatacagagtaaactgattactaaaatcagaacactaatatattcattatctcacatagtttttattagagaggtatgcatttataagctgccaacaagtccaaggattgttttaaaatgtatctttcattcttattacatttgtgacttcctgggttccatgccaattgtttgtttttaagaaatgtagtgttataacaagattgtttcagaacttcaataatatgcaccttcaaatagaatattataggtcttgctttataatttgtaaactttcagcatctttgcggcttaactttgcaacatacttcaaagacttaggcttcatctaatttgacataaaataaacaataaccagcaagtactagatgattatgcatctgatatggtttggctctgtgtccccaaacaaatcttatcttgaattgtaatttccacgtgtcgagggagggaggtaattggattatgagcgcggtttcccccatgctgttctcgtgatagtgagtgagtctcaatctgatggtgttaaaagtggcagttgtttcctgtgctcgaatttactctctcctgccaccttgtgaagaaggtgtctgctttcctttctgccgtgattgtaagtttccttaggactccccagttatgtggaacagtgagtcaattaaactttctttgtttataaattacccaatctcaggtagattctttatagcattgcgagaatggactaatacagaatctgtaataaactcatgcagtatctgtatctcagattgtatctgagattacagtctctgctaaaatacgttctttacagatgatcaatttacttagaacataggccaataagtggttatacacagatgtctgttggccttgaataatagcactggccattgtcagagttggtattggggaggttggtgtataaagagtacgaacttcatagagcagcaattctcatatgctaatatgcatataaactacctggcagattctgattcagtaaatctggagtggaacctataatgtaacatttatttatttatttgtttatttatttttttattatactttaagttttagggtacatgtgcacattgtgcaggttagttacatatgtatacatgtgccatgctggtgcactgcaccaactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgttttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgatgagcattttttcatgtgttttttgtttgcataaatgtcttcttttgagaagtgtctgttcatgtcctttgcccactttttgatggagttgtttgtttttttcttgtaaatttgtttgagttcattgtagattctcgatattagccctttgtcagatgagtaggttgtgaaaattttctcccattttgtaggttgcctgttcactctgatggttgtttcttttgctgtgcagaagctctttagtttaattagatcccatttgtcaattttggcttttgttgcccttgcttttggtgttttagacatgaagtccttgcccatgcctatgtcctgaatggtaatgcctaggttttcttctagggtttttatggttttaggtctaatgtttaagtcttgaatccatcttgaattgatttttgtataaggtgtaaggaagggatccagtttcagctttctacatatggctagccagttttcccagcaccatttattaaatagggaatcctttccccattgcttgtttttctcaggtttgtcaaaggtcagatagttgtaaatatgtggcgttatttctgcaggctctgttctgttccattgatctatatctctgttttggtaccagtaccatgctgttttggttactgtagccttgtagtatagcttgaagtcaggtagtgtgatgcctccagctttgttctgttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctttttgaagcaattgtaaatgggagttcactcatgatttggctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttacccattcagtatgatattggctgtgggtttgtcatagatagctcttattattttgaaatatgtcccatcaatacctaatttattgagagtttttagcatgaagtgttgttgaattttgtcaaaggccttttctgcatctattgagataatcatgtggtttttgtctttggctctgtttatatgctggattacatttattgatttgcgtatattgaaccagccttgcatcccagggatgaagcccacttaatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactcttttttataatgtaacatttctaacatgctcccagatgatgctaatgctgagactgatctatggaccacacattgagtagcaatattttaaactttgaatctataatgaaagatgtcatagaaaatttcctacttattttaaaattaagaagcacactttagaggaagaaaattttaaaaatatataattatgatatctcatttttattttgggtataaatagaaggtataatagtgtagttctatgatatgattagacgaaaaaaattcagaaagatgtagatactccactaactagttggatagccttagacaatttatataatctctcagagtttaagtttttgtagttatgagagaataaaactagattatctctaaaatccattccagtttttaaatctatgattctagtctcctaggcttctgagtctgagaatggagaagcacctcttataaacctcagtcttgcttttatatctaactggagatttggaatagagtttccaggttatttatgaagtttaaataatattatacatatgagtgtggtgcttaacaaattgccttaccaataacaagtgcctaactaatgttattaatgtttcctattgacaatatttttacctaccttagtaaaactgaatcttagaaagtgagttaacttcttccaggacatacaggtttctagacatatgctgaatcactgtataataacaaaatacctatgtaattgataatatattagaaatatacctttaaataaagccagtaattataatgaaataagaaaaataccaaggaagaaaaaaatgcttgtctctctatgttcaagctggtaaaattccatcaaaatcaagctaatctcaattacccaaatactctgtcctcttgtttgatagtctgtgtgtgcatactcctttttattctaatataatagtgaaaatattaagcttaccgatatgtaaatagcccccaattatattgtgtgatgtcatgtttgtaaagcacacattcatttactaaaattattcattgtttattatttatagctattatttctactaataaaaagcatttccacacatgagcaaatgtatcaaaaaaagtctaagaagatgatcagattgatcagtgtactctatgcccttcttaatagtaactgagtgtgattttttacattgcatactgccagaaatcaccacatgtagcatggcagatggctgccaatagtcttgttatcctttcataaattatgtggcatttatgccattagggtgatttttcagtttagaaaagacaactaagggtcagtcttttctatgataatggactcacaagggacctcaaaactttaccatgaacatattttatatcttaagttatcttccagagactttgaatgtttgaagctggttgaggtcgggaagtcaggacagaagagggagtagagcacacctgctctaagtataggcatttcaacgttcagaggaaattagtgtggcgtggaggggcaccaggggtggtagagagttcatgctgtgctctctcgaggttggattctacagaagctcagcgttggtgtgattgttggttagtctggtgtggtttggtttggttctttagtaggtggggcccctaagaacctgagtaatgtccccatgcactagttctgtaaacgcggaagcaggtggtggcagttaagtgactcacactcatttaggctctaagccggccctctcattcaatatccagcaattcgatttctactgttgggtttacgttgctttgctagtctggggcctgcttcgaagtgtcaaaatagcagtgccattgttcgtggtgaatttccagcaaaagaaacagacagaatgttttagcaccaagttgtgtgatttgagattaaaatgctctgcatggctattcctcatgatggcacttttgagtgattactacaagaaaaacgaactgttaaaatttgaaaaggggaaaatgttggatacagctcaaatgatccatatcaactactcagttattcacctgtgttaggtatttcccaacttttcttggggtatcctttatagagtagcctttgtcaagtctcataaaaacagaactaatatacttccacagtatgcagtattaattttatatttcgatttgctctgaaactttgttctctcttgagactaacaagtaaatcataaagtgaatatttttcaatgtcgaagttgttctgaaagtataattttaaaagttctttcgggccataatatatgcctttggagaagttaatatattattgaaatatctacttatttcatctgccacatgaaaataggactgtttcatctgtccttaaaagcaaggtggaatatttgcttcttttgaaatgtctgtggcattttttttcttttgcatattctgcaacacaaagaaatatttaggacttgaaagaagaaggtgagctgcttgattacgctgtactagcaaactgtgaatttatgttatttacaaattataattaaaagcctaagaagaaaatgcatgcattattttatttaaagaaaagcctctgcataaaaacactcatggaagagttattttcaatttaaaaaatagatgattatgtgtaccataaaatagatgatttcatgtaccataaactactatagtaatttgccaagagataagaccaaggttaattttttttcaaaattaacttttaattacaatttaaattaaatcactttaagtaaaatcataatttaaaattattcttttaatcaaaaggtttttattttaaaaataaacatgtagaaaagaattatatatacttaatatttaattctttaaaagtttactgaaaggtcatctagttacttcttaatgagcaccatatttaaatatatttataatgaggtttgggtttttttattcttttcaaattaggtttaaatatttttcagttaaatttggtttttgcaaactacattccttgcacatcatgaggctaaagccagatatgtgacataatataagaaaagcatcctaagagagaaaacattctcaagctctaaaactataaaactttaagtataaattgatgataaatgtcacattgttattttaacattttttgtctgggaattctatgaagaagtaggtgcaaaatgttactatgtggaaaatgtaatgtactttgtgcattgaattttaaaatgacatggaaggtctgaagaacacagaaaggttgacagctcaccacagatttattaagtatattcaggtttttatctcaagatttttttaattacttgagtgttggtattgataaatttgttgttgttattactgagaacttaatatgttactatgtagatttcctaagttctctttcaatattactactgaatttgtaaatgataagtgatcatgaaataaacttatatgttgaacaatatagaccatatcattcacaagtattagggacatttcattatgggtaagaaatataacctttggacgtgtagaccttgtagtccatttcagtttgactaatcaacatgttcagtttataacatgtttgatcctctatatctctaagaatatatgtgtttttgtgtgtgtacatatgtgtgtgtgtaggcagattttatttagttgatatcatggggaaatctgttgctcacatagttgacatttctttataaatgcaactcacctcatcaaaatgacataccaaaagaactttaagaaacacatttgtaaatggcttacatattctatgctttcttaacccaaccacagtgtaaaaataattctgagtactttggaacataaccacaaacacttatcaaatatatgctccccagtttgcaattgggtccctataaatccactgtaagttgaaaatatagttaagtcgaaaatgcattgaatacagctagcctacagaacagcatagctaagcctcacctaccttaaacatgctcagaacactgacattagcttaaaacaaggcaaaatcatctggcagcatgatccactatagtgtattggttgttaaccctcgtgattgcgtgggtgactgggagctttgacccacttcttcctcccagcatgtgagaaattatgataacacagactgcaagcacagaaagagatcaaaattcaaaatttggagtacagtttctaccgaatgagtattgctttcacaccattgtaaagtcaaaatatcataagttgaacccttgtaagttaggggtcatttttatgctattttaattatgattgcaatgaccaatcaggtctgtggagctgttttttcccaccacaaaatggcttaagagtgctgtattttgctatcttttcttattgatattagaataactttttgactgttgacacttaaatttaaaagggtttctaaaaatcaatgagaaagattatggaagatgtgtttgtattagaagatgtagcaaacttccatttgaacaaaactctgcccaccttaagagtttcttctgtgtttatgattaatttgcttcaagatttctgtttgtggctgttgagttatcattctttttttttctcagtgtgctcattccttcattcagtcagttattttaaaaaatattaatttgttgcacaaatgtaatatgtctttgtataagacagacctaaattcaactaagggaccctatttaagaagtttgtggaaatagaagtgtttttaaggtccataaacatcagttttctcatttgtaaaataattggggcaataatacatgcttgagttcatagaaagtacatagcacagtgaatagcacaatttggggggtatttaacaaatgtcagtcatctttgcattatctttgtatgaaattaacatgtaattcataagcagttttaggtatctagcatttccattagctccagcgtccagtcaaagccctctgttggaatatctttgcagctacaggagtctgacttgatcaaatgtaacactttcatacctgtgtccctcccaccctttcatttgcttgactggcttctttgtatcagactatgactcaatggatttttccttttctattgctgaagaaagctccatttccaaaaattccattcaacaattcactacagcagacgacttataaaagagaaaatgagatatcatcctgtgttttcaagagtagataaagaagtagtagggttcttgcacagtcccagggttgatggcagagtcttcttcctgttcaatgtctcaagtttcatctgtccatctcctattcatgcacactgatgccatcctctgccatgctccctcatcacacttttgccacacgtgtctgtcctgaggcatctaatgtctgtggcaagtaaagtctcagaaccataccatgaagatctatggtgaatgaaataattaggtagatactaagacagagcatttaaaatatattctcatatattaattctcattcttagccattaaaatatttgtacttcaagtgttcggcttgaggttgaaaaatctgaaggactgacagcatctctcattatttcttttgggtagttaataaatgcttggatttcagttcttgatagggacaaacgatattttgttgataatggatcttcacttaaatcccatcatgcaatttactctctacatcacaaacaaccatgcgaagaaagaaaaagaatcagtgatttttctcttccctctaaggaagagattttcatagcggaaacaaagggaatattttggaaatttactgtggtgattttctggattattatgaagggggtggtggctgttgacatttagagggcgaaaatcggaaccactagaacatcttgcaatctgcacgtctggcctaccctacaaagaatttcccaccacccagtgactgtaggtttgtgcaattgcaaaatctctttacaaatttctgaatctggaaacaaactcaaatttgtatgtagatacaaagtatattgcatagttttaatgtgcactaattttctaaatataactacagtgtcagtggaggaaacgtactttgctcaggtcacaactgttttcaccatttcagaaagtcacagataccaatgctgctcatggtgtctaagtggcacaaagggcacctgtgtgtcagcctacatttgtcgttgttatattgaaggtgattctaggtgtgagtaaaacatctgactacttgattatgtcttctaatgtggtggtgcttgaatgtttacatatcaatatattattcgtgtagatcactatccttttattgcattgaaacaatgtttaaattttgtgtgtagatagactgtattttttatggatttacttcaggctgagggacagattgttctggtagccatttgttacttggttgtcaagaagcaagctaggttgatggtgaaacactataagaaatatagttttcattttctttaacatttgtatataagtgttctatatttaaataacaattacataattaaaagttttagattcacttgtgaattatttattaattgtaagattgtacctttcaagaaaactcaaccttattttttcctactttaggtggttttcttttcaagcattaaaaataatgttattgagttctattgatgaagttaaaaatctgatttccttttattttataattcattaggcattattacattttcactaaagttgcaacttgaaaattcctgtaagacacgcatcattccatataagaaaaatgtaaaattcaaatattgtgcaactcaaggtaaatttacaaaataaatttagtaagcattattaaagactcatagcctttaggttactaatatttaatattatagtccaccaggaaagatgatctcaaagagggctcagtattgatttgcttgttggtatttcagagatactgacagctgctatgacttctgctgttttttcttaactttgcccatactgagtttgctttgtatttccttgttattaacccacatctcaccatattgcaattaactttcacaataagcactccattgaatatattagaaatatttgcaatgtgaatagaaactcttaataagagcaggcctgctgctagatgataagaggtctgcatgaattagaaaaagttgcccttccatatcctgaacagatgtagccccaaagttcaggggttagtgaagagagggcttctttcttcactcccctcattcttttcctctggggagacactgtctttcacaacttcgtggacagcatgtggactaaatttcagacagacacttgccccttcagtgaggcatctttgtgcaaggtacaaactttatacacaggcatgatgatccctaacacaaatgtgtctatgaaagaaaagagaaaaataaagaacacccaagttttcatgaaagagcagttatacaggaatgaaagaagctttctaacaagaaggaaacagttgagagggaggaattaaagatagaaaaatctattgatagccaatctaatttccctgtttttaaaattcaagggtgattcactctaccacttatgagcagaaaacaaaccttagaaatagattacatgattacgatctatgtaaactttcacttcgtattaccctaattgggttctcttctaattctgtgtaaaataatacatcttttggtttatggtaagagagagccatcctactatgactgccaaattttgattattcccaaattgagagacaggaaggaaagtgtttacatttatcatattgtaaaatttgaaatatgtatttatagcccattttagaaatgtttcaatgtaagaaaatgacttttaaaaagaagtccaatgtctagaaaggcatccagtagttagtatgactgaagtacatagttagtttcttaagaactctgcctttttggtatttttccttttagggaataaataaaatcaagcctctcaaatgattttccaaatccagagccatgaagttacaggatgatggattgctaggctgccattgttatctgtgtcaatggtggtcttggaatcactctgtgtggctctatgttgtggccctctctgcacctcctaaagaatgacttcattgctgtttgacttttcaaatttccttccaaattgaaaactcaagacatttttcttcacattttattttctttttattatgccagtttaaaagtctttgaaaataaagaactgaaactcaccttcttctgaagtcgcaagtgagcaaacagaaataatggattggactttgttaatgatatgcctaaaattagatgttaagttattaaaattttagttttccatgaataaggacaaaaacctcatttctaaaaccttgtcacatttaaattacgctgtctcatttgagtctccagaaaattatgtccagtcttctgattgtcactcctataaacttatttttatttaaatgacataacctccagaagtataaaatgttgaaattcttttcagaatgacttgcattatagcttttccctcctgtggtattgaaatactatgtttcatattagaatgttttcaaatatctactctcctaaatagattagttaatggtattgtgtttcctgaaataatctgtgtaatgaatacgaacatttctacaataagtttacagtcttcttactttagagtatcatagatctaaattctaatttatttttttttttgaaatggagtctccttctgtcacccaggctggagtacagtggcacagtcttggctcactgcaacctctgcctcctgggttcaagcgattttcctgcttcagtctcccatgtagctgggactacaggcatgtgccaccatcccaggctaatttttgtatttttagtagatatgggtttcaccatgttggccaggctggtcttgaactcctgacttcaggtgatcctcccacctcggcctcccgatatgctaggattacaggtgtgagccaccatgcccagccctaatttactttcaataagcaaaattacactttgtgtcacactttccccacacacaagctttttgtgacttcctaaaatatttatttatttatttatttatttattttgagatggggcctggctttgttgccccagctggagtgcagtagtgtgatctcagctcactgcaagctctgcctgccaggcttaagtgatcctctcgcctcagcccctcaagtagctggaaccacaggtgcgcaccagcgtgcctggctaattttcatattttggttagagaggggctttcaccacattgcccaggctgctcttgaactcctgagctcaagccttctgcctgcttcagcctccaaaagtgctaggattatagatgtgagctactgcaccctgagacttttaataaatttaaaaaacaaaaaatagaaaacaaacaacaacaacaaaaaatttcattccttcctgttcccaggctaaaattactcttttgagttagtggatgagtgtatgtgtaaaactctagcttactttgctattgctgaatgggctgttgttatagccattgttattcattgacatttcagggctgagactatgtcattctagaacttcgactcatactctcatgttaatttggtataaaagaaacataatgaagaaagtgtatttatctcattattatttgttgtgttgtttcttcctgcctctctaaatcccacttttttgtacaactaattttttctttcatcaacttttctattaacagcttttgactttataactgcagctaaatggatgataaaacaaaataaggtgtgacacaaagaatgaaacagtgaatggaagggcttaggtataatggaaggaaatgtcaggaagaaagtcccagatgacttttcaaaacttcagggttggcagtagctcatggtgggagagatgtaactcagttgatggatttgatgaattttgtccaaacgttggaatttggactggtcagatacaacagaaagcccccagacagtgactctgcaaaataaatatacaaaatgtgatcctgacattcagaaactcatctttttctgagatgctttaggccatttttcgtgattgaaagaaagcgacaacagctctatcccccgtgtccatgatcagagaaagagaaagaatgaagattcaagggccgaaagcgtgaccagctgagtcacatttgaagccttcctgaaagcctcactcagtgacttctctttaaacagctttagctagaatgatggcacctggcctctcttacttccaaattagacgagaacatactacattttagctgggcacattactatcccaaaccaaactggggtgctattagtaaggaaggaaaagagtagatactgggcaggcaattagaaatctttgcagcaagacattcgggaaaggtattatttagaaaagtaccaaagtctttttgtgtccttgatgtggattgaatagagtgagaaaaattgcctgtgtgccggtttcccagtggaggtacatggagaaataagaattgtttccttctgcatggtaagcagctctccttgtccaattgtcccctattactgaccatggtcccacagcaatatagttctatttctaggaatggactaggaaaaaaatcccagaggagaaactcccacactgatttctacttctaaaattcaatgtatttgtacctcgcgtctctagaaaaattgtgttttagtatatcagcttttgaagacagctgtacctaaatccagccatccaaatgggacaaaggaagcagactttcaccttcagaagcagccatgagtttgtgtctgctgcattgcactttcaatatctaggacagaatttcatacttattatataattacagtaatacaatttgttattaaatagttgccaaacaaaatagaaatacaataaaaatttaaaccactaacctttaaatgatatattttgttttaagaatattgttcagctcagatatcagcagattaatgatgagtacaactaaaccccaatcagttgaaagaaatgtataacatatcattttaagatctctgtagtaatttattttttaaaaggaacttaatatcgtggattttaaataattgaaaatattttttacacttggactaaatgttcagatgatttttattatgcaaacatcacatctaattaaagatatttcaatattatatttcaagacattcagtaaccattcattaagggctgaatattatatagtgggataaactaaggccatagaatatttatgtccccagccataggaagttcgccatttattggaggagataaacacacacataactgaatttggttttgatcttcctctgacctattctattaattcaataatgtaggcctaatcattattgatatactttattcttgtcaagatttgccacattatttgccttgaagttatttattgcaaagggatttgttctctttaatggatggctctgcattttagcatatgcgtttgtctttgagaaaccaccaagaccaccaggctaagacattgaataattaacttgacataatatttataaagtagtgagctagaaagttttgaaagattctattaataaaaatggttcatcaaatttcgggggcaaatgccttaaacatttattaatagctaaacaatatatgaacttttcctgaggaagaaaacatttcttcctaagtagtttctaagtagtaaagtctaatccagatcttgttatatgcactgtagagttcttttttcagaaaacaacattgcatagtctatatttctttttataggacaggcagctgcgttagtgaatgattcactaatggtgcgaagtctttctgtcaaacaaacacacagttcacttagttgggcttcaagtactttagtttttttcctaaacaataactgtctttaaaagaaagaagctgtgtaaacattgaatacagactttaatttaagacagatgataacccggaagtgaccacttctctttatcatcaaaataccgctgaagccccagtgattcaattgccaggaattcttctttgcttgaatttgatcattcttctttctctttaaaatactgttgttaagcactggatcggcaatgtggcattgtctctagggattgaattatgtttaattgggaaggaagcacactctctcttgtttttagttcataaagtaagaagactatcaattagtaggcagtgcagcccaattggagccacgctgcactacagacagtttggaggagattcatagtaacaaacaagatttaaaatacatgtcttgtgaaaggccattataggtggatggctgggtttttcctgtcttttcatgctgtagcagcattatattagaatgtgaaggacactcatatccataaaataatggctttcgtaatgcagatgattaaagtaggaagcctacccacttctatttttccctaggcatataccaggatcaaatttcaattagtgacctaggaactgcaggctctgtattctgttatcaatccctttagccagctagaatcaaagattcacctgtcactctagactctcagtgactctaaggaggatttagaatagacatctgctctatcctgttacgttgacttctttatactgtctgtctacaaaatgcattatgaatatacagtgaacattacaaatattctaaggtccattaggaaatttcattttctgtggacaaggattttaatgttaaatattgatagtgatttctgctaatttattgttgatttgctaaaccaggccattttacggaaaaattttaaatatgccctgttgatcaggaaccaatatatatatttttcaaagtgtcagaatggttaccttgaaatcatttttagatatgaattgcagaattcctagaaagaaaatatgctctcttataggactgtgctttatcaggaaatggcaggttatctagttatattttaaagataccaaatttgtttagtgcagattttacttctatagtgctcaccttgatgagcatcacaatgatgttcttttatttttaaaatgatgcattataatcccattagagcctttgccaaccagtaaattattaataagacgatgatcatgctaattaagctactttattagattttgatggattttgtgccagaaattatggtggggtctttgaaatatatagagtattttctcttagagcaagtcgtctagcatcattgaaaactttactgaaaactcttcattactcataacattgctcgtctgtttcaaaatgacacgatagtcactttcacagaaacataatagtatgcaattcaaatgtttaatttgctgctgcaaaagaattcacaatagaattctcaatgtggggttaattacatagtaatgaaagagtaaacctattgggaaaatgctctaagtaacattgctctgtttcctactgataaagacgtgcacgcctgatttattttttatgctgggaaattcagaagtaagagaaaaccttgaaaaggtatgcacatgaataataaagttttttatcatttgtcaacatgatgagaaaatgatgaacgtggataattattatattacaaaggctataatcacaaaatagtaatgtataagaatatagcattctattatacacaggagaacatgatacattaaaatcattgataacataatctaaggaaagacatcgctaatcagaacaaaaaaaggaagaagtaatagagcaggcactcaaaattgtgtccatgttttctacaaataatcttcaccctctctgcctatgagtatagtgttatattgctaggtatgttatgtttactccatatatgtcaaagactccactgggggaattgaacaatgagaacacttggacacaggaaggggaacatcacacaccggggcctgttgtggggtggggggatgggggagggaaggcattaggagatacacctaatgtaaatgacgagttaatgggtgcagcacaccaacatggcacatgtatacatatgtaacaaacctgcatgttgtgcacatgtaccctagatcttaaagtataataataataaaaaatttggaccacaaaaaaaaatatggtatcttaataaatatctcaaaacagttataagattgacaatatgatccctactttgttaggtgaagaaaatgacacttttaaaaacataaaaagatttcctgtatgataggattcaaattcatatttgtttgtttccaagggctttttctcattcattatcctatgctgtcatgtaaattaatccatgaatattgcagcttgtatcagaagcttgaaagttcacagaaagaatcattttctacctaaatttgcccatcaaatttgggtggacagtgacagcagcacagtgttaggcttacttttaaatgacattatttaggatagtgagaggataaacaaatagactaaaagaacagaacggagtccagaactagatccacgcagatatggccaattgatcttccaaaaaggcaccaaagtgatgtaatggagaaaggaaaattgttttaaccaccagacctagaaaacttggtatccatataggaaaaaaataaatcttgatacttcataccatacacacaaaagtaattatagatggcacatagacctaaatataaaatcttaagctcaaaagtttctagaagaaaatatagaagaatatttcctggacctgagctaggcaaagatttcatagaaacacacaaacagcattagccacaaagaaaaaaaaaaaaaaaaaaagaccagtcaggcttcatgaaaaacaaaacaaggaaaacctgtgctcttcagaattaaacaaacaaacaaaaacactaagagaatgaaaaagctaagctatgggagaaaatattcacactatatatctttgacaaagcagttgtacccagcatatataaagatgtcatacgaatcaattgtaaacagacaacacagtaaaaatgggggaaagatttgcactgtttacaaagataaatgtctgataagcacaaaacatttaatgtaataagttattagctaaatgtaaattaaaagcaaaatcaaatactattgcacactcactagaattgctaaaattacaaaagattaacaataccaattgttggtgaagaggtgaagtaactaaactcacatactctgctggttggaatgaaaaatcatgtaactttgagaatctcttgggtaataactgacaaagttgagcatatagtcaccctatgacacatcagtttcacttctaagtatttactctgtagaaataaaaacatgtttacaacaggacttgtaaaaatatgtttttaataactgtttacagagagccagaatatattgcctaacattatttttatatataaaggttacagattttttatattaattttatatctttgtagattttttatttcttttattttaatctttagatctactactatatcacctacataggggcaatttaactcctctaattcttatatttctgattttgattctataattccttttattaatactctcaatagaacattaaatagtattgttgatagtggcccaactttaggtagaaatctactacattttttgaattgatgaatgaaaaattattttagacaatgtggaatgagtcaataatgcttattaccatatatatatcaccactaatctttattattttttgtaatgagaatatttaagatttactctcttattagtccgttttcacactgctataaagaaaaaactgcccaatacagggtaatttataaaggaaagaagtttaattgatactctattgagcatggctgaagaggcctcaggaaacttacagtcatggctgaaggcgaagaggaagcaaggcaccttcatcacaaggtggcaggaaggagaagtgtgtgagagtgcaggaaaaatctaccatttgtaaaaccatcacatttcatgagaattcatccactatcatgagaactgcatggaggaaaccacccccataatccagtcacttcccaccaggtttcttcctcaacatccggggattacaattcaagatgagatttgggtggggacactaagcctaaccatatcattctcttagcagttttcaactatgcaatacattattattaactctggtcatcatactgtacaatacattgtgagtatgtgaatatagtactcgtacttattcttcctgtactaactcaaaccttgtaccctttaatcaatattcctccatttggtgccacccacccaatacatagtaaccaccattctactctctgctttatgaattcaattttttttttacattttatatataaatgagatcatgtggtttttgtcttcctgtgcctggattatttcccttagcataatgttctctaggctaatctgtgtgttcattgaagcgttatttgcaatagccaaaatatcgaatgcaatgtaagtgtccatcactgatgaatggacaaagaaaacgtgatatatatatatatatatatatatatatatatatatatatatatatgtatatatatatatatgtatatatatatatatgtatatatatatatgcgcaatggaatactattcagccttttttaaaaatggaggaaatattttgagaacagtcatctacaaattttattttaccatcattgtttaatttacattattacttagaatagctatcatcagaaagacaaaagataataagtcttggcaaggatgtggcaaaaaggaaactctcaaacgctgttgggaatgtaaattagctcagccattgagggaaacagtatggaggttactcagaaaattaaaaaaagaactaccatatgattcagcaatgtcactactgagtatatagtcaaaggaaataaaatcagtatgttgaaaagatatttgtacttttatatttattgcagtattattcactatagccaagatatggaatcaatctatgtgtccatcaatagatgactggataaagaaaatgtgatgtatatacacaatggaatacaatttgaacattaaaaataatgaaatcctgtcattttcaataatatacctgaacctggaggaaattatgttaaatgaaataagccagacatagaaagacaatcactgcattatctcactcatatgtagaatgtaaagaagttgctgtcatagaagtaatgagcaaaagctgtgtttacaggcgagggatggttggggtactgtggagactggggagatactgatcaaaggatacaaaatttcagttagatgggatgaataagcccaaggggtctattgtacaacgtggtagctatagttaacaatatattgcattcttgaaaaatgttgaggatggatataaggtgttttcaccagaaaaagaataattatgtgaagttatccatatgttacccagctggatgtagtcattccaccatgtatatatatttagaacatcatcttgtactgtgcatggtaaatacatacaattatatctgtcagtttaaaataagataaaataaaataatataattactttaaagcttgtgaaggagtcaccacatggacaatataacagaaaatctctgctagattgaactttgtgatgaacacgaagtacttaataaacatatttctttgatctgtctatgcatggatcaatctgttcctgttgaggaccttataacttcctactgctcactcaacaggaaattgttctgaaagtgctctacccatcaaccttcaatataaaaatatacattttatgatttactcccagagttttgcagtggcacaactttacacaacaaatttgatcaaaatagaaatacttcaatcaattttctttggcgtaagtcaccttggtacttgtcctcatagggtttcgtgtatttcacattgagttgcatcatagtaaaatcaaggtgtatatcattcctatttccatttcacaaattatggaaatgtttcatgttactggttttgttttgctatttatttcagtgttgcttcatggaaaattgaacatagtaattaaaaatgacaaaattttaaaaatctatcatcttgaaatttgtacaatgttttcatgacattattaacaaaactaattatcgagtacagttacacgttccaaccagagctatgttgaactagagtacacaggagagctttttagtatgaactgatactcacacgtaagaattgcttatattttaggaagcgtggccaaatttctatatgaaacatccacttttacaaagtctgactgtattgttgtttatttggaaatagtagtcaaactgtaacaaaggtggaaaatcttttgcacggctgttgagaaatgggtggatcacgtagaataaggcttacaaaaccactagtgggttagcagccccaaacatctgagactatcagtacaaggaagaaatctctatttctgtagcctctgatttgctctatctcatatggagggcctaatgaaggaaagaaactgcattctaaatgatgcagagcaaataccctaaaagggaagtgcttggatctttattactttggagacctaaaagacaatgtactttgaagttagtttcttctggttaatctcttttacttgatgtagacacattacataaatccattgtcgtatgaataatacgtaacagcaataatctattatcataatgtttttaggtattcataaagtacattttctatgtctaaaggaaaagtagcagattattaaacttccagttttattttatgatctgctctgcctcttcaattcattccacctttttgttttgttttgttttttaaatacattcatatgaatgtatttttcaatttcttaccaaagaagcaatttggaaaacactgattgttcatttcccttttacctccttgtttcaatttatgttttgagtacagtacattagtttatagagactgtgattgaaaaaaaagagcttacaatcttcctcagatagctttgctctgagttttacaatggatggtttggaaaaatagtgtaataatgactgagcttctaaaatagtgaagtaacagttatttttgtgatgtaatatagtgatgtatatgtggctcaaaagggttgctatatattccccccaactccaattttatttttaatttttggttgtttttcagttttatgcaagacttgctatacctaattctacaagctatacagtgttttttaatattgattccagaatttgtttcatcatatgcaccagaacaaatacttcagtaaaacttcttctgcactttcttagacaaagacagcatgatacaggcacagctaagtctcttaagctcttaggtatccttaaaacattgacaaggaagtcaatattgaatttcagataacaactggaattttgacagtactcattagttagtttggtctgacccaggcttccatcagtgcaaactttatgccccaagagtctcacaaagcatttacagcatatgctacagaaacatagaaagggagcaggcaactggcagagtatgggcatgaggctgacagctcagagatgccactggacctgcctcatcagctctctgggcactactcactcttctgaaagtatttgaaaccttttgggctgttactttacacctggtaaaaagcatctatagaccagaagaacctgggaagagggtattccttcccttcagagccaaaacagagagttttatactcttcagggggtttccttcacaagacagttactcacaaatcaacgatattgaaattgtatatctgggatttgccctctactgtcactcatattgttcataagaacaggaacagataatatttattggtttgcaaccacacatagatataaactctaattgcttcaacagagttttatggtaagaattgtttagtactaccatttcacagatgagaaaattgaggctttgaaagcctgaataatttgtgaaaagatacaaagctcctatgtggtcagactggaattttaatctacttgtacctgacattggatcctagactcttcaataggttacacttccttcgaactgggaaaaggtagcacaaatcatttatttttaaatcaccgatactagttttgttgtttaaggcatttaatctaagttgacttccccaaaggactgtgcagatgttttctcaaattaaagtgatatttcagaacaacaagtactagaaaatttaattcaactaaacagtaaattctagaaactgggggatcttttggcctctcatacaattttattcgtataactatgtgtcccggccagtcatgataacatatacttgttcaattgataaaaactgaactgaattcaagtcatagacttactgtagaggcttgggcacatttgcagaatatacacttggaatatgcaatgaggaatagaggttaagaagaaaggaaataagtaattacataagtaataattatatagtaattacataagtaaatacaattataaataattgcataaaacaatatcattattattattattattattattattattcgaaatggagtctcgctcttgtcgcccaggctgaagtgcaatggcgggatcttggctcactacaacctcctcctcccaggttcaagtgattctcctgcctcaacctcccaagtagctgggattacaggtgcccaccaccatgcctgactaatttttttttgtatttttagttaagatggggtttcaccatgttggtcaggctggtctcaaactcctggcctcaggtgatcctcccacctcggcctcccaaagtgctgggattacaggcgtgagccactacacttgggcgacaatatcattattataaatacagaaaattcctgtttttttatatcagtcatcctagaacagagacgctatcagctcctggggataactcttcccacatcgtctggaacataattatatttaattaaaacctgaagtggtatctaaagataatgacaaagtattaaatgtgcagagggtttcagtctctcaaacaaatgtgagtttgttactatgttatgtaccatagtagtctaagggctattatgttgtttcttacattagtgtaaccatggtgaaaaccaaagagaaaataaagaatgattgttcatgttttaatgtataagagcacattgatacattgtaaaacacccagatcagttatttaatccatcttttgaaatcacagaagaaaactggtgatatacatgtgatgaggaatggcaactgtagtgatttatattcctctaattttttgcaaaaaaaagaaagttcactgaaaaaattacaactttcgcctatgctaaacttaatttatgtaaaatagtggtcacagctattaaattattgttatttattcacaaagttctcctctacatattgttttaaagtaataactgctttacagcatttttttttaaatggagtctcactctgtcaccaaggctggagtgcagtggcacaatttcggctcactataacctctgcctccagggttcaagtgactctcctgcctcagcctcctgagtagctgggattacaggcacctgccccacacctggctaatttttgtatttttagtaaaaacaggtttcaccatgttggccaggctggtctcaagctctggacctcagataatccacccgcctcgacctcccaaaagttctgggattacaggcatcagccactgcgcccagctgctttacagcatttttatagacgctcttctttgaacttactaagagttcattgaaatcagctgtgcagagtttaaatccagcaaggaaattcaggcacagacaggttggaggtaacaaaaagtaaaactggaaagtgaatcaaattttggctgaaaatttaatatatttaatagtatgtatgattcctcaatctaacttaggttaaaataatcaaaaataaaataaggtgaactactttttttttaatgggcaaggtggcagaaatggaatttccaaacatctagatcttaggtctttattattctaagcaatttttaatacaatttgagaatctttatttctgtactcttcttcaataataacattaaagcagaaggaggttccaagatggccgaataagaacagctccagtctgcagctcccagcgtgagcaacgcagaagatgggtgatttctgcatttccagctgaagtaccggcttcatctcactggggcttgtcagacggtaggtgcagcccacagagcagggtgggacattgcctcatttgggaagcacaaggggtcaaggaattccctttcctagcaaagggaagccatgacagatggtacctggaaaactgggacactcccactctaatacagcgcttttccaatggccttaggaaatggcacaccaggacattatatcccgtgcatggcttggagggtcccatgcccacagagcctcactcactgctagcacagcagtctgagatccaactgcaaggtggcagcgagactgggggaggggcgtctgccactgctgaggcttgagtaggtaaacaaagtggccaggaagcttgaactgggtggagcccactgcagatcaaggaggcctgcctgcctctgtagactccacttctgggggcagggcatagttgaacaaaaggcagcagaaacttctgcagacttaaacttccctgtctgacagctttgaagagagtagtggttctcccagcatggagtttgagatctgagaatggatagactgcctccttaagtgggtctctgacccccgagtagcctaactaggagacacctcccagtaggggccaactgacacctcatacagccgggtgcccctctgagtcgaaacttccagaggaaagatcaggcagcaacatctgctgttctgcaatatttgctgttcttcagcctctgctggtgatacccaggcaaacaggttgtggagtggacctccagcaaactccaacagaccagcacctgagggtcctgactgttagaaagaaaagtaacaaacagaaaggacacccacaccaaaaccctatctgtatgtcaccatcatcaaagaccaaaggtagataaaaccacaaagatgggaagaagccagagcaggaaagctgaaaattctaaaaatcagagcgcctcttctcctccaaaggaacgcagctccttgccagcaatgggacaaagctggatggagaatgactttgatgagtttagagaagaacgcttcagaggatcggtaataacaaacttctctgagctaaaggaggatgttagaactcatcgcaaagaagctaaaaaccttgaaaaaagattaaacgaatggctaactagaataaacagtgtagagaagtccttaaatgacctgatgaagctgaaaaccacggcatgagaactatgtgacgcatgtgcaagcttcagtagccaattcaatcaagtggaagaaagggtaccagtgattgaagatcaaatgaatgaaatgaagcaagaagagaagtttagggaaaaaagagtaaacagaaatgaacaaagcttccaagaaatatgggactatgtgaaaagaccaaatctacgtctgactggtgtacctgaaaatgacagggagaatggaaccaagttggaaaacacttctggatattatccaggagaacttccccaaactaatgaggcaggccaacattcaacttcaggaaatacagagaatgctacaaagatactcctcaagaagagcaactccaagatacataattgtcagattcaccaaagttgaaatgaaggaaaaaatgttaagggcagccagagagaaaggtcgggttacccacaaagggaagcccatgagactaacagcagatctctcgacagaaactctacaagccagaagggagtgggggccagtattcaacattctaaagaaaagaattttcaacccagaatttcatatccagccaaactaagcttcataagtgaaggagaaataaaatcctttacagacaaagaaatgctgagagactttgtcaccaccaggcctgccttacaagagctcctgaaggaagcgctaaacatggaaaggaacaaccagtaccagccactgcaaaaatatgccaaattgtaaagaccatcaatgctaggaagaaactgcatcaactaatgagcaaaataaccagctaacatcataatgacagaatcaaattcacacataacaatattaaccttaaatgtagatgggctaagtgctccaattaaaagacacagactggcaaattggataaagagtcaagacccatcagtgtgctgtattcaggagacccacctcacatgcagagacacacataggctcaaaataaagggatggaggaagatctaccaagcaaatggaaaacaaaaaaaagcaggggttgcaatcttagtctctgataaaactgactttaaaccaaaaaagattgaaagagacaaagaaggccattaataatggtaaagggatcaattcaacaagaagagctaactatcctaaatatatatgcacccaatacaggagcacacagattcataaaacaagtccttagatacatacaacgagacttagactcccacacaataattatgggagattttaacaccccactgtcaacattagacagatcaatgagacagaaagttaacaaggatatccaggaattgaactcagctctgcaccaagcagacctaatagacatctacagaactctccaccccagatcaaaagaatacacattcttctcagtgccacatcacacttattccaaaattgatcacacagtttgaagtaaagcactcctcattagaatcaaactagaactcaggattaagaaactcactccaaactaaacaactacgtggagactgaacaacctgctcctgaatgactactgagcacataacaaaatgaaggcagaaataaagatgttatttgaaaccaatgagaacaaagacacaacataccagaatctctgggacacatttaaagcagtgtgtgcagggaaatttatagtactaagtgcccacaagagaaagcaggaaaaatctaaaattgacaccctaacatcacaattaaaagaactagaaaagcacgagcaaacacattcaaaagctagcagaaggcaagaaataaccaagatcagagcagaaatgaaggtgatagagacacaaaaaacccttcaaaaaatcaatgaatccaggagctggctttttgaaaagatcaacaaaattgatagactgctagcaagactgctagcaaggctaataaagaagaaaagagagaagaatcaaatagatgcaataaaaaatgataatggggatatcattgatctcacagaaatgcaaactatgatcagagaatactacaaacatctccacgcaaataaactagaatatctagcagaaatggataaactcctggacacatataccctcccaagacttaaccaagaagaagttgaatccctgaatagaccaataacaggttctgaaattcaggcaataattaatagcctaccaaccaaaaaaagtccaggaccagatggattcacagccaaattctaccagaggtacaaagaggatctggtaccattccttctgaaactattccaatcaacagaaaaagagggaatcctccctaattcattttttgaggccaacatcatcctgataccaaagcctggcacagacacaacaaaaaaagagaattttagaccaatatctctgatgaatatcgatgcaaaaatcctcaataaaatactgggaacccgaatccagcagcacatcaaaaagcttatccaccaggatcaagttggcttcatccctgggatgcaaggctggttcaacatacacaaatcaataaacataatccatcgtataaacggaactaaagacaaaaaacacgtttatctcaatagatgcagaaaaggcctttgacaaaattcaacagcccttcatgctaaaaactctcaataaactaggtattgatgggacgtatctcaaaataataagagctatgtatgacaaagccacagccagtatcatactgaatgcgcaaaaacttgaagcattccctttgaaaactggcacaaggcagctatgccctctctcaccactcctattcaacatattgttggaagttctggccagggcaatcaggcaagagaaagaaataaagggtattcaattaggaaaagaggaagtcaaattgtccctgtttgcagatgtaaaatacctaggattccaacttgcaagagatgttaaggacctattcaaggagaactacaaaccactgctcaacgaaataaaagaggacacaaacaaattgaagaacatttcatgctcatggataggaagaatcaatattgtgaaaatggccatactacccaaggtaatttatagattcaatggcatcaccatcaagctaccaatgcctttcttcacagaattggaaaaaactactttaaagttcatatggaaccaaaaagagcccgcattgccaagacaatcctaagcctaaagaacaaagctggatgcatcacgctacctgacttcaaactatactgcaaggctacagtaaccaaaacagcatggtactggtaccaaaacagagatatagaccaatggaacacaatagagccctcagaaataataccacacatctacaaccatctgatctttgacaaacctgacaaaaacgagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaagcaataccattcaggacataggcatgggcaagggcttcatgactaaaacaccaaaagcaatggcaacaaaagacaaaattgacaaataggatctaattaaactaaagagcttctgcacagcaaaataaactaccatcagagtgaacaggcaagctacagaatgggagaaaatttatacaatctacccatctgacaaagggctaatatccagaatctacaaagaacaaatttacaagaaaaaatcaaacaaccccatcaaaaagtgggcaaaggatatgaacagacacttctcaaaagaagacgtttatgcagccaacagacacatgaaaaaatgctcatcatcactggccatgagagaaatgcaaatcaaaaccacaatgagataccatctcacaccagttagaatggtgatcattaaaaagtcaggaaacaacaggtgctgtagaggatgtggagaaataggaatgcttttacactattggtgggactgtaaactagttcaaccattgtggaagacagtgtggtgattcctcaaggatctagaactagaaataccatttgacccagcaatcccattactgggtatatacccaaagtattataaatcatgctgctataaagacacatgctcacacatgtttattgcaccactattcacaatagcaaagacttggaaccaatccaaatgtccatcagtgatagactgaattaagaaaatgtggcacatatacaccatggaatcctatgcagccataaaaaaggatgagttcatgtcctttgaagggacatggatgaagctggaaaccatcgttctcagcaaactatcacaaggacaaaaaaccaaacaccgcatgttctcactcataggtgggaattgaacaatgagaacacttggacacagggtggggaacatcacacactggggtctgttgggggtttgggggagagaggagggataacattgtgagatatacctgatgtaaatgaccagttaacgggtgcagcacaccaacatggcacatttacacatacgtaacaaacctgcacgttgtgcacatgtaccctagaacttaaagtataataataaaaaaattaaaaataaaaataacattaaagcaattgaatgtacataataatcagtgacaattttctagtataaaattttctttgttacattcttcatcagttctcaaaatatcatctaaaaggaaagggtgagccagacgaggtggctcacacctgtaatccgagcattttgggaggttgaggtgggaggatcacctgaggtcaggagttcaagaccagcctggccaacatggtgaaactccgtctctactaaaaatacaaaaataaaaatacaaaaccccatctctactagaaatatcacattatatatatctatatatatctatctatatctatatctatatatctatatatatctatatatatctatatatatctatatctatatatctatatctatatctatctatatctatctatctatctatatatatatatatatcagggcgtggtgacagacgcctgtaatcctggctactcgggaagctaaggtaggagaatctcttgaactggggacggggaggtagcagtgacctgaaatcttgccactgcactccatactgggtaaaaaaaaagaaaaaaaaagaaaaagaaaggttgttttaagtgtgtttgtaaggaagagggcagacaaaagaaagagatcattcaagatttacacaagattgtttttatttaggaatgcctttcttttgaaggtttataattggcgtttggttgagtttagtaagtgttccagacccagctctcttcagactgatggttcggaatccatctcagcctcatctccttttaccccagcctgtgacaagaagtgctttctctgaaaataaaaatcagtacacacagttctgttgatattatatttgcttctttgtcatatgtttaggtagaattagtggtaagttttctgagttttctcagtgtttaaaaaattcttccttaaaattggtgagtcaacatttatttccagttggactttgcagacatgttataggtgtataccttgaataactttctctttttaaggtttgctttctttcacgataaatgcagtaacatttgccctattaaatatgttctaagacttcattaaacacacactaaaaaacagaatcttaagtataggcattttctgctcatgtatcactcatctacttactccaagaaaagttgatcctgaagagatgaattactgttttttttgttttttctttttaaagttatttagggaaggcagtgtgtatttaggtaggtatgtacctatgtggttatttggttgttactatgttatggaccagccttctgtgataaattgtagagtttattttgttacgttgttgcagcaacttccttgacattattagaggggcagatttccatttcctgaacagcaacttaataacaactcttgatgaacttgaataccatcagtaggtctattctcagtttccttctcatttggctaaagaagtggtctcttccctgctttattgcataggcatgaacattgagttattttttcattgctttggacattgattctttctaatgacttccagtaggctacctttcagatcattcttctttatagttttacaaaatgcgtcatacattttaaacgcatcttccgtttctctatgtttcataaaaagacaatttgtgtttagatctcatctttctgggagttctttgaggcttatattcctaatctttcaggtgggaccagtcttcaggaagttattcggagtttgaaaagataagcagtttatgtgaagtgtgtgtgtgaaacaaccctaagttaaagcctaaagtaatctacaaaatagtatttttgtctctttgtatatatttctgtgaacattcacagtttggaattaaaatacggtgcccttacgaactataatctatgacaattatctttaaacgtccaagctgtgaagcagtagaaaaatctactgtgatttgggtaaacttttcttttcttaactttctttgttatcttggaaaaacataacatattactaatatatttttttaaaaatttgtcaatgttcagtaaagtacagaaggcacgcttttaaaataaaatgcttaatgtttaattcagcacaactaaaaaagaaaccaaagttttcttaattaaaattagttatgataattgtattatgaatcagcaatattcccaaaaggtggcatgcttgaaacgtggaatatgtttgctaccaaacagtcttaaaatctacaaagaaaagaggaatattattgaaagactcttatgacaattgtcttttttgaaacatttgtgcacattctaaaacaggttataaaagttatccaagtgtgatgctcttgattattaaaagctaaacatttcaagtcagtctgtcaattagtatttttgactgaataattgaaatctttttcagtaatgtttaaattgcactatggcttttccagattttatatgtatctaaatctgtatctatctgtatgtcttcaattaaaatccccactttattatgtcacaaaaatgaattaatgttggaaatatttgtgaatacataaaaactttatgtgagatagatacagcataaaacaaaagttagcaggttataatatacaaaaataaaatattttctttttggacctagcagcatcatttgtgtaatgcataatgataaaagatgcattaggtcatgatagttcccaacatgtattttaatggtatatcaacccttcttttccttgcagtatcatagtaatcacttgtgtgtatttgcatgttcaattttacaaaatcaaaacaatgtgtacctaatacctaatgtttaaaataattataaattataggtttattttgttactttgttgcagcaacttagcaacttccttggctcacattcccccacccctgtttttttggtggtggtgttcttgcttttgttttgagatggagtttcactcttgttgcccaggctggagtgcagtgggatggtcttggctcactgcaacctctgcctcttgtgttcaggcgattctcctgcctcagtctcccaagtagctgggattacaggcacccaccaccatgcctgggtacttttgtatttttagtagagatggggtttcaccattttggtcaggctggtctcaaattcctgacctcaggtgacctgcccatcttggcatcccaaagtgctgggattacaggcgtgagccaccacacctggccatatttcccccatttttaatcaatccattgctaagcatccaatggactgtactccaaaaagctaatttgttttgaaattggaatttgttttctatagactcagcagtaataacattgggtaaggtttcatactaacttcatgaacttacttaaatgataatgcaaatgaaatacacttaaaaattttctaatgtagcaatatacacggttgcatactagttattaatcactattcactagaaaataaacttggaaattaatgaacatttaagctatttttaaaaaacttactatgaatacttaaatccagccaaaaccccttggattgttaactctgtttaccttaaataagatcagaatcgagttagaagtggtcagacacagtggagcaaatctttctgtagaagaagaaacagaaggtttagaagatagcgggaaataatgcttgagcacccaagggctctgaaggcataagccaggtagtgaaagctcaaatctggtccaagagctgtgaaatggtaagaaattaaaaaagaagtccgaaaccacatgtgagtaacgtgaaagacatggaatgaagcaggcttcccacctgacatgtagggggaaggaatcaggcactttggagaatttcttcccagacatgaagctggggaattttaattgatagtgacaactgggcgcatagcagttgctctgtaaactcaaagagaaagaactttgtagaagtcttactaccaaccaacaagtacttttcctctttcttcaacagaccctgtaaccaaaccacaaatccataaatcatacaggtgaattcccatagctctagtatgaattacttatacattaaacattttacagataaatgacactcattgttggtcatataaatattacagtggacccatgttaagctattgtggaaacacagaagaagagactcaaatcaaattggagagaatatgaaagactttcagatggccacaatacttcagctgaaagttgaagagaataattttgttaatggcattgcagctgttgtgtgctgaggtattaatgagcccctacattggctcaggtgagaaatattataggattgatatgtagcagaaaggatgaagaggacataaactcaaaagttatttaagaatctaaaaatgtgtggttcagatgaaaaggagtttagaatgatgctttgatcttcttctagtacaactatatctttgttgttgcttttcaaagatacaaggaatacttgaggaggtgtatgtttgaggagaaagatactgaatttttgtttggacacagcaaatttgagttgatcattgcattagggttctccagaggaacagaactaatagtatagatgtatatatgaaggagagtctattgaatattgactcacacgatcacaaggtgaagtctcacaataggccatctgtaagctgagaggcaaggaagcaattacaagtcccaaagcctcaaaagtagggaagccgacagtgcagccttcagtctgtggctgaaggcccgagattcccctggcaaaccactggtgtttcagtccaagagttgaaaagctgaagaacttgacaggagactgatgtttgagggcaggaagaatgcagtatggggagaaaaatgaaggctggaagagtcagcaagtcagctccttccaccttcttctgtctgctttattttggctgtgctggcagctaattacatggtgcccacccagattgagggtgggtctgcctattccagtccactgacttaaatcttaatctcctttggcaacagacacacccaggaacaatactttgccttcttcaatccaatcatgttgacactcaatattaaccatcacagtcatgtattatacatgaaggaaaatttaatataatattggaaatgtatgctcatacattccctatcctatagataatgtaaggactcaatattaaccatcacagtcatgtattatatatgaaggaaaattttatatcatattggaagtgtatgctcatacattccctatcctacagataatgtaaggacagagactcccgttattttttctatatgttgaaagagatcttcccaaccctgcccctgtatgtaccatccttagatttctctaccacagattgtagccagtctgtttttctccagttgttcagtccaagaatatgaggtcttatttgactcttctctcctgctcacatttacttgaaagtcctgttaatgctacctaacattacatctggatttcaaacacttctctgtgcatccactttctcactcctttcaattcattatcatttcaaacctgaaatattgcaatgacctacccaatggtttaccagcttctagcttttacccaagaactattttcaatgtggcaaccagaatgaccccttaagtaaaagtcaaattatatcacttctctgctcaaaaccctgaaatggctgtccatttcactcaggatacaaaccaatgtctttaaagtgacttacacaaaatgcctacattacctcttccctcataacctactattctccctcctgctcactcagctccagccgcagtggcctttttccaggctttcgtacatactgtcatatttgaacctcaggacctttgcactggctgtttcatcttccaaatatcctcattagcagcacctttgccactttctgctatcagttcaattatcactttctacgctctgttcaactattctatttagaaatgcaatccaaccaagcacttttctcttctccacattttcttttccagatagaattctaacttacccaatttatttgtacatttttcctactgtctctgctattagaatgtaagccacatattagggatatttatctcttttttccacagaggtatgtcaagaatctaaagtagtacctgacatatagtaagtgcttgataaatatttttacagctttaggagataaaattgagaaatgaaaaatgtctatattgaaggcataatgtgatgatttgatgcaaatatacattgtgaaattattaccacaatcaagctaacacattggttatctcacgtagttaccttattttttgtgatgagaacacttaagatctattctcttagcaaatttcaagtatacagtatagtataattaactataggcaccatgttgtacatttgattctcagaacttattcatcttaaaacatttctccatttcccatacctctgatcccctgacaaccacccttcttctgttgctgtgatatgatttttttttttagatttcacgtatcagtgaaatcacatagtatttgtctttccatgtctggtttattttatttaacataatatattccaggttcatccatgttgttgcaaatggcaagatttccttatcttttaaggttgaataatattttattatatatatcattgtttctttattcatttattcgtggataggtacctagtttgttttccatatcttagctactgtgaataacgctgcaatgaatgtagcaatgcaggtatcacttcaagatattgatttcatttgccttggatatatacccaaaagtgggattgctggatctagacttcctttcttttctttttttttttttttttggagtggggtggtctcactctgttgcgcaggctgaggctggagtgcagtggtgccatctcggctcactgcaacctctgcctcctgggttcaagcaattctcatgccacagccttccaagtagctgggattacaggtgtgcaccaccacacccagctaatttttgtatttttagtagaatggggtttcaccgtgttggccaggctggtctcaaactcctgacctcaggtgatctgcttgccttagcctctcaaagtgctaggattacaggcattagtgaccgtgccaggcacaatagttctagatttctgatgaaactttgcagtgttttccataatggctgtaccaacttacattccaaccgaagggcacaagggttcccttttcttcacatgcttgccaacatttgttattactcatctttttgatagttgataaatacttgttgtattaaaaattagatgttgaatatcactagttttttttttacaggtgcaagccactgcacctcaccactaatatttttaaatatggtttttgtggtcatatgttaacatagaaaatatgaaaatattaagaaaactaatttttaaaaaattgaagaagaatatgattaggttgagttaaatatgaatggcttttagagctatgcaaacaattaaaactaactgacaagagagaatttgtaaagagattaagagtgattcataagtgctgggtatggtggctcacacctgtaatcctggcactttgggaggccgaggcaggcggatcacgaggtcaggagttctggaccagcctggccaacatagtgaaaccctgtttctactaaaactacaaaaaattagccagacatagtgttggctgcgtgtaatcccagctactcaggaggctcagggaggagaatcgcatgaacctggggggcggaggttacagtgagccgagattgcgccattgcacaccagcctaggcaacagagcgagactccgtctaaaaataaataaataaataaataaataagagttattcatatgtgtggatattcacctagcaagggaacagctttctggattttttgtgtgtttgttttttcattatattctgctatactgagtagagttttccattaaaatttttcctgattattatcaatggacaatcaccaatccttcttagctttaaataacctctctaggcaaacaagaactaagtagaaaaaaatatatttgagacaaaacaatattttatagtatagttaggtaattattgcgtttggtagtttttgcaaatttaattgtatttctttgagcctatttctttgatattcgttatttagaggtgctgaaagagggaagcaccaaaatgaatcacatatgacaagtatacatacaagcaggtttaaaaaaaaccagcaaaatattttaaatagctaaataattttctatttgtcatattttaaatctcacttaattataatcattataggttcaaggtttgttttaatcaactcaagtaatattttctggaaagctatgagcaagtgttttatgaattctaactctttggtatcaaaaacacaaattggcctgtttcgtttttcatcatgcatcaacaccagtttgggaattttctttggccaaaatttctattaatatgtaaaagaaaagatgtgttttcttaaatgctctggaaatagtatcataaaacatatataatgtgtaaatttaataaacttttaaaaatattgaaatgaacatcatatatttttgaatgatgtgttgatatcttaaatagtgctacagaggtaacaaagtttaaattaattaaaattatattcaccttgaatatggaatctatttcatgtcattaattcagctaaaaattagaaactaaataaattatattattgaaatttaaaacattgtagaaatttcaaaaaatgacaaatttgctttgtacctttatttcttctacaaattcttaaaaaatgctcttagtattttttttttttttttttttttttgcttatgatttaaaatatgatatttactttggaagtttcttcttttttttgttaccagttcgtgttatttcttgggttttctttttcacctaccatccttgtatttcttacaatttgcttctgaaaatacctatttcttctttttaaccaaatagctcaaggctgggataggatgcctcccaggaaacatctggcaatatttggagaaatgttttgttgtcacaattctggggagaggaatgctactgacatctagtgggtggaggccagggatactgctaaatatcctactgtgtacatgaccacccccaaagcacagaattttccagcccagcatatcaatagtaccaaggttgagaaattcttattgaaacatacactgcgcagccaccttagtggtccagatttctctacattccaaaaattttattgaatttattctcctttttgaccacaaaattcctgatttttctctcctctttcttgttttcatttctcagattaatgattctgactatgatgtgattgaggggcattgcctttggaaccattcagttaccaccacactagatcttcaataattaattaagttctgatcattacgtgttttcatttctgtgtggataactggaggaatcttgtaattaattagcaaccatgtgtagtacagtgttaacacttgctagaaatgagtgggctctttcagaattctcagtttaagaactcttccttagtgtttttcaacgcattttgtttggaatacagacatgcaagatattctgcaggggaagatcatggtctgatagatctggaaaatgctgactttttggtcccaagaagctctgtgatatttaccaatgaacctgagaggtcctgaagtactaaagcctgcttagtttggttttctgcagctgtgtgtgtgttttttttctaataaaattgttttgtttcgttttaatcccttaaaattcctattaacatcaggaaatattgatataatcctatctgctttcacaagattctaaatgttcaaatctcctcaccagaacaagtagaagtaaatctgctcaaaggatttttaaaaaaaactggcatttttagtgaattacgtgcagagaactttatatttagttttaattttgttcagttaccttaagccttttttatcttattatacattattagagtaaatttacatttttatctaatctcatattaaggattgaataatacactttttgaagtttacaatagtgtacatattatatgtatcttgttttaattttctccaggtgtttttaataattgaattttccagtttgtttgctgtaaacattgaccatttagaaaataaattgatgtaacactatctgcttcctcaaataatccccctcacctccccccacaacacacacacttatatcttgcttgtgtagtttatagcatagtaaatatacatgcgtattttagggtataaggctaaattcaaatctgtgatgctatatgccatatgtttcctgacctatttgacaaatttaattgccccttaaagtttctattgcttctgtaatgttataacttattttttgtaatagttggtatatttattttctttacagaacaataatttccatgagaactaggactctaaaaattgctcagtactgtatggtatgtcatatagagatcctgacagaatgccgtacatgcaaatatactcagcatgtgttagttgaaaacagatgatgagactcctaacttgtagtagcatgtaatctatatgtggataaaagtgtgctcaagcagtagctattaccaatgcacagctctgaatgactaaatatctcaatcaagaatatcgacaataaatccaggagctgtggctcaagcctgaaatctcaatgcctagggaagctgaggtgggaggatcatttgaagttaggagttcaagaccagcctggccaacagtgataccctatctctacaaaaaacaaaaataataaccagagatggttgtgcacatttgtagtcccagctattcaggaagctaaagcaggaggattgcgttgagcccaggggaggacgcagtgagctataatcctgccattgcactgtagcctgggtgacagactaagatgctgtctcaaaaaaaaaaaggaaagaaaaaaaagaaaaaaaacccaacataacaacagaataccgaatacccataataagaaatgtaagattctccatgaactccacatttttgggcttagtaacttgactcttaccacctaaattcaactcatttaaaactataggccaggagcagtggccacacctggctaatttttgtacttttagtagaaacagggttttgccatattggccagagtggtcttgaactcctgatctcaagtgatccgcccacctcggcctcccaaaatgttgggattgccagcatgagccaatgcacacagcctatagttttaaatgaattttgctgattctactataggctgggcgtggtggctcacacctgtaatcccagcactttgggaggctgaggctggcggatcacctgaggttggaagttcaagaccagcctggccaatatggcgaaaccccatccatctctactaagaacacagaaattagctgggtttggtggtgggcagctgaaatcccagctactcgggaggctgaggcaggaagaatcgccttaacctgggaggcggaggttgcagtgagccgagatcactccactgcactccagcccaggcggcagagcgagactcatctcaaacaaacaaacaaaaactataaagaaagcacccagaggaggaaataatcaataaattacatatttcctggacaaataatacttcatagatgcccccaactttcccattcattgctaaaatctcatcataaggttgtaaatccaggattacatggagcacaagtttcacagatgttgtttgactcattcattcattccttattcattcaatatgaatttattatattttaggtaccaagctatcggctgaaaccagctgttagaggatggagagtatccagattgttaaggaagaaatgggtagatcatctggtcagtagtaataatggtaatggatccccagaggcagagtcaccttggggaatataaaatgcattttaatttgaatcgataaggaggctgatattgtgaatcattaaaaaataaatttgaaaaatgtaaagtagtgacagaagcacatggtcaccaggcaagaaggctaagaggcagttttgaagccactgcaaggtattctttgaggaagtgaaggatgaaagctctgtgtttaggtttctggttctaatacatcctttaacaaggccatattgtaagagaatggttaaggtggggctgttcagttggagtgaaattgaccgttaatgatccatctcagtatgatgggcaaagatgtattacatgaacctggtatcagaagagtgtaatctttgtagctctcacctatgattacatgattgccattaattttagaatctacgtggaatcttaatgattgtgaatgactgaaaaccattaagaaaactttagagactttctggataaaatgcaatgactaagttattattcgatttatatgaataaatatattcttagtctttatgtgcttttcggtttccatatgcacaccctttagttctaagtttggattttcctctataatattacaattgctatttctttgtctgtctctctcttccctcctcactccattctttccagtatccttgtctatttttctttctttctctcttctttttctattgttgcatcactggccataaccctattgcagttgtgaaatatttagtggcctcagcttatgtccctagtgggagctatggaaagtacagaaaaatgaaaagtgactcacgttattctagtgtgtctctcactttccacagctacagttattgctacccttggggaaatttacatacactataaatagaaatatatactttagaaagacatttaaacttcttcttttacatgtcagaataaacaaaagtactagtaaagaaattatttctgcactaaataatgaattgatcctcataatgccctgtaggtatggcatattgagggacaaaaattataagtctgatttcaaacttctaagtgttgaagactcatgtttgataatttgataattgggggaaaaacagagcaaataattccctttttgtctatggatcatattgcctctcagttcctttagaaaaatacaagttaattaagcttagggactggaggcgtaaaggatagtaaaaggaagaaaaataatttagctttcagaagatcaagagtactaggggaagtgattttggctctcattttttattgaaataaaaattgacagagaatttggacatcctttggaaagccaggcaaaggaaattcagtttatcataaacaggataaaaatcagaatatccaattccctgggaatcagaaattctccatgaagctgaattctgcttcagttcatctctgactcattttgtcattcaaatatgtgggatacctactatgcaccaagcattgttttagctgccggagattcaatagaaatgatacggctaagttcctggcctccgtgaacccgacattctgatgtgactgctttattattagataatgtgtaagcaaatttgccattgtgtgttctaaattaagtaaattggatttaaaaaatttagaaagactatcttttggtattcttacaacttactatttaaaataatacaccatttgaaagaaggttttgtgcctctagctatagccacaagtggcttcatgccttcagaaggggtcagggaagacaagcagccaggaggcagtagggacagaatagttgctttgaatagagacaggtttagtccagttttgcctgagagggttagagatccattctgctctctgtccttgccatggattctgttgtctttcactccagccccttctgctcaacatgcatcattctttgtttccactctgcagtcctttcatgctgcttacttaggtgttgtaaattttgaatgactctaatgtctacagcatttcctgaattttacatctggacagtattgaagggcagcggggcctcccaaagagcctgttttgcttgactaagttcttttgctgtattgatttagtataagaaattctgggataatgttcaatttcttcatggttcttaaaaatttcaggcatcaacaaaggctgtgtattccaggcaagagatacaatatgaagaaaaaaaacaacaacagactattatcagcttgttcaaacacaaatctctacaggttgacattttcttaggattggttcccagaatgtgatgtattttcttctgtgggtgttcaactcatttgctcttacaactgaaaaaaacagcagtaaaagccaaattgaaccagtccagctgttatactattacttttaaagaatgcctcaaattcttagtgtttacttctagtttagttcgtaccggatttctcttcacatgtcaagctatgaaaaaacaagctgacaaatcaaaaggttgacttcccaatgtcttctgataaaaataatatttgaactattctatctgtaacacaagaatatgtatttatatgtaagaaatcctttggctcttccctcttttgttatttacaatattgggtgcattctcatgatctttctttgctattcattttatttatttttactttcctacatagagagttcttattgtttctgttgtttcataaattttagaagcctccaattttagaactaaaagaaccatattgtagagatttcatgatcgccaagtttaatccttcctcttacctatgagaatgcctgtaggttgcttgtattttattttatttcataaactactggaacatattctttatttttatttttatttttttattttttgagacggagtctcgttctgtcacccaggctagagtgtagtgacgtgatctcggctcactgcaagctccacctcctgggttctcgccattctcctgcctcagcctcctgagtagctgggactacaggcacctgccaccatgcccggctaattttttgtatttttagtagagacggagtttcaccgtgttagccaggatgctttcaatctaccgacctcgtgatccgcctgccttggcctcccaaagttctgggattacaggcgtgagctactgcacccggcctggaacatattctttatgtgcttgtatttcttttctgttaatatttagatctatagtttatttgcagctactgtaaattttgatacatcagatttatcgaacatgctacaaagagtaaattatgtcatagtttgctattttctcatttagatattactccatacaatacagaacataagctttgggcatgtttgattagtaatttaagaatcctttctatctatacaagtagtgacctacgcatcctccatttggcctccagtgtgcaattctgtgtgattaacattttaaaatttcctatttttttaatgctaacttttgtaatcttcaggtgtcagacgtttagatgaaaacagtacatctgctaaattattgctcaaaatattacatattttatgcaaaattgaatggttcacctacaggtagaatgaagagaaacaaacaggcaaaattattctttcagttctgttcttatcatcatacagttgggtctgcttattactaaggttagatcaaaggcctgagataatttagctagtttcctatctagataaacctagacttggtctaaagccacctagcagctctgtgacttgctatgatttagggctgctgttatctcccaaatactggttgtaaattaatgaatgaatccagaagttaaagataactgagacttttacaacatgaagattttcctgactgaaataaaccaggtcatgtgtcactcatttatattttaaattggtttaattagtctgctcctctgtgatcacctagtgaacataagctcttttggggaaacagaagttttgagagagaaggagatgaggggatagtaagaaagggatggttttggagtggataatgaaagctatgatcagatgaaagtgttgcagatgggaacatggccgttctggacagggtatcgccatggatgacttaataacttgggacatggggtaaataaaaatagaaccgtaaggaatacttggggagggggtgtaattgaccctaaaataattgtggaaagccaagactatctgatattttttgatatcaaagaaatataacctagaaagtcagaaaaaaactttagcatttagttcactaaaagaaataatgatccaaactaattgatatgcctgccttaaacacagttttctatgaattttaggctcatatacccttataggaaaaacatgatcacacacacacaaatagcatgtttttcgagaattattaaatattgggaacctgaaggtatcctagagatcctaagatccaaactcttcatttagtaagtgaagtaaacaagtcccagaagattaagtgaattggccaggtcatagagcccatcttcatgcaggattttatagtctgaagtgatatttcaaaattgggggataaatgcttcagacctttcaaaatttaattattgtagaatatagattagtgactaaaatgaaaagaaaaagtttcaggaagataatctctattattttggtataaatgttgacgaagaagagataaaaaatatttttatggcaacggcttgttggatacgttgccgaattttctttaaacaatatgaaatgatttttagtaggaaagtgtcagtgctgtatgtgtgtgtgtatatgttacactttctccgccacttccaagccattcacagttaaacaggatttcactcaaacattgtaacagcagttgccaaagcactaaactctgtatgtttttggatgtcttggtacaaagaataagtaacaggagaaacaccctcagggaaagtttagaaactctgtgtagcttttttcactttaataattacaacagtgttaattcacagcctctttgactagacacttaggatttaagtagcctagcaattctgccttcagctactagtgagttcttttgcatatttatcagatgtgcccgcctttctttttatttcatttttttctttttttctttccttttctcttcctttccttttctttcttcctttctttatccttcatttttctttcttttccttccttttaatttattttttaaagttgttaaactttaagataaaatcaatggggcatatatccattctctatcaaaatagatctgccttataaatatgtttcatttaaaagtcgataaatttttaaattcccagtattaatgtgtgattattttatttgcattatctctttttttaacctagtatattaaaatgtatgtattcaacacacagctgctgaggagctctctcccaccttcattcttcctcaatcaacagccctctctatactaggcactgttgtaggaagtaatgattgttgtagcctccatttattcttcataccaaatactaaattatttaggttcaatttgccgtaatgtaatcttcaccacagtctttgaagttgtatatcattgtcctcactttatgtattaaacaaaattttaaaaaatgttcaaagaagttaatatcaccaaggtcagtaaccagtaagtaagtttgtcgtggttcaaaaccagttcatctgaagttcagagtcgggtgtatgtgctgtgccttgtagactgtgtttgaacacaaaagcaggaggagggatatcatatgctactggttttcttccttctactctgcctactatcttctttcttggctccacttttcccagggcatagtctataaatttctgagaaacattttgcacttctgttatgagtaggaactctttcatgacttcaacgttgcatttgaatgcatatgcttctgcaaaatgtaccatcatcaagttactttaagcactttgggggaacaacatgatgactatacccaactttgccaacatacccatgatatgcatgattcactttcattattttagtataaatgatgccaaaataaatagaataaggaggttaggatttaggagagttgggtgtttcagctctgccactaaacatctctgatatttgggactaatatcttaatatttattggctttagctttcttatcagtaacagaaaaaaagttctagatgtgtttagggtaacatgccatgataaatttttattattatttctaataagagtagcacaaggcttagcatatagtaacatttgcaaatcttaagtgtctaaatcaatgcggttttacatatccttccataaccgtgccacttgataatacatttttttctcatgccatccaataactttttttctctaaaaataggactaggatagtaactgcagaataactaaagacttcacttttttactgctcagatgaacattcaaaataagtattatatggaattttgctgtagttttatgcttacttggcaacacaagcctggccttgtttctgtaactcaaggtttttgaccatgaatggaagttaaattttataatcagagcattttctaagtcttgtcccacaaaaaaataaaatataataaaatggaaactgttcaggccctagagagaatttgctggtcaagcacatatttacacaagtagagtgcatggcactcttgatattgtttctttttcaggagctgatttaatatcctgccttatgttgatgtgcaggctcattggtcatgtaggttagcttagagcttatattcccattcttattatttctggaatatattttaatgtccaggttatgttgaaacttattctaataataaaaatagctgcaatacagagtctccagtgctcacagaaataatgtagaaacaatactttatttaataaaaaagaaaaagaaaattttaaatctaaaatatttagtatcttcttccctgaaagcaaactggagaggaaatatgaatgagaataactgtgtacttgtgtgagaaaaagattctagagacaagagaatctttttgtttgtttgtttgattttgtctaggtaggatacttcactagtccaataatctttcctctaatgtttaacaacattcccacagtaacactcctgaaaatggctatgcaattgggaagctcaaaaatttgtaggagacatgtacatattatctgtacatattttcattcttaggaaaatagcaagtctacatataggcaagcagagaaccatttcctttctttctggttcatcacacttccccaagaatacatagaatgtgttcttccaaagcagcaaaagggatcctctcatgagttctttttttcacagcttgttacaactgcatgtttatgcatcttttcttatccatttccatcgcttcactttggatctctgcacaggattctgacaagctctttctccttctggcacagcagattaatccttttctaacacaacttttaccctttaaattattgatttgaaaatatccttcccaaatctaacttcattctgtttgacttcgtaggcactcacgtctgatccagcctcacacatcgaacttcctcactgttcccttgctaactcatgtctctctcactcttgtacctctcttgtaagatcacatttaaccacttcctaatatgctgtatctgtactccaattttctatctaggtcctgctcatctttctatgtcctattaaataccaccttttagtgagagcttctcttgtcattgttcgtatttcttgttcctttattttatacattaccatttaattctattaaaaattccttttagctaacaactacaatcacagttatcctataaatgttctcttcttggaatggtatttttggacattccatgttttgcaaaaggcttctgttttcaagatttaagcttgattctgctttactttataaatgtgtgccatgtccagtgcctctgttattacctcccaccagaggatgccaggccttgaagaaccctgcctgcatctcacaatataaggagaagaaaccagaacaattggtgtctgggattctagcaggacagatctcccacttggtcccatcagccatgggattcattagctgcagttaacccttcattggtcccaaactcttctctctgaatattgatgagaagatacctggaactttcatggccttccagcattttccccctggttttaatcaagcctttggtaatgagtttgtggcttgctctcttaatgaaccctatggtatgatgaaaactggtaccctcagtaaaaggccatccaactgtgactaaagggctcagaaacaagaggctgagtcagccagtgctgccgcagatctgctgtcagcaccatcaggagaatttatcaccacacaaataataataataataataataataataataataaatgtgtcactgcaattcctactagaaactcaactgccatcagagtgcacaaagtcccaaatttatataaggaacagctgggtcacttccatgacattcaagcttgggctggagtagcgacgttttgtctaagccaactcagaaccctttataatactcctcccacctataattttctgttttaggctctctgaaatatcctccctttctgttacctttacctgaccattacctcgaggaatctctcaaggctcacactcggaatcttttttactgcagcttgtagtccacagtagctggctctttactttgggcacagctattgatctctgcccggaagtatggacttgatcttgggacttccccctaggtctcaaggtctcccttgtgaaggctacctattttgttttccctttcttccatatgcccatgctcaactcccaagatcccagatgcagaaaagctccagctttgccccgaaccaactactcagtatgctcaaaagcaaaaatcacggactataagtatgaggaacttaggtgctgtactgaactttgcaactctcatagtatctaacagaatgaggttacatgttaagtattatttgattaatcaattgataaaatgtcttgtagataaacaaacaagaatccaaataggaccacaaaaatgaaacctgagacttccaaaataaccgaaatggcaggcagtccatgagatagtgtggaacataattgacactaaatagactccaaacaacaaaagattgtgtaatcctaaacactgaagcctactgtaagaaattataatactgtatgatgctaatatggagaattacagtagggattaattaaatgataagagctaagagaagaaacattagttaatagaatatattttaatttttatttttgtgttctgctctattctcttggtctcaggctcagctaaataccatacgtagaaggattaccaacctcttcctgaaagcttgaattacagttccccaggtggatattggtacttcatgaaggatggttggagttgctgaatattttacaaaggaaatgcgtgtggctcaaaggataatctagttatcttgatgaatttatcctttgtagttgaaagaagttttgaaacattagacttcaaagaaaagcaggaaagtgattgagcatttatgtaaatactccctaattgcaaaaaagtggttcttagacatttctaaattgagtgagataaacatcaaaagtgctacattattttctattttacaagtgtcactatctctctttccctccatattcagagatggtttttctgtatcatttctgctaaaagttaaagaaataaaaacgaacatcccatattccaaaaatcacgctcaaacatgggagatattttgaattcagaacacaggttgtccaaaaattaatattacgtccagtggtcagtttcccaggccaatccataaacattctataaaccctagactatagcttaaatctagtctaaacataacacatttgtattaaaatatgtagagtaagctatcctgtaaagattgtaagaaagaagattaaaaaacacaattgaaaaaaaaatactactttttagtgcgatggctgggaggaaagtatgtttaattagagcaaggaacagcaaaccaaactgcagactaaatcaggccacccacctattggtttatattttttccatggctctttcatcctaccatggcaaagttgagtaacttcgatagagaccatgtaactctcaaagccaagagtatttacgggttggaactttccaggaaaaaaaagaaacacacaaatgctggctctgaattgaaagaggaacaggagctagatggaactctctgtaaattttaatgttaacttctgtactgtgagctcctccaagggagcagtgctgtggctcgggcatcctctctccagagatgaggctcgtgcctggcacgtagtaagtgctttgatacagttctagtaaattccaagggcttgataaagcaattcctctagttctttctcatttcatttcagttcaaaaattacacatataattaaatattattttcagggagtgaactttttattattctttttttttttttttttgtagaacacaccgagcttctttctgtgggctaaagtaggcttcagttttctaaaccatgcatgggtatttggtgtaggtacttggaattaaaataaatattctgtctggagtatgtcctcagatataaatttttaagataaaagtcagtaattatcttattcagtaatctttccatcaggcatttttatttatgtaatgtatcataccgagagaggtgttaaaattgtttctctcaacttgtttggcaattgctgacaattattgcgtaatagatgtgtcagtgcatacagccagatttttgttaaggattgtaatcactgtcagtaaaacaaaccctctcaatcccatatcataaaatgtgtgctaaattctactctgcatattactgatattgcattcatgtttgcctatttccattttcttaattttattcagtggtgtttactgaatgcccccaataaagaatagggaattgtggctcatttttatcttacctttaccttcattcccccaaacagcagcaacaaaagcaacagaaggaaaaatgattttgtttttctgtcttctttcatgctgtacatatctttcttactgtacactttccctcaagaattatacgctttaaatttgatttgatatatgcttattcaattatacatgttacttgataactaacttttatcatagttattgaagtctacattcaataggtatgaatcataaactattcaattgaatctgtactttcttccagtttcatatcataattaaaaataacttaatcacttttatagtgtcttgcatttccttggtgtattatgtatttcaaatagactttctgttgcctttatatatgaatgacaatttggatatgaaatccttggtcacattcttttttctgcccaaatgctgtaatcttctggtatctaatattatggaagacaaatctgaaataacttgatttatttttgtattgtggatggcatgtcccttctacctggaagtttatggcatcctttatttttggaaccaataatcctttcacagaatgttttcatgtggttcattttcattaattttatgctatttacattttaagaatgcataatgcattcaaacaacttacctctattcaagaacctagtaaatattaaagctagggccagaaatcagtctcttatatcccgtttctatcctctttcttcctagttactccactagccctgcatcttaaaacactcattgcagtgtaattgtatttattcttgcagaaaaagtcttagtttagtctcaaacttagaaataattttttaaagtctagtcaggtcactagtattgttgagggaagcccacgaatggctttttcctaagggaagagtgattctgagagcaggtaattgtcactcagaatatcatcccacccaactctggtaaatgtgagtagaacatgaaagaaccctcaagcgttagcacccttgcttcagacatcttctgctctaacagaagatgggtcacagcagaggtgttacatgtgggaggtagaccacactgttggcaggcctgatggctgcttttggcaatggtagaagcaaaggaagttcacccactgagagccgaagaagagaaaatggcatgggccacaaagtagccaaggatattctactccatagcacatactatgtggaaaaattctgcagaatccacaaaactatacattatcacagaatcaaatcccataaatattgtcttgtgattctttgtgaccctgtgactttcctctttccaaatttgatatgacctggcttaagtaagatatattgttttctttttaccctctccctttttcttaccttctcccattcatatactctctctcctccccctccttccctctctttctccctctcctattcttttctctgaaaacttactaagggccatctttgtgataagaaattcaaccaacaacacggaactctctcttattcagattcaggtttattatggccacattttctgccttcctttgacaaatcatggattattatgaagcatgaaacccttcagtctgaaaactataataacaaatgtgaggtagtttttccacaacccattaatacgtttctattgctaacctgcctgttcccatgctcttgtgcatttattattaatactgtgagcagaacagttcctctgagatttggatagttttaaaactcacaattctatgcctttctctataatcgtaatattttagagtatgtattaggctatggataaattaaaacatatcacaatagaatatgtaatgaagaccttaggtgagtttatcacaaatgacaaaggaaaactatccctgaagaaaaaacaatccatattgaaacaggataagaacaaccacaaaaaattccataaggaatctgatgaacatttgagtgactgatactgaattcagcccattcttcttgatgtgagtgagatttgaaacagtacagtgagcttttccagtatagcatttttggaacgtgaattaccgtacataccactaacatagaactcaaagtatattaaggctgcaagagagcttggcagtcatttaatatcttacttttcagatggagaaactgatgcagataaaaggcagttgcacgccctaagcatttagctagttcgaggcagaacctgaactaaagccaaatgtaaagtctcttaatgccaagttttcttcactttatcgagtttccttctgtgtcctgcaacacatggcttagacaggttaatttgttctagaaaatgttagatataccttggactcatctgattctaggctattatgtcaaagtaatatgtcatttcaggtgattctcttaatatgagacataaaattattctcagcatgaaatttgaaatggtttaaaaattttgcaatcagcatacccaccaccaaccaaataataaagttcatttattttgcatcttatatcatgaatagactagagcacaccaaaccactgagttattgaacttgcatctggcagaaatcaatttgacatcccaatttggctatttctaggccatatgagtaatgtcataactgtgttacatcagtggtttttcaaatgtggctgtacattataaccacccaggtaaaattaaatcagaatctctggagggagggcctgagcttctgtttgtgataaactaattagagagttttactagtaatgatgtgttatagtaattatgaattttattacacaaaagctacttttaatcacaatactcagaaacacagattgataataaatctatttgtaatcataaagtaaaaatcaaagaatgagaaatgcttcaattttagacattttctaattctctcaggtaatgaaattcggactttgttctttgatccatactctctcaatctgtaaaatagaataacatttcttgtctcacaaaacaattacgaaaattatgttggccacatgataatatgccttacattgtgtacatagttaatgctcaattaatattatccttgatgacaatggtgatgatgatgttgattaataatacttaataatacttcagcttcaataaattaaataggtttccggtcctatgcccattcaaggcttgcatgaggattccagcttgcaatatagacatcttagtttaaattcttactaccacttatagattatttagtggaaagctaaaagtattagtagtttaagactaatggggcatcttagagaaacacagaaggtggaacaaagtctatacatatgcacaaagcagtttaaaattaaacagatttaagaatttagacattgtcaaagagaaagttaaagagtagattttctggtttgaccttttagcaagaaagtaaatgagaagagaagagataggaccatggaggtgacattttgcaggtgcgactgagtgagggcccttgaaattcaacataaatcatttgaatttcaacattcagatgtgattcttgaacacttttgctcatttaatgtaatcatttgaagccttatcacacttcaattgaaagtaacttacagctgtttatattgagagtttatcatgtagaacactcttttaacaatatgaaatactgtccaatcactctggttgccatatctaatgtttcttttgcacatgatcccataaattactttaatggaggagtaattttctcacataagtttgtgattttgtggctaatcttctgagaacatacgttcacagacactaaagacagcactctgacttataatatgtcaggtaataacggagatatacttcaaagaagcgatttccttactgacccttggtaagaacccaggaaaatgatgcaaacctcatgcgttcgtttgttaattaggagactgaacattcatttctactgccttttatatgtgcaggaaggcttctggctctggccattctgcaaaccaaggagataagcagtgacctgcagtggtgctctttccctgttctgggctttattcttctatgcaggaaccaatatcagcactgtcgttgagttgtacttcatcaacttagaaagactgttgaagtacgataaaggatgcacaaagctgttttatttcagtagaccctttttatcagtgtctgtgataattgtagcaatagcatggctctaccacatcaacaaaccatctgtgggccctttttcaccattgctctggccctttccagaaaaatgtgccacatccctgtggtaccaaaaccctttggcaggagatatcatggcttcaaaataagagtgtccaccttcgccttacaatcaggattgatgcattcagatttggtaaagaaacacataagaagcattctcaaaacttttataagtgataatggaaagtaaagcagaattgttacattcctcatgaagttcaagaggtatacatgaataccaaagtgacaaaatcctcttgctcacagcaccaatagtgacagtgaccatttaatacatgctttttttaatgaaaagaagaagacagatcccttctctctctttctaaacagacatctagtcattaagaacatgaaaaatgtcattcatgttttccctaaaaagcattttctaaaatttagtggtccaagaagtaaatgtccagtgtagcaacaaattacaacacagcaaaatttgactttaatcatatgaatctatcactcacagttgcagaggtttggctaagttcataatgtaggtattatgtgtatgtagtattctttctggtcaccaattattgggggaaccacccccaataattcaatgtaggttcttttcagatatcgggggaaccacccctgataattcaacgtaggttcttttctattttccctgagtgttggctggtctgagtaataaagggaaagagtacaaaacagacaaattttaaagctgggtgtccaggggggacatcatatgtcggcaggttctgtgatgccccctgagccgcaaaaccagcaagtttgtattagtgatttttaaaggggagggagtgtacgaatagggtgtgggtcacagagatcacatgcttcacaaggcaataaaatatcacaaggcaaatggggacagagcgagatcagaggaccgtggtgaaattaaaattgctaatgaagttttgggcacatattgtcattgataacatcttatcaggagacagggtttgagagcagacagccggtctgagtaaaatttgctaggcaggaatttcctcgtcctaataggcctgggagtgctacgggagaccagggcttatttcatcccttatcttcaaccgtatcaaccgtataagacagacactcccagagcggccattttagagacctacccctgggaatgcgttctctttctcagggctgttccttgctgagaaaaagaattcagcgatatttctcctattcacttttgtaagaagagaagtatggctctgttctgcccggctctcaggcagtcagacctaatggttatctcccttgttccctgaacattgctgttaccctgttcttttttcaaggtgcccagatttcatattgtttaaacacacatgctttacgaacaatttgtgcagttaacgcaatcatcacagggtcttgaggcaacatacatcctcagcttacgaagatgacaggattaagagattaaagtaaagacaggcataggaaatcacaagagtattgactggggaagtgataaatgtccatgaaatcttcataatttatgttcagagattgcagaaagacaggtgtaagaaattataaaagtattaatttggggaactaataaatgtccatgaaatcttcacaatttatgttcttctgccatcgcttcagccggtccctccgttcggggtccctgacttcccacaacaaccaataactttatttagtacgtttaaaatatagatttttctcttgactttagtgttcaaagcagcctgtaaatacttgtaacatggaatttttagcctgccccccaaaaaagcattctagtttcttttcacaacatactgctaaatcagaaaccctaagatattagcctgttctcatgctgctaataaagatgtacccaagattgggtaatttataaagtaaagaagtttaatgaactcacagttcagcatggacggggaggcctcataatcctggtggaaggcaaaggagaagcaaagtcacatcttacatggtggcaggcaagagagcatgtgcagaggaatcctctaacaccatcgtatctcatgcgacatattcactatcatgagaacatcatgggaaagacccacccccatgattcagttacctcacactggatccctcccatgacgtgggaattatgggagctacaattcaaggtgggtggggacacagcaaaaccatatcattctgccctctgaaatctcatgtccccacatttcaaaaccaatcatgccttcccaacagtcttgcaaagccttaacatatttcagcattaactcagaaatccatagtccaaagtctcaactgagaaagggcaagtcccttctgcctatgaatctgtaaaagtgaaaacaagttggttgcttcctagatacaatggaggcacaggcatagggtaaatacacctgttccaaatgggagaaattggccaaaaggaaggggctacatgccgcatgtgaagcaaatccaaaatccagagaggcagtcaaatcttaaagctccaaaatgatctcctttgactccatgtctcacatccaggacatgctgatgcaagagatggattcccatggtcttggacagctccacccctatggctttgcagggtacagcctctctcccagctgctttcatgggctggcattgagtgtctgcagcttttccaggcacatgctgtaagctgtcagtggttctaacattctggggtctggaggatggtggccctcttctcacagttccactaggcagtgcccctggggactctgtgtgggggctccaaccccacatttctcttctgcactgccctagcagaggttttccatgagggcccctcccctgcagcaaacttccacctggacatgcaagggtttccataaggcctctgaaatccaggtggaggtccccaaacctcagttcttgacttccgtgcattcacaggttcagtgccacatggaggctgccaagacttggggcttgcaccctctgaagccacagccgaagttgtaccttagccttttttagccatggctggagcagctggggcagagggcaccaagtccctaggctgcagagcagaagggccatgggccctgtccacaaaaccatttttacttcctaggccactgtgcctgtgatgggaggggctgccatgaaggtctccgagattccctaaagacattttccttattgtcttgctgattaacttttggctccttgttacttatgcaaatttggcaggcaacttgtatttctcctcagaaaatgggttttccttttctattgccgtgtcaggctgcaaattttccaaacttttatgctctgcttcctcttaatcactttgccaccttagaaatttcttccaatggataccctaaatcatctctctcaagttcaaagtttcacaaatctctagggcaggggcaaaatgccaccaatctatttgctaaaacataacaagagtcacctttatgccagttcccaagaagttcctcatctccatctgagaccacctcaacctggacttcattgtccatatcactatccgcattttggtcacagccattcaacgagtctctaggaagttccaaactttctcacattttcctgtcttcttctgagctctccaaactgttccaagctctgcctgttactgaattccaaagtcacttccacattttcaggtatcattacagcagcactcctctctactggtaccaatttactgtattagtctgttctcacattgctaaaaaagacatacctgagactaggtaatttataaaggaaagatgtttaatggactcacagttcagcatggctggggaagtctcacaatcatggtggaaggcaaaggagaagcaaagtcatgtcttacatggttgcaggcaagagaacgtttgcagggaaatttccctttataaaaccatcatatcttgtgagacctagtcactatcatgaaaatagcatgggaaagacctatccccgtgagtcaattacctcccaccaggtccctgtcaggacacttgggaattatgggagctacaattcaagatgatatttgggtgggaacacagccaaaccatatcaccaactgtatctaaattctaatgttaaacaagaaaattgtaaaatataggctaatctttgctttttatccatacactaatgagctttatttatgtggaaataataacaaagttattttatgctgctaaaactaacttatttgaagttcatgatattttatcctttaatgattctaaaatatgcttgcaaccacaatctgctgtcttttctgagacaatgttttctatatataagaagtagcaaaatgtagtaagaaaatgacagaactgggtctggagacctgaattctagtcctaaatacactgctggtcacttctccaatctggggtttccatttgtaaaattatattccacagatattgaaatatttaaatactaatctgtgaatgtttgtttctgaacctcactttgtcactttaaaacaaaattatgtaattattttacaataaagaatatgggagaattaattctccagctttgtcattttattctttcttctctaaaacagatgctgcaagtattaccaagtgtcttcagccttggaaagataaaacttcctttgcttgctgcagtatttatgtatacaattgattcattaaacaagggatgcatttttaagaatggcttgattttctttggaaaaaacggtttgcactaaaaacattaaatcaggtgcagtttatgtgccaatgaaccaaggaacagcagacagtaaataaagttgagaatactgcacattcaaacagaaagaaaatgagaagaggaaactgcaccagtattgaactaacatggagggcataaactaaacagtgactgacacagtttaaaattgctttcattctttctcaacacttttcactcagtggcttctttacagctttcaattaacctgctccctctgcttccaattgctctttcttactgccaatgatatttaaaagatacactaaattatagattcagaaatgtttggaaaagactctgttaatagttttgctatcctcagatggctttaaaattttgaagggtgcaaactgctaaactaagaacaatattggtgtcaggattcttggagaccagaacagtcaatcccagggtgaccagccagcccagcagatactgagatactgactgcactcctgccaatggaagaccatccaggcacaacctcctgaagccttggccctttgcctacaacgcacgcctcagaatgatgtcagcatttgaaaaggatttgtatttaccacatcatttatcattatatttgaactttttaacatgtactctggaaacatgtaagtcaaactcccttcatgaccacttccatcatgatggtgtgaatctcatgcctattataaagagatccatcatccatggcagtctactgctcctgcacctctagactggaattgacttgccatgtgagttgtcttggtctctttgtttttacaaagtttgacttctgcttccccaacctttagaatgctgtaataacaagaagtttgcatatgcatatggaatgctcatgcacaattacatttgagtgcacagtgagtaatgtggtatattaaccaacagtgcttaaccttaaaagacatttgacagagaatcacccacacttttcaatgaaattaaaatgaacagttagaaataacacttccatggaattaccttatttattttaggagcaaaatggaatgaaatgaattagagactcttacacaggcgttagttcatgtttgtcataacagcaaacagagccattggcatatgtataccaataactacaatgagaggtagaaagaaatgagcaccagccaagcacatgggagttttgagtggaggattagttacagttcagaagatcccaaaatgttttgttgattgtcatcatttaaggtaagcccaagactatagggaaaaattatatacagagagtcagagggaaaggagggagggagggagagagagagagagagaaagagagagagagaaagagaaagagagagaattgtgggacctagagataattacaggatagctgcttctagagaaaccagaagagaagacatggcatgtatagaaaactataaatagttcagcagtctagataatactaatatatttttatgtactgtcaaatataagtatatattcacatagaaagaaacatatgcataaagagacatacaccaagagttaacaggaggcttttgtattgtcgcactactattggaaatttcccagtttctttactttgtgcactcctagtactctaggaggcttcattttatttccactaatgacagtttatcttcaagttagtgtgaaagctgcaggctattatcattgaaacactgggtaatatttttgtacaaatttttttccccagtgaatttcatttatttcctcataacctctctgttttgaagatggtctctattcagtgtaggaaaatttctctactggaaaaaaaatggaaagatctgcaatattatacaggttgaaaagtttttccactttcatttttcctagtgtatgatagcataaactagcatttttttacgttgtaaaggcaagaatgatgtaaaaaccagaaaagaattaatgtacgtaagctcattgttattattcctcatagcaaataatatcacaaaagacaaaacaaaggaattatttgtaggaacttactaaagaatgtctgtttgcacaagtttaaaatttgctaagtcttctcatcaaataaatttaaacagcttactatgaagattgataggtatttaaactgaccttagaaatcaggtatataatttctgactttttggttttgtaattaagacgtgacagtgtgactgaaatttaaattcaagaaattagaccagcagctatacctttaaaagtacctgtagatttttgttccatgatactattttaaaatgtactcaaagcttgcaggtttaattacaggatcactaatttgtttccagatacaagagacttaaaatttaagtataactttaagccaatatttaatcattcaattgttcttcaaaatattaatcttctctgtatttttaaggaaaaatgacttatctagtctaacagtatgctgacttcatttcttttttccagcattaaattacatataaaccagtttttcaagctttaaaaatatggctcaaattaaaagccggtttcttgaggttttcaggtatattagcccattttcacactgctataaaaatactacctgagactggataatttataaatgaagaggtttaattgactcacagttctgcatggctgggtaggtcgcaggaaacttagaatcatggtggaaggggagggggagcaaggcatgtcttacatggcagcaggagggagagaagaggcggagctccaggcacttatcaaacaaccagatctcatgagaactcactcactatcatgagaaccgcatgggggaaatcacccccatgatccaatcacctcccaccaagtccctccctacacatgtggggatgacaattcggattataacttgagatgagatttgggtgggcacacaggcaaatcatatcatcaactatcactaatattcctgcttacaattcagaaatataccccattttggtacaatttggaaatatagggaaagtgatatattctctgagcacttttccctaaaatgtcaattataaattgaagattcagaaaatgtgttgatttttccaaagttgtgtcaaataggtagatatatgactggaacgattaactcaaaagtgaatgacttattcgttatattgaaaatagaaagcccaagtcccaaaataagagatatattctaatttctatgtatcccccaggatttgtgcctcccatttgtttaattgggtgttgctagtgaaatggcagtcttattagctttaacgtatttaaatttatgttcctgactcatgtgccttgttttcaaaccagttcaaccatctacgttatggtatcatcttacatcttctatcttaaatgttatacaaagtgtgtaagatctcaacttgtcttcatcctaagaaaaattcctgcaatgttgtcaaatttgaaatcctttttcttatattctaggtttcagtttttacagtgccaataagaagaaaaatgaccctggcatagaactttttttttttgttttatcattggtgctatatgtgaattccaaggtagtgttttgatgaggaacatgtttagtgagaataatttcattgatttcttggcatttttattagtatatattgaagatccagaaccatctattctttcaagaattatcttaatatatcaacatatactacatttccctaatctctactctgtattcatttagtcaacacaaccaaattcataatcttctttgtatctacatttgtcgattttttccaagacccctttattttccactatctccttctccaaataatgatggttgtaactgtaagttcttattcatatccacctaatcatcaagtatttctgttaattctccctttaaaacatgcctaaaaattattccatctctgttacttgttggggacacaataacctcttagagatagaatccagcaaatggagtggatgtcatttttttcttgaaatatcaatctaaattttagtagagaaatagcagatataattgtttacttgaaatcaatataatgcactaatccaagatgccagggactaagaacttgagacagttcaacaggctgagtcataggaatgggcctgtagggatgggtagaacagaagattgcacagggcaggacagaggaacaaatgagataggaaggaataagaaggaaagatagagatcaaggtgggagtacctactataacatacagagaatgaaaaataagatcagttaccacaggagttaaataattaaggttgtaattttatcactgcacatgactggaaggaaaatatcctgttttgtccctttttacttgtatacaaatgtttcagctgtaataatttactgtggccataaaaataaatgttccatttgaaaacactttacccccaccttttaaagggtgtcgacttcattcaggtcaatagagaaattagagagggtagaaggaaaaaattgaagatgtgaaaggtgatgtagaatcaatgtgacaatgtaattcatttaccttttaataaaaattacacacaacttctcattgcttttcttttcttaaagatcatgagctgaaattttaatatttctgtttctatgcttgaaaaacagtctttctcccttgcccctaccataagcagtggctagctaaaataaactaatccaaaaagtttcagttctttcctcaaaaaatcccattcaatgaagtccgaaaattagttctaaggatatctcaatttatgagtgacagcttctggtagtgtgaagaagtagaatctgtctaaaatattcacatgataactgttttctttttccaagactagagccattataagctgaaatataggtagagccaggtgcttcacaacaatgtttcagtgatggaccacttccacatacacaaggatggtctcataaaattataatactggccgggcgtggggctcacgcctgtaattccagcactttgggaggctgaggcgggcggatcacgatgtcaagagatcgaaaccatcctggcccacatggtgaaaccccatctctactaaaaatacaaaaattagctgggcatggtggtacgtgcctgtagtctcagctgctcgggaggctgaggcaggagaatcacttgaacccggaaggcggaggttgcagtgagctgagattgcaccactgcactccagcctggtgacagagcaatactccgtctaaacatatatatatatatacacacacacagacacacacacacacacacacatatatatactgtgtttttactatgctttcctttgtttctatgtttttagatacactaatgcttaccattgtgttacaattctctacagtatccaggagagtaacatgtaccaatgtatagcctaggagaaataggacatgccatatagcctaggtgtctagtagattatgccatctaggattgcgcaaatgcactctgcgatgtttatatcatggaatcccctggaggacacatttcttaaaatgcagcccatttttaagtaacacatgactctgtattccatcttctaacccttctgcttctggaaaagcacagacttcaggccaatactgagtatggcctctgaacagaaccaaaagagacgttgcagggtaaaaaggagttaatgaaaagttttttgtttgtttgtttgtagcctggataatttgggttaagataatgtttcaacaggaacagaccctgaattactgaatccaaaagggatgtcttgggttgtttctcacgagtggtcatcagatttgtatttctgcaaaatgagattttccatatttttgttagacttcagccaaaacttttgctgtgtagaaaggggaatgcaatttttcttatggtatcaatgagtgagaacatacaaatatataaaacattagtgttaatgaaaagaaaaaaaagctaaaaagtgtaaaagtgaatcaccctgttaacatttatctgaactttctgggggagaaacctgatgtcatagaccacaattagaaaggactgcacttaataggaactttgagtaattatatgaaacaggacaaaatatttaaaatacttttaagtatcctaaaaaagaagaaatatcacattaaaataacattcagagatgattattggcagctcctaattgccaatccctctgctggatgttcaagatacattaatgcaatatagacaatagcctgagccttaccttccacaagtttactgtttgttggattttccagcatatttaaaagtggaaaatgataatgcaaaagaagaggatcaatatatcctgaaagaagaaaaaattccaaatgaaacagaacttttttttaaatgtcccacgagtgtgtgtgtgtgtgtgtgtgtgtgtgtgtgtgtgtgaatcagaaaaaaatatttattaaggaagaactgaaaattgacatattgcttcaattacattgtgtttggaatcatacataatttttctttagttaatactttgtgaaatatatttaaatatactcctgaatttaactggtcacaaatcactttgtcaacttcataatatgccaagttagagaaacacacaataaaataacatctttggacagtcggtcttctttagagcaattgtagtaaggttagtgatacagcaacaacacaaaacaacaaaaaaccaaatcaaatcgacaaaaaagtcacttttgctttcacattttccacatagtagggccttagggatgacaatcctgatggtggtgagtgagattctcatttgtatataaaacatattgtcttcatttatactgcatccttatctgtgcttgtctggagaagctgctaatggagattatcaggggctcacatcacatcatgccacctttttgagttgccacagttgagttgccataggcaaattggtatattttcatgccacatagctacatgaaaatacaccagtaacagtgtagaagagttttttactggtctctattcataacctacattatctgatttcagccaagatatttttttaactgatggctaaatgttattgaaaattaaatctcctcttaaggataaaactagatcagtcgtctcttgagtgaatttctcagatttagttgtagaaaatatcatatgtatctaattctaatttgaatgttaaaaatgttaaaaaacttaatgcctgtgtataaagagccattaaaaagaaaatctcgccttgactcagccattacacttccggcaatccaaactatatagaaacctatgcccccagaatttattgttgtatgtttaagacaattaatttaaatagccaaaatatttaaaaatggtgaacaactgcacagaatataaaatgtctactagatgaaatgctactagatacactgttatgtagctattaaaattgcattcataaaatatttataataatatacaaattaaatctgtcatggttaattctattatcatataaaactgcataaaaataatgagttcaactatgattacagaaaatgtacattatagaggcagaaataattacatcaaaatattgacaacagttgtctttggtagtgggaatttgaatccattatcttttcctatttttttgtacttcatacaataagcatattttgatgtgtaaatacataaacatcttaactattttgtaaatcctgttctctgatacactttagagctacaagcctttggttagtttctgcaaaagttttttgttctgtgttgctttgttttcgtctctataaaagaacaaacttttctctatgctcttacatcacaacaatcaacacagaaggtttttgtgaccaagtgagcttgggttttcccacacacatcaagcaagcaatcaattctgcagcagacacaggttgagtgtcctctaattcagttcaattctaacactatccatctggagttagcatcagatcccagggtgaggactcagttttcaagaatgccccctcccaccacttcagaagtcaacagaaaggtctgcctctttctgatggacaagctacaaatcattcctacaaacccttcctttgggttcagttaatttattagagctgcttacagaactcagggaaacatgcttacttgtttatcacaaaggaagttacaatggatattggtgaacaccagatgaagagatgggcagggaaggggatgagtgtggcagtgtacagcttccatgacctctccaggaccctccagaagcccccaagtgttcgaatatccggaagctctttgaacacttctttttgggttcttacagagttttcattacaaaggcatgattgactaaatcactggccattgctgatcaccttaaccttcatcctctttctcctctcctgggggtgggttggggcagaaagtcccaaccctctaatcctgccttggtttttctggttaatagccccatcctgaagctacctagggactgccagccctcagtctactagtcaactcagtagcatacagaatttattactttgaagattccaaggattttaggaatcatatgccaaaaactggggatgaagaacaaatatatatataatatcacacaccaaattctgaaattgaaaataaccaaccctgcttatgaaagcatagttgtgattttttggggggaatcctttaattcgtaaattatatactgtacctttactacatatatgacttttcaattatttaataaattattgatggcatcatagcattagttttaatatattcatgttgacttgctatcaactcaaggacttcctttcagctaaataaaatatatccatggggaaaattcttgtaaaactttgttttatgcactattttatttacatctcagagatctaaattatctattctaagattaattgggccaacaatatcttaagaaaagaaatgacagactctaaattggaaattaaatatcagtccactaattagttaatagatcttttaatactgtctctaagtgatcaaaatgttctgtgcttctgctgacttctagcactgaaacttgttcttaaaacctgtaatcagaggaaagagtataatgggaattgtaataggtatacctttttttattagctattctctgatatgcactgatatggatgctttgcatatgtcacaattatgagtaaatatacattatatctcttctgaagtagatatttacatgcctagtttacaaacagaaacaacagtagaaaggttatgaaaattgcccaaattccaaaacccagaaaactgacagattatctttgtatggagtctctctcatgccagtcgtttgttggtggtggtttaatgtggtcgtggatcatatagtaaatacttttcaaatgtttcaaccatagagttaaaacatcttagatatttaaactacatttataattcatattaaaaatatcagctcataattttgtcatcccccagtgtttttacaactgattattgtatataactaatggccccacccttcagcaaaatgtctttaatattttaatattcctatttttaccatgcaatgggacaggcaatgtaaggagtgccatattttcaaattgaagccagacatgggaacattacataaaatgtataaaatatacttccctaaaagaaaacgaactctccaagagataaaataaggaaatatactgaggcattgacagtaatttgccttcacagtgtcctccataactggagacttaagaaatatgagtgaagatatatgtcagtaaattgtaggcaagtaagcaagtgttttaattatcttcctgtgattttctgtctaaatatgaagatatctagaatccctttctctattccaagaacacatttattattgttcactgacagcataagtttctccctaccatcacatttattattgtttaattaaacagagacaagtcaagtggttcagaaagaaaccaagtaaatgaatccccatcagtctttacataattaatgatattctctgtagactgcacaatttattaaattgctgagcagaaccacttcagatacacatatttatgtattctgagtcaaagactattctagaaactgtagaacattggaaactaaaataagtcagtggattttttttaaaaatgtgtaagtatgacaaaatttaggagagtaagaactattaatagtgccccattacttcttttttcattttcagaacctttaatgtagtgctatagcaattttgaaagtaaaatcacttaagaaaaataatatgaaaaattaagatattggaaataaagtatataataaaaaagtactgatttctagggaaaaataaataattccccacactcagaccagatacttttctccctatggagtaaattacaagtgaaattttacatttgaatgaatccggccataggatatatattgtaattattaaaagtctaacatagcaacttgaatgtttcaagagacttgctattttatatttaatatgagtgaaaatatgttttaggaatatgttttttgttccttaagattaagttttgtatacagagtcatagacagaagttttattctttctgtctctgggagagcacagcagtaatgattctctatgaggctaccaacatagcaaaattaaccaggaaaaagcaggctcctatgcagagcctattaataaagaaggtaatgacctctaagcattttatttgtgtttcgtttaggcagaattctgttttgtcgtattttacacattattcacaatactgtttttcaaggacatatcacagactaaaatcactgacccagatgacaaaaattataacataagtttgtattgtgaatgtcaatcatagctgttaaaactaatgtatgctgttaaagaaagagtgtgttgaaccattccagcaaaatttttagtgggaaaatccattaaataattcaggagaaattgtaataattaatcattggccttgaataaattgctagaagaaaacaacatactatgttgtgcttaatgaaacatatacgtgaaattattttcaatttctgaaacgtatcatttcaaatataatgagaattctttcattcatgagtcatagataatatcaaagctgtcttggatgctgttaggacacagtatttctgggatactattaatcaaactgaagaaagtaaaaataggtttataaagtagtctagacccaaaagggaggatagacattaatttcttgtgtgatatattggatacattaatatacaatgcatctttagtacttgaccttaagtgtcaagaatataatgcaccatttctcttttataagcagtactttaaagaggtgtttctggtcaacattattttgtactgcaaggttaaaatgatgaaatgcataaaaacatgaaatacacaacttattaaaatgcaattcaccagtccatgttcaggtgtttctttaatgtcagacctcaacaacaacactttcagataaaaattaatcatcaacatgatgctgtatggtaatggcatgaattttatttccatttaaatgtttacatttctctcaaatcaccaaattaatagtacctttaagtctacaatcaaaatacatatttagatttgtttcttttatgctatttttgcagcaatttttattgatagagtatgtgggtccttagctaacaccaagtattcattggtaatgatatcaaggtaagagctctcaaaaaacaacattggcctcaaatattcacccaaaacctagctgtatgattactgcttgaccaagtgcctttgacaaaatctatctaaaaaaaatcagaccttacctcccttttccagtggagccttttaaggtattcacagctttcattctaatttattgtgaccccatatatctacaagtgtaattggactcttaaagtttttagaccaatccaccactagtagcatagtagaatgtatcatgcggtaccgtgaaaaataatgggaactgaaataagaaagacattcatttatatcctgtctaaatcaattactctcttggagacttggttttctttaatggggattaaaatgctttccattcaagatgtactgagtttaaaataagcatcatacaaataatatcttggtgtatggtaggtttccataaattttatctagcttccttcaaataacattatacaaataacatactacattcctactagatttccatcagttttagttgaatcctttcaatctccttcttttcatttatcaatcataacaatgtgttagacaacagaaattttttttagttacaaaatactttcttcaaacagaacaggactgtgttttttttttttttttttttttaactcattcatgaaacaaacattttttgaggcatggttattagcaaaaacattccaaataacgaaagagtggaggatggataaatgaacctgctgttggtttctccctttgttctaaataatagatgtagacatattttaataatagcgattagatgaaagtctgcattatatagtttaaattactttaaaatctctgatggaacttaaaacaagagaacaagtaacaggaacttgagagttagaaaaatattttttaaactttaggcagaaataaagcccaaaattttagtatatttcctgccagattattttatatcctagagataccattaagaaatgaaatagaaacaaaaagctgttgtaatgtagaaacagttaccacaattcagtaaatacataagtaggacttaatttttttagttcctaaagtatgttcttattcatactatatatgactttagcagacttatttacttatttatttactttgaaggagggagtggtggtgtttgggtatataaataaatgttagctgatgacaaagcaactcttttaatttatgaataaaaactgctaggcattaaaagttatttcctgaattatctatttcccaaggtttaaatctttaacttaatactcaatatgtaagttttcatcctgtgaaaaaaaaaattactaagtgtaacagaatttctatatttcactctcttctgtcaagaaaaatttcttttaaaagactaattatttatagttgaaataagactgattagtgttgcttgttccaatgactaattaatgaggaaatggcatgtccttaccctttgatttcttgctgattaataaatcaataaagtattactggaaggaaaaaaaaagcacagaaccacactcatataatgagataatggttgccctttttcactttctgaaaactcatagtctgaaaaaaaaaaaagtccacatcataaatgaaattagctgggcccattgccagacttttgaaggaggactagaattgatggctcatgaagattaaattatttattcactcctggaacatgaaacaccaggacagagttgggacacagccattatggtcgcagcttgtcattgcccttgctgctgtgggtttcatttcttaatatacaggaatttcaaacttcaggtttgttattataggtcagttcttgagatgggcctcaatctagtccacatcttcatgacacatccaagataaaaataactgctaagatttttggtgtttcccagtctgagtttctaaagacatcacagagtaataaaaaaaaaagtaacctatataatgtaggcaggcattagccacctttgagccttttatgctgtgtggatataacagctccaaagtgaggaattaggggcttcattgtaaacccctaaaacttgagctcctttgatgcctctttctgtaggtgatgctgtcgccatttaaatacctggaaatgagccatatgaggtgcagagctaatcttaaaatccaagtagaaaagacttcagccttccattggccctcaagaagtcacagtcagaaccggtttgagagacaggtaggctacctcacttacaaccctacgagtaggctgtctccctagccacaggattctctgggtctcttatgggcactgcatgcaaaacttccttcaccttggatctcttaactttagcctcctgaatcatcctgttcttatgcaacatcagctatcattttgaactcaactagtccattgcctgaagcataagagtcctaaagtgtcaaggccagttgaggcctcacccagctttgtgattttaaggctgcacttttatagatgccactgaaatattctttagatttcatgaaattttgagttcacaagactaatatttataccttaaagaagaatgcttatagatgatctggctttattgctgcagacagaataaattagacattttttacaaaagtcaaatgtaaaagtatagtatctaggatttttgtgctagtacttaaaataaaggaaatgtttgaaataaagggaaatttatccaaaatataattatgtaatcaatcaattaattcaaactgattttagtaaaacttccatctatagaacagctttcttttaatgaataaaatcattaatgaaggcatattgtaaacataaatatatggacagaatagtccagaaaatacagaatttggatgcgttgcgtgagttgtcgaggtgaagaataaagcatcttggacaacaggttgagcatttcaacaagaagaaaacttactgtacagggcctggctgctgtgtgctcccctagatgcctgaaggttctgtctcaaatataccattcccacctcctcccttctcccccagattaaatctgttagtgttttgaaatacccaaacttttcatgtttttaatagacattttgagtaactctggacaaaaaggcattgctagattatgatgaatatatgcactctggagttactatatctgaattcaaaaggtgccctgaaatttgctcattctgcagcctttgtttggttacctaaactctttaaacctcagtgctaccatatgtgaagtgaagatgattgtcttcctattaagactgtgtgggacttgagtgatgtagtacacaaaagcacttaatacataagatgacttggaagagaagagatactaaaatggtgtattttaatttttctccgcctcccgggttcaagtgattctcctgcctcagcttcctgagcagctgggactacaggcatgcaccaccatgcccaactaatttttgtatttttagtagatacggggtttcacaatatggaccaggctggtttcaaacccctggcctcaagggatctgcctgccttagcctcccgaagtgctggaattacaggtgtgagccgttgtgcctggcctgagtatactgttaatatagttttccaccaccggttaccaggctatacctatatcataaatcaagtaatcctataaatctcttatcagaaaaatatagctattatccccactaaccattgcaagactgacggaattctaatatttaccagagtactttggtctaatggcaagggggccaagttctctgttgcactgtgaatgggttgtcgggtaagacagacaagactacttcatttttttttttttcgtggtcacatgtgtctaaccctggacggtcatctcatttccacacacttttgttttaaggtaagaggcctaaataattaagaaccaatcaactaccctgagataagattttgcctcaatagtggaacataacacctgaaaggaaagtgaaattgaatgttgattttggagaaaagaaagaagaatgaaagcaaatttttatgtgttgacttagatagaggccttgcaaacataaacacatttaaccagcaaacaactctagggccctttgcaccaaacgatgcaaaataaaaatgcattaatttcattccaaaagctgcatccgtgcactttatgtaagttgcttaaagattaggaaatcagttactgtgcataaagttgaccttcatttcagacatctgaaaaaaatatagttttaagttaggatgatgataattttcctccggcaatttcgaaagaggtgtaattttgtagctaaagtcgaaatcttgaaagaaaagtctacctttcaaatatgaattcttaatcattaccttgatgtaaaatcaattaccattaccaagcaaaaataagtaagtgctcacttttttgtgaaggtgacattattcttttaatgctgtatttttaatattttcctttttgctttataatgggcccacttagatgtatttttgttttccttagtccaaattttagtaacagttttgtgctttggatcctgtcctgatgggtttgtaataatttttacagaatttttaaagagatattaccctaaaatattagagttccatataggttcttgaccacaaactagcagaaatgtgaataggtatattggaatagcttggccacttcagaattagtgagtcaaacatgaggaaatactataaactagagacagcagacctagaatttatatattatttattcaacattaacagtattatcagtaaatattctaaaattacagtaatgctattaaggaaagaattttctgtagagtatataaagacaaattctatattttttaagtttattaattaagtatattaaaatttcttatcacagaatgactatgaataataataattcatccatagatagatacagcttttctggtctgtagaaactgctaaaatcttatcggattcatatactgaaattttatattttgtcatgctgtaatgctcattcaaagatattaagattctgataagaagtgttttctaaaagcaaaataatatttttgaaaatccaggatatatagtttaatatacagagcttcttaaaaatacatccagatcgcagagtgtattcaactaatagtgtgtgaaacaattaatcactgggggtcagttttctaatttaaagtgaggtggtttggcctgaagtacattattttgaagcccctactatgattctgtgaactatttgacttactaaataaatgtggatggaagacgtagcattcaccaatggtccaggggatgctaaaaacaacagaacccttgctagattgacctaattgggagtctggtgtgtccctgttttaagatggtgagttatctaacaggcacagaacattcagcccaggtatgtaccctacctttaatcatctggacgtataatgattttgagcattagattcccaaagtcatgaatcctgttgaaagagcaccaatgaaattccaaattgaccagagtattttgccataatattatcaggttattttatgagtaattacattttattatagcaattaagacatctaattttgccagtatggaacaactaaatatgagtttaagtttgaatgatgagaagatttcaacttcatcagggtgatgaaaaggtacatagaatggtcatgaagtagaatgaaatacagttagaaaatactgatcactccagcatgtctagggcatggggcccttatagacacaaacaaaatgctcttcataggtgatgcttggtttctgttcagtacattgtgttcttccaggtgactaaaattgattatttgatgatgcctgctaatatctcccccttactggagttaacctgaacatgagatgctgtgattgccagggctgtcttgtgcttaacagtgttcctcattgattcagtctgaaagtctaaagtgctctcaacagtgtagccccttatgccattggacggctactgtagaagtgtccttggaaaacactgaattttatcaacgactggggagtagttgattaatttttaacgtacttgcttctataaatctaagttgccatttccagattaatttcatttcagcagagttgtttatgtgcatataaaggtataatttttaaaaagtgaaatttcaatacatgtccaattctgttggcaaacctcaaaatttaaaagaagctttctttatatttttaaattatgcttctatggtagccataaatctcagtgcacttttctgagtggaagccttggctattgatcaacctttggtcttctgcagctgagttaaatatcatggaaacattagtgttgaaaactaaatagatgaaattgtaaaacctactttacttaactcagtgacagtagtatttgtcatttatttacatgacgacactgaaaatcaatcaaatgtcagattccttttaactactttaacagaatatgtgagattgttgtatgttgggcaactcaagaagtaatttattcaaaccctaatgctggaaattaaataatatgactagaatgactactctggttagtagaacacttttcatcagaaagttgtgagttaaaagattttaagtaacccaatgggaactagattcaaatatcccagttcccaagccatgttctctaattcagatataaatattagcaataaggatgagtacctcataatctttgtgtttccgtctgtagaaatagcttaatgccacctgtcaaccaatgtctgaataaactaaatttggtaaataagatgccatcattgtttttccatggaattcagaggattcggttactgaaatccatggcattaatttttctgcctaacagcctacactctatattgatttttcatatagattaaatttcctttttaaatttgcattgactctttaggcttcggtttcctcatctgaaaagctggtaaaacaatagtgctaggaagaggcttcattgtgaagtcaacaaagattacacctcaaggctacatttgcaagtgcctacacaatatatgtgcattgctatatgttgttgtaaaatttttgaataagacattaatgcattcattttcttaaagaaggactctcatattctttaaaactcagaccccacaatacccagatctacttttatacaaaatccctaaggatgtgataaggactaaataagatcatgtaaatgctctttttttgcaaagtatgtgcttaaatataaactgttgtcattatgaaagtcattcagtgtagggttctatacagttcaggagtcaaaatactcacttgatacagtgactgtcattgtatttaccattcaacattgtttacatttacatacctggctttgttatttccagaagggaaaatccacgttcaccttgtttgcctttcaaccccagacactaggatggtgcatggcacactgaagacactcaataaatatttattttattaatgaatatgaaatatgacttagcagtacagaataatattcaaattgtgaaataaaatacactgaggatcaacactgttatttaaaagattctgttgatcctaaattttacaatgagtcattaaatgtattgctcagctttcataatcttcaatctataatggtttatttttcaaaaaggctttaatttccttggattgttgtaaagttcagagttattcctttaagaaacaggctatattgcattgcaacaataaccccagaaaaataacattagtagaaataatataattaaatattcatataagataattgacttatctgctttactcaaatggattttaatgataatattggactaaccctatgtgacagcatctgctgcttttatgcactgtccccttacctccctcggccccctgctttgccaatccttccgaacataccctggaacatttggcttaaagtttcagaaaatctgctccgtttgataatgtcaactcatcacatttcagttaagcagacatcaaatcaaatgactcatgtcacagatacataaatattacgtacatggaaaggaaatttttagctataaatgcataaaatcttctggtttgtaaacctgaactacattttaaaattttgacagtaagaggaaactgatgtgaaactaatacataactctcaaataatccaatggccaactgatttggaagctactcatacaaaataatacttgcgttaaaaaatgtcctttccttaaagttactatcttaacaaatgtacaatcataaatctactaaaggtaaacatcatttcttataagaaggatatattgaactgcatacacatcttactgtcttcaaattccttcaaaaatataattaacccatccaccttatcagggttagctcaaggaaattcgaaaccatcataagctaaaaatcgttatgtgattgaacctcatcactagataagtgattctgacaaaattgccattttatggaattgatcagaaatgccattccaagaaagagggttcgccttatgaaaaaccatatatatttttatatctatattatcttatatgaataatatatatatatttttttacttgcctttggaaagaactttgtaaaatttgttaaacttcctgtatggaatgaagtaccttattacacatttctactcttgttaaataactgggggaaatgtgttatatctaggcctcactttataaatatttgttgaacttattgaattcagacaaggaaggccagaggggtttgtgtgagctgttctctgccgtcggctgatatcgcatttgctttgataaataatattttaccttcccatttgggtaatgcctgccttaggttgagttcttcttaaagcagattcttagatgaagattcatacaagtggtttatttgtgaattgaaagaaatacatggggttatggggaaatgagacagggaagggaggccagttgctaaagtcaaaacaggtgcctctaagctagctgccacgggaagggaatgtagatgagtgtccatatgtcaatgccattggtcattagatgtttttgatgaggactgctccatgatggttcatttcctggctcttgcaggctgtcatgaaggtggcaaatgagtcttcagggacaggagagcaccctcaggaaaagaagccaagaagccaggggttggctttctcttggaagttaggcagtggttgatgaggtgatcaaggtgggagatatgagtggagaacaatcagcgtctgccagaatgacaaccatttttcacatcttccttaatattttaaaaaacagatatattctaagacttttcttataatgactagagagggttttaaaaagtggttttatatttgatggaacccttgttggtgctgcagttaaagagttacttcaaaatcctgcctcagcacaccctgttcctttttctttgcactccccgaagccaatgtttcagaagcaactgccgatcagcagaattcatctgtttctcccacagggctaatccctgaccgacctggaagccaagccaggctctaacctggcagactcactcttctcctgctcctcttttacgtaatcccatgcttattgattctctagaaaatctgttttccttttgctcaaagcagagtacaaagcaagaaactgcctcgcactctggagaaaacacatgaaatcacaagctaaccagtgactgtcattccataaaatagcagttctattaaagtgcattatgtaaaaatgggatttgtactagagttgttttataggaggttggtttatatcatcacctgtttcattgaaaatttggtcggtgatgagtcatccataaaactggcagaataaaacttcaggagtggctgttgtaaagttcttctaaggctcataaaaccgggttatgcgcttccacagttttgatattgctcaaacatttcatcaaaagaacgtgaatatcatcagtgctacattttaatttgatttttaggaactttcatttttaactttccttccatgacccctgatcttttatttgaaagtatgggaacacttgacccattgttcctcttcacattggatcagagaatacaaaagttaaactcttacacactgctatagataagagagagtttaaatgttagttatagaataagaaccttaacgcttttgtgattatataaaaataaaagctagcatttgctgaacatatgtactgtttcaaacattacattgacttatgactcactgtttacgttcattgcatcacatactctttatgacaatcctgtgaaatagttgctcttttcttaacttttatttcaggatcggggtacacatgcaggtttgttatacaggtaagttgcatgtcacaggggtttggtatacagatcatttcatcacctaggtaataaacatagtacccaatgggtcacttattattatccacacgtattaatacttagaagaaacctgaggcgcagggaaattaaataaccatttaaggtaagagtcaggaatcaaaccctagtttctctacacgaaagtatgctttaaaaaactctactgtgttatgaaataatatgtgcccatgtgaaagaaatatatagacaaaattaatctaggatggaaaatatcacagtggtggttgcctctgggtggggggattgagactgacctggagggagcatgagagaactttccagggtaattgaagcctcctatcttaaccagcacatagttatatatagattgtaagagtatatgcatttgtcaaaacatattcggtggtaacacttaagatcaatgtaatgttgttcccctcttaacttatggatactaggcttaatatatgggtgatgacataatctgtaaataaacctctataatacaggtttacctatgtaacacacctgcacgtatatccctgaacttaaaatacatgttttttaaaaagatcaatgtatggaccaaaggcaaattatacaggcacaccttcccaggtgtgctatcctcccacctctgtttttagtcatagaatctgaatggaagcagccactgccctcatcctgatccccaaaccacgtgagagttcaaacgttgtgcacaagacccagtccagccagtaagaatccttaccaagaacttttattaaaacattgccatcggccgggcgcggtggctcacgcctgtaatcccagcactttgggaggccgaggcgggcagatcacgaggtcaggagatggagaccatcctggctaacacggtgaaaccccgtctctactaaaaatacaaaaaattagccgggcgtggtggcgggcgcccgtagtcccagctactcgggaggctgaggcaggagaatggcgtgaacctgagaggcggagcttgcagtgagctgagatcgcgccactgcactccagcctgggtgacagagtgagactctgtctcaaaaacaaaaacaaaaacaaaaacaaacaaacaaaaaaaattgccatcaaggttaaaataaataaacgaaaaaataaaaatatatatatttcttttttttcccctgtggtgagaaatctgtaaggacatgagtactacttgctgacaaccaagtcctccacttttggagaaggtagtctaacacttcaaatgtggctaattcaactaatgaacttttatttaattttaattaatttaaatttaaatagccacacatggctagtagctaacacacggaatggcaaagctttgggagaatgagtcagatatccacagggtgtaagacataagtaataagaagaaagagccctgatggaactggatctctctggaagggcagctccacccctgcccttcttgtaatctggagatgtaagtgtattagtccattttcacgcattataaagacactatctgagactatataatttatagaggaaagagatttaatggactcacaggtccacatggttggggaggcctcaggaaacttaacaatcatggcagaaggcaaaagagacgccaggaccttcttcgcagggtgacaggaaagacagaaaagttcaggggaaattgccatttataagaccatcagatctcacgagaagtcactcactatcatgagaacagcatgatcataaatcacctcccaccaggtccctccctccacacgtggagattatggggattacaatttgagatgagatttgagtggagacatagccaaaccatatcagtaagctaatgaatacacatgccttcatctctgcaaatgattcccctccagaatattaccctttaaagttacgattaataacataaaaatctttataatgctgtttgtaaaaagcataaaatgcaaatgtgtgggctgaggtaacacttcactataactaagtttccatttatctaacaaataattagtagataaacccaaatggctaattattgtaaacttttccatcttcataaaaatggaagataatataaatagacgaacagcactagcaccttcagggcaccaagaagacaggaggctgaggcttggaaagaacaatcttcacaactttttctaggattggttgtgttaattttcaaaagtctcaggtaaatgagatgggtctggagcaatacctttgcatgatttatgtgattttttttacacttgaattacttcaaggagctttccaaagaatgttttaacatactgtgaccaataatgtcagagctgatggcagcatctgtgattatacttttgaattctggctggtagtgtcagatttgtagactgacattattatttttataatagaagttataagaacacaactctaaagattatggctcatagaattttagaggtggaagaggcccttagagaacatctagtacagccccttaattttacagatgaagaaacaaaagcccaggagaggcaaactgagttgccacaggtgatgacacctaattactgatcgagctgacactaaatccagttctcctaatccccaaagcttgctgtcagtgagccaatcccaatacatcataccattctgacttttgccttttcaaatgatgtcttaattaccgttgatatattttataattttgtaggagctgacaaatttgtcaggacaaaatttcatataatgtgatatattttgtgactttggcgtcaaggaatgcttgtataagatgtttgcccttcatgaaaatcttgaagtattggggaatgcatgctaaaaaaaaaaatcactagttttcaatgaaattttccagctaggtctaatatcaatgtatgcaaaattatcttaaaattgtctgtatttgccacctatatcatcatttacagtatgatagttgcaggaaggacacaagctcagatttgggtagaccaggttcaagtcagccacagcaacttcttaactgttcaggctttgtttgttcttgtgaaaaagagattaaaattgtactagtatagaaagcacctggtattatagtttgtcctatagagataataaatatatagtaaaacttaatgaattggattatacactagaacattttcacatttgaactaatagtgtgattgttatgtaataaatgtggttaataaaatattgatacagtataaaatatataatatctgattaatactaatataattctgttacacaaaaacttttaaaacgttatgaatgaaaaaaattagttataagcatttgagaagattttgcctgggatttggaattattggaaacctagtagatccatcttcttgcagacctagaatagaaacactttggaactgaaaagagaacaagagataaaattttgttgcactgctttctgttcaccttcctcctgacccttcaaatatttcatcccacccagtctgaggcctatgcccaaagtttgattatacattgttattagataatgtttgtgcctatcatcactgagaagtacttccagagtccagagtcgtcttcacttgcattataccacaggttggtccttaatccgtgtgagaatgaatctgcatgagttgaatcactccatttctgaatggaccctgcaggtcctcttcccacaaccatgaacaactttaggatattgtcacttttgtaacttttttctttcccacatcctcacaatatcctccctttgtgtccttcccaataatgctcacacatgattcaataactgcaacaatttatactgaaggctatatatgcaacaatatatactgcaacaatatatactgaaggatatactgaatttatacagaaggatatacgtataaatatacgtttaaatatacttttaaatatacttatatttaaacaatatatattgcaacaatagatactgaaggatatactgaatttatacagaaggatatacatatccactgcttcagatccttgtcttaaaccaatctggagatattcaaattattgataaccctccagacctggaatctgaagctgtagacctgaagattagcctgatatatttattttcccaatatttataatcaatcagataaagagtccgatattttctgggtaaaatcctaggtaaaatatcaaataaaattcactggaagtactcattatatagcagattactgaatgactaaaaaacctaatagagaattctgttgtgagagcacttctaacataaatttattttataatggcaaatttcattagaattcagaaaatgtaatgtctattcaggactgtttacttcttaacatattaaagacaaactatattttgctaggtgaacaagtatttttcttaagtcaatacaaaggattggaaaattaaattttcattgcattcaaggaaaagacaatgaggttcctatcatttatgtatcctcagtgcctagcatggtagcagcacatcactaattcacaagtgtttgtgaaaggaaggagggaggacaaaagagaaaaggaaggaagaaggtttgttacagcatgtcaagaaggtggaaatagaacttagattcaagactctggtttttgatttccctttgaaatacccattttttaaaaatgcttatgttacctagaagtggtaattactaagtcattcattctagcaagaaacatctgagctgctactatgtgcagacacctctggggatacaatacaggtgaaacacaagccactgccctccagatatccacaggctgacaagagaaaggatactttgtacatttctgtaaactgctatcaagaacatagtaatgtcctgtagcccaatgatggaaggaggctggaaaatggcaagagagcaaataaatttggagaataattgcttgagcaaaatttgaacacttaagagaaaatcaatggtcagatatgttaaaaagatggaattcctggtagagaggatggcaaatgaaaggattggggcatgaaactgtggtgaaatttccctaaacattcagttagtttggtatgactaaagcatagtgtgtgtgtgtgtgtgtgtgtgtgtgtgtgtgtgcgtgcacatgtatgtaggtatatgtgcatgtgtatgcatacatggatgtatagaacatagggtaggggtgggaaaaggtaaattttttttttttttttgagacggagtctcgcttgtcgcccaggctggagtgcagtggtgtgatctcagctcaatgcaagctctgcctcccaggttcatgccattcttctgcctcagcctcccaagtagctgggactacaggcgcccgccaccacgcccagctaatttttttatattttttttagtagagacggggttttaccatgttagccaggatggtctcgatctcctgacctcatgatccgcccgcctcggcctcccaaagtgctgggattacaggcatgagccaccgcacctggccaggaaaaggtaaattttttaagatgacagtgaggacacttggtcaagatgaaacaatagtaagatcagggactatgtatgatgcctatatgtgccaggcactgttgtaatcattttatacacactaacttattcaatgaacacatagacacaaacccacacacctttgagctatatcccattgtgatcatcctgaggtacacagaaagtgctttgttcttgtcacagagctaggaagcagcagaggcaagagttgaaactagccagtctgtagagactcgcatatttcatgccaagatgtttggacaagagaggaactgaagcatgctaataacgtgattaatatccctagattctgactaagtttgtggaagttatttataaggaggaaagctggagaaccaaggcaacaggtcttcttggggtcagatgcagtagctcaagatagcagaaagaggtcagtgaagagactttgatctagaacactgagacctggtcactagcttcagtaagagtggacatggggaggactcactgtcacccttctgtctagtttaggtgaatgagtgagaatgaggagtttgatttccttagtgaacctccataggaagtgtctggcacacagctggaatgcataagatacagctctggcaatcttgactctagacaaacatggagttactatcttcttaactggaataggtagaaatataggacaaataccactgtcaagcttcccgcttttcacttttatttgttattataatgtagctatggaagatatgcaaagaaggaaaataaagtaacctccacaccaaagtattattattaataaaaaataaacacctagctcttatcctaaagaggttattaccaagtggtgagaaatagttataaagtataataagtacatataagccttaaatttccaaacagatttgcataatttagcatagcttgtgggtaatgatgatgataaaatcactaaacatctgctaagcatttaaacaacattttccttccgttagcatcagttgctggaaaataacatactttggctcaaattgtcctgttaaaaatatagtttggggccagcagaattttattcatgcttttatatggagtctccacttttttctgtaaatgtatttatagccaaaagctttcaccagttaggaaatgcagcagatgccaataagtacattcattattttgattatggcaatgtcagactttcagaaaacttcctccatctctatctgtagcacaacctcacatagggagggaccatgtgctggtcaggaaataaacagctttctggcaggagttaaatgaaaatactgtttattactcttataagatgttataattgacggttttattgtaatacaatagcgattatgacatgttgtcccaaaccctaattttgttgttttgtagcaagttacgtttttatcaaggaacacagtggtttaaaaaaaaaaaaaacccaaaaaactaagatttggggccgggcgcgatggcttacacctgtaatcccagcactttgggaggccgaggcgggcggatcatgaggtcaggagattgagactatcctggctaacacggggaaaccccgtctctacaaaaaatacaaaaaaaaaaaaagtagtaataataaaagtagccgggcttggtggtgggcgcctgtagtcccagctactcaggaggctgaggcaggagaatggcgtgaacccgggaggcggagcttgcagtgagctgagatcgcgccactgcactccagcctgggtgacagagcgaaactccgtctcaaaaacaaacaaacaaacaacagcaacaaaaacgaagatttggataattcatgtgtcttttgttttgatctcagaatttcctcattaacagatgtgaaataatttaccaagtttttcttcaaattgactaggcctgtataaaataacagaaatgccctttgcagtgaaagcactttgtattagggattgatcactcaattacattctggatgagaagaaaaaaaaaatcctattggtgtttttatgtgattacatttagggagaaaaagtttggaaagctaagaatcttttgtgggaagacaaaaagaaagagcttttaaggggcactttgaatacagagagtgactttagatagctagcaatgctgtttaaaagttacatcatggctttaagcaaaatcaacagcagtgaaacaaactgaacaagcagaaaaaaatataactcgaaacactgatgagtagtagtttttgaaagtgaattcatccaataaactacatcaaataaaggcaaataaagacaatctaagcttcattcacaaagtacatagagaaaaatgcttgaaaatatatcacatccaggaagaattttttaaactgacaggtgaagttattttactatatataaattctttaaggtggcagatatcttgtcaaatgaccacccttacaggaggacagtcaacttgattctaattaataaacaaagttttagtggaaatcctagaacacgtagattcatgagactcagcattcaacttggaaacccgcagaaactgtgtatctaagccactctaaccaaatagaagaaaaccttctacatattatgtgccagggagacgttaggcattagcagtgcacagacagtcatggttcaggctttgacgctgatgacaactggtggaatgtgtgttatctaccctgttattgtactaacctatcctctatcctcatcacacagtatgagaactacagtagcttgtcttctgcctaaaatctcctaccacttccacagtcatttaatctgccagctcactgttatgctggtatttttaagaaataatttcatataattagtctctttctggatgaaacactgctaaggtgtttattactaacctaaattcagtccttttcagctctttcactctttgtaatccaattccattctttgcagccagtattcatttctgcttgttctgaaatctatcccatcacttaggatttggaaactagcagacatgaagattggctacaaagaatgtaactagatttttaaacagatttagctctaatcccatttcttagaacaattcccaacttgaaacaggaaatatctagatggtttcactgtccgattctgtggtgacccaacctcttagcactcagattctgcctcggccctactgagattactagtcttacccaacatacaacttccttccacatctaccaggttgaggaatgaagcaaattatgtgaaataggagaaatacttttagaggaagcttgagtattggtgtattgggataatttatatgggatggtaaagttagagggtagatgatggcacttcattacatctgcaaaattttaaaaaaaattatcctagggctaggcatggtggcttacacctctaatcctagcactttgggaggctgaggtgggaggatccgttgagcccaggagttcaagaccagcctgggctatatagtgagaccccaagtctacaaaaaatacaaaaattgaccaggcatggtggtgcacacttgtagacccaggtactctggaggctgaggtggaaaggattgcttgagcacaggaggttgagactgcagtgagtcaagatcatgtcactgcactccagcctgggagacagagtgagaccttgagactttgcatcagaaacaaaacaaaacaaaacaaataaacaaacaaacacgttctggaagtagtatgaatggtaggttgagagatgagggtaaattcaattgagaaagggatgcaaatgagaacataattattagtaatctaaaagagaaatggtgaggggaaatttttaattaagataaagtaaaataatggtgaaatcatgaatttttttattttgtatttcatttttaaaaatcataaccacatgtacacttcattactttaagaaatgttacttttgaaagaaaaaatagtcatatccattgactctcaaatattcttatgagttatttatactaaatgaatgaaaaaggcagagaatacaactatgtataaaatatgagcccaattttttaagacacacttatgtatagataggcatagagagacagatgggttaagagatattaagagaggaatgatgagagaatagaaaaaaactttaggggctgggtgtggtggctcacgcctgtattcccagctctttgggaggccaaggagggtggatcacttgaggtcaggacttcgagaccagcctgaacgatatagtaaaaccctgtctctactaaaaatacaaaattatctgggtgtggtggcatgcatctgtagtcccagctgctggggaggctgagacagcagaattgcttgaacccaggacgtggaggctgcagtgagctgagattgtgccactgcactccagcctgggcaacagagtgagactctgtctcaaacaaaaaaaaaaaaaaaaaaaaagaaaaagaaaaaaatctttaaggagatatgcataaatatttcattggttgactctagttattgacactataactgatttgcatcttctttcttgcactttcctaatttagaaaattcaattaatatttctttaataaagagaacattgagtgtatctaaaagtatgtcaattggtgagtaatgaaagaaagtgtcaataaaaataaccggaagagtgcagagaacaggtgtagaaatatcaaaaaggacaagctgacaaaagttttgattggtggttcagggataatagagagagggagaaggcaggcatccatgataatttacattttcagctgcatgttatgcatggctgttgatggaatcagcagtgcagaaggctcagcataaataaataggaggtgagaattgttccaagtgaaggagaggttggctgtgggaacattcggtctcaaagcagaggaatattttaacactgacatactttcaaattgctacccatggtaacagttaaaagcaacttcactgtatttggttttgttattattattataaacttccacttcctacaaagcatgcactccatctttgcacctgaaaggagttgttttcactgctgccctctaccttggttcatgactgggagaaaagagctgaaattctacaggattcattttgagagagagaattcaaagcactatagcgttatagctgcaaatatccaagcgatatttggggataagtgtgtgacactgaggagaaatagagtttgaagataatagtttaaatctttgtttagtagtaaacactttcattagtggcctaaacaccttgtttagtagtaaacactttcactagttgcctaaatgaaactctcaacagcataactttctagctgcataatttcggcaagtcccttaatctcactggacctcagtcttctcatatgttacataaagacgataacagtataaattctgtagagttgtataaaagttaaatgaatgaatagatgacaacagcttagaacatggctttagcagattgtaaatactatgtaaatattggatattttattttcagtatatgtatatattctttctacagagcaagctctttatgcattaatagtaatcttgctaaaaatccaaatctattcagaatgagtactacagaatttttcttatagaaatattaccaacattaactcctctcttagataaatgtgattcacatttcatctctttatgcaatttccttattgttttatcattttcctattgctctattctataaataatgaatacagcattttaatgattcttgtaaatagagaccacattttttaaccattgagcatacggacaaattttattcataatattttatttctttcattgtacttgagattaatagcacaatttctcatccacaaagtttattataggttgtaaaaatgaacatgatctctcttctgattggctcagaaaagaagtttaatcttatgtaattatctttcgaatcacacatgcatcagtacaatcaagctctctatctattagatcactgaaccgtttcacatgagtttacagattaatattcatataaaactatatatctttcagcatatctcctcttggtaggttttcttaaagaaaaacaaaaaagagtagcaaattggaaccttggatatggaagaactgcttaaaaaatattcaatgaattgccatcgggtcactttttccccttataaataaaaagttggggtataaaagcagaaatatcattataaaagaactggaatgtcagaaaacactaagaacattctgtttcagtggtatacaaacttgtttgtccttttaagccatgaaactttttctttaaacaaaatttcttcaaaggtctaattcttaaaatagataaactactgtgaagggcagatgctacgaggacaccccatgacccaactcccaaagcctttctttgtaatctctctgctccaggtagtggtttgaataaggacggcctaatccaaacattgccttttagagagaccttgagaagcagtgatgtagcctaggttacaaggtaatccagtaaaatgtatccatgagttccatgcgctgacagagaatgcattgttacattaattttttttttatatcatcccaactatggaaacttcagttgccaaatgctactgctacataatgtattcatcttttggtagtaaacttctctgctccagtttatttttcagcctatgaagttttttgttttttttttcttattaaaaaaatctcaatttagaaataaaaatgagacaagcacagtcaaaatttaaattagcttggtttcagttcctattattaaagagatttttaaaatatcctacttttgaacatctttgctgccatccttcatttctctcacaagggaaatataattcagcagagtcaatcgtgactgttttgaatatggtttactaaattcacaaacaaaaagtgtctctgatagtcaacacaaatatataaacaagcattgagtaaacggcaagaaggataaaaggcatttttccaaatgaagacttccattgaaaagaagaaattcaatgaaccttccttaaaacatatgaaacattctattgaattttgatctaataaaaaattgtattaaatttgctgtattagaactgttacacacttgagatcaaaaaagaaaacaaaaaatgccctaactataggtagggacattgtaggactaatggaagtgagtatataagtccacttggcaccagagatttttttctaatgtggaagtgtcaaaagaattctgctccacttcaaagcagtgcctggcaggaacaggaaagcataaatgtcactgaacaaacttagagacaagcacttccttcactgaagagaaacctgatatctttctagaaattctagtatgctgatacaaaatgctagacactatctaatttcattcctccatattaatcagcaccttaatgtatgttgcagtttatagacagtaaatatactttaatattttctttctttgcatgggtaaagaataaagaatgcaagtcaatagaaaagaaaaattttaaaataattgtagtaattggctataactggtgagtatagcttggctttggagtgatgtagccctatctttgaatgctggctccactatttgttatctatagaaatagacaggtcatagaaagcatttcccatctggcaatgtacttgtgaagattaattaaaagttaatctattggccgggcacggtggctcatgcctgtaatcccaacactttgggaggccgaggcaggtggaccgcttgagtcaggagtttgagaccagcctggccagcatggtgaaaccctgtctctactaacaatacaaaaaatagccaaccatggtggcaggtgcctgtaatcccagctatttgggaggctgaggcatgagaattgcttgaactcaggaggcagaggttgcagtgagctgagatcgtgccactgcactccaacctgggcaacagagcgagactttgtctcaaaataaataaataaataaataaataaaaagttaatatatttaatatagcttgaagaacctagaataatacctggaaccttataagcattcattaattggcagctagtgagtcctttaagctctatgattgcaggaaatatacattcactaggattacctcaagtaatggggaaatgtttttggaaaatagatatggatcaagtaagttaggagttctgaccctgcaacatggaaatagggcacacccaggtcccagttcagaaacaaggtaaagctatagtggtactcttggccacatctccttagtaagacgcaggagtgaacctgttttccttcagtattgtgactagctctactctacttctgcatcaatcagtcctgttcgcagcaactagtcacctcctcctttgtttaatgttcatcatctttaaacatcgacctgcttatagtatccacttactcccatgtctgctgacttatagaaaagcaaggtacaggtatgtgaatgtagaatgagcataaaatataattaaattaaagcgtaatcagcagaaactctgtgcttttgcatagtaatcctaccagtgaatgattctttctttgtatcctattttgacccatcaagacaaattttattggtctaattaataactaagatcccttctgagcaaagctcttctgtgagactacatacagaccagtctataattgctctgatgaagtgcatccgggaatagggtgaggattggtttctcgtggcacctatcgcagccatttatcctggaagaattccctggaaaggaactgcacatgtggcacacacttttagacttagcatttctatacttctcttgtccatttgtgcagaaaggtggagagataattcagaaagagagctagtttaaagctagaataaaccatgcaaacacattttttttctaatttttgcaaattttctccaatatcctgaaggttaaacagaggttattctgttctgttttctatacccatgctaaggttcaagaaactataaaagaggctggctgactatctctcaaaaggcttcctaggagaggttttccatggccctgggtctggacttcacctagaaggatttaaatctgagttgattaacaagatgatatccttcatggaaaaactcacaggggcaaagctcaaaataagcttgttatgtatataaaaaagacaatttatcaatttagaaaagatgccctgaatgcctgtatgtgtatgtgtgtttgtgtaattttatatattaaataatatataattttaattgacagataaattgcatgtatttatcagcctatatttttcatgacatagtttttcctctggaaaaggtaagtagaaatctaaattaaaagctgtatattgctcaatgaatttgaaattgagaaatgtgtgtagttcaaatattttgtctagctacctatagggatatgcttggcctaaaaaaatctttgagccagagattctcctcatttggagtgagactaggtatcctccatattagcctataagaatctattgtttttttggtttctgctgtggaacacttctcctgttgggacattctgcattatttatattagtacatcaaatcaaggtatagacttgtttgaaaactattctatctctctaataaccctatacacttattcattcattcattcaaaaacttacttactctgcacttattatgtgcctgacaccttaggcacataataagtgacaaaaacaatgtcaaagacattgacatttgacgttgacaaaaacaatgtcaaagacattgacatttgacgttgacaaaaacaatgtcaaagacattgggggatacaagagtgaatatggaaagcaatgtctttttcttacttggcccttaggctccagttaaggtagagagacaaaaacccatttaattattccatctctcactctattgcataatctcaatctattggaatgtaatccgtttagggattatatgttatagaacataatctacatgttagagtatacaatcccaattgatcctgcaaacatttctagaaaaaatcctatcaaatgagtaataaagtgttctaagcactaactagaaatgtattcaggtgaaaaagaaaaatccaaaaaaaagtgtttttttttattatggtttacttgagaatagaacttaagataggaacatttatcacagatttgactcttccataaaggattgatcaaagagcttaattctcagaaggtaacttaattcaccttgcgatgaggtcaacatgactatttacctcataagcaacttgaattttcatagtataattagccagtggtttttcaagtctaaagaacagcctttgccatgctaaaacatgatgaagcagtgactcactacagaagacaagccttttcagaatatactctgtgactcttttttttttattattatactttaagttttagggtacatgtgcacaatgtgcacgttagttacatatgtatacatgtgccatgctagtgtgctgcacccattaactcgtcatttagcattaggtatatctcctaaagctatccctcccccttccccccacaccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaagcacaggaactcatcattttttatggctgcatagtattccatggtgtatatgtgccacattttcttcatccagtctatcattgttggacatttgggttggttccaagtctttgctattgtgaatagtgctgcaataaacatacgtgtgcatgtgtctttatagcagcatgatttatagtcctttgggaatatacccagtaatgggatggctgggtcaaatggtatttctagttctagatccctgaggaatcgccacactgacttccacaagggttgaactagtttacagtcccaccaacagtgtaaaagtgttcctatttctccacatcttctccagcacctgttgtttcctgactttttaatgattgccattctaactggtgtgagatggtatctcattgtggttttgatttgcatttctctgatggccagtgatggtgagcattttctcatgtgttttttggctgcataaatatcttcttttgagaagtatctgttcatgtccttcgcccactttttgatggggttgtttttttcttgtaaatttgtttgagttcattgtatattctggatattagccctttgtcagatgagtaggttgcaaaaattttctcccattgtgtaggttgcctgttcactctgatggtagtttgttttgctgtgcagaagctttttagtttaattagatcccatttgtcaattttggcttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattatctttgaactgaaaattcacatcttaatttgcacagagtattctgaaatatcaaatgtatacctatattggaaactttaccaggtagcactgccacattcagtttttacataagaaactgagcattttagcatatgagttgggaagtcaattgtcctgcttgatttcctatttggcatgtctgtgataatattgaaattgcttaatgattttatttattccttggagaggtggatccgtacacaataagcatttgcaaacacctgggacaaagtatggacctctgtcagcatagtctgtttataggcctaggaaagtatgaacagagagttgagaaggaagaggcaaaggcatgttattttactgagacacaatgaaatggctgtacatagaaaatacatcttaagatatcagagataaaagctataaaaggggcaggaagaacaaaatgtaaaaattagatagtttcacttatttttcctttctacatccttttttttttttaattgggaatcttagattggtgggttttgggggagggtggagttccttttctgaggtcctttattttctgcttgagtgcctgaaaatagatgcaagacagagaatgtctccactgactctcacggtggctgtttattcagagtgcagccttcatttggctctcctggaagctggctgtgagacaaggaatccaggccaagttctttatttggcagggaagtggagatgtagatagaaaagaaaaggcaactaataacacattatcaagtcagttaccagtacaggtagctgtagcttaatcccactgggaaactgagaacccttagaaaagtttgccatcagcatcatcttctctggggcataagggatctggggttcttataccccttttccccaagtggtcatgatctctcttgtacttccagcctgtggtgttttcaggtgcacaggccgtggctgcgtgagaaaactctcagcccgttggaagtcaggagtgcaccacagtgaaaagggctatgggggcagagatggatagagcatgacagttctgctgtaagtggcccaagttgaagggagctgttctcccgtctgcctttttgccttcttataaaaaccaaattagcaaagacattgatacatagacttgtcttataaccaattatggacttatattaattacccatcaatattctctgatccatagtacatatggaaatgtgtgtgtgtgtgtgtgtgtgtgtgtgcgcgcgtatttgtaaaatgccattatccctggtattctatattagcctaagcttaaaattcagtccttgtactgttactttttactgtacatctgtgacaaaattaatactgccatatgatgggtgcctaacaccacccactgcttttaaattatattctcattttttgttattcaatgatggttcaactatttcaccaagaattaaatagaagtaagagtcaaaatgaccaggatattttctctaataccgctgtgtactattaaaaaaataattaagatttctttattcatatcaattatgagttgatgcactgaatgatgtaatatttattcatgttaacagtggaaaatgtgagtgggaacagctttcatatggaatgcttttcttgtactttagaagtaaataaataattaaataaataagagttctaatttatgggaaaattgtcttatatgagttgattttctaagcctttgttttaccagcctgaaagaggaatgctacacagtcatattttaatggctttgtttattcttttagaaaaagtatcaacatgacatcatctgaggctaggttgtgctgcatactaataaaaacctgagaaatgtatgtttgacttctgatgtaaaggttttctttttaatatagacttaataacaatttcatacttaaccgatgagagcagcaaattaatcaaacaaatcgaacattttcttctccagggaactggggaagcttctgatcccttgatatgattatatctatatatcaaattccatactaatgacccccaagagagatggctttatcaataagattgtaagttattaattaattaattagtctcctggaaattctactgtgtgattttctgtttttacctcacaggagggagttctgagttaccttgcttcttcagagggttagatttttcatgtttcagggttgaacaatgaggtgtaggcaagagctcaagatagcatttgaggggcttcgtttctgtattttagactattaagctaacttctataaagggaaagtactaacgttgatatttagagaaaaacacggggggagctaaaacaagacagagaaagacaatttgatgcccttaggatggggtgatgacaacaggtttgttccaacatagcagccatccacatagctgtaccagaagcaggaccttggcagggaagttctgtggccttgtgtgactttaaccctgggaacccggcaaagatttctgtaggcagagttgatacaaaagggaatgttctcaaagtagccaccactttaaatgaataaatagcacctcagtagaagaccactggccagtgttctgtccaaattcacacatggaggcaaaggtagccatacaaagtgatgaatactgagtttcttgctaatttcattgaatgggtagcttgaaacaattactttgatttagaaaaaataatgagatctgacatactttgcattgcgtcttcagtttttctgatcaatccgtaagttacatgatcttcacatacaaactaagaccattcacataaaagagagaaaaggagtaattatttttgctttcttagcaagtgcctagaatagcattttccggtgcatgcactggggacaatcagggccataaatttctgatatgaaatacatttaagaaataccaatatgagggcaatggaaatttccggtgcaagcactggggacaatcagggccataaatttctgatatgaaatacatttaagaaataccaatatgagggcaatggaaatttctttggtaatttgcaaaacatattaacatattaaaggttctgaagtaacccttgttactagtttaactttctttaacccagaattgcccaaacttacttgagcataaaagtgttttaacacttctgagaaatatcctttcagataccagatggctagataaaaataaatagttgttctacattgtaatagcatctattacagtttcaaatctaaatatctgtctttgttccaaaagcaagcttatgtatatgattgtttttattttctatgtagactcacaaaaggagagacatagaaaatttaactctacactatcattcccccagattcaactctggcatgataaagatcctagagtgtattacaaagaggtcacccttataatatggtaaatgcatatcttctgctataaatattttcataaagctcttctcttagtcaaggattgagagtacaactggccgtctttaggaaataggaatcaggaacgaatggttgttgctcaaaagcataacatttaagtgggttaacagagcacttatatgaatgagcaagaagataattgtgctattacacacagttttacgaccattaaaatacctgttctaatttggcatcagatacgtgagcacaatgtgaagagcctgaggttggaatgagagcaggaaaaatgtccgaagtttggacagggagcaaagaaattgagaaaattatagaattgaagagaaaaccatggtgaggcacaaaaaagctgtataattatatgaatgatattaggtggttggcaataagcaattattaatattttcttttatgagtgaggaaaaaaaaagtatggtcataacagagggaatgcaattcgagcataagaagaaacacgagagtattatgctgtagtagtccagtctcactctgctatgaagaaatacctatgactgggtaattcatacaggaaagaggcaaaactgactcacagttgagcatggctggggaggcctcaggaaacttgcaatcatggcggaaggcaaaggggaggcaaggcaccttcttcacaaggcggcaggaagaagtgaatgcaggaggaactaccaaacacaaaaccatcagatcttgtgagaactcactcactatcacaagaacagcatgggggaaaccacgcccatgattcaattacctccacctggtctctcccttgacaggtgaggattgtggggattacaattcaagatgagattttgggtggggacacagccaaactatatcacatgctaaagcagccaataatatctctaggaaaatgttgtagtttagggtagatatgtgtttggaacaatttagattcaaaactcacagaattgtgagtagcaacaatgattactcttaaattagtaatgctggaatataggtaattttaattgtgtgttctattctgtggtgccagtggcattttcccccctgatgttatttttctgcagctccggctttgtacataaatggataatagtgctccttggtgatctattttcaagtcaaaattctttcttattttctgctgaggtttagcattccgtggataaaaagcaaagtttttcattccacagcaaaatataatggttaaaataccaacagctttacaggaaagaggaccagcctaataaccctgaaatagtcgcagttagtgaacccttaggcacagttttctcagtaaaaaaataatgtgatagttgataggataacctggagaatcccactaagtgctgatgtatagacactgtttcaatcttctcacattcatctgacttccctccagcctacctcagtgctgtgttatcctgtgtatggacagattgcatgtcagattcctaattttcaaatcaattttcaaattaataatttaataataatgtcttatacttatgtatatttcaaatcaaccctggtaaatctgatacttgtgttttatagtcaaagttgagcattttatgaatgcaccttgtaaatatcacatatcaggcaagcactagaaaaccaaatcacaaactgaaccaggttatcttccaacatttgccaaaatgagatgcaacacatctgagggaaatatgtattaatctttcttgtaagttatctgaattggtttaatggaaataaaattttaaaaactaaaatatattataaattctcatggatctgtctacattggtttataatttattttttcattagatttataaaggggcaatgtaaaaattaacatcagaatatcttatataacccattttatccattgtaataaagtttattgaacacctgctatgtataacttttgttttatttccttttaaataatagaaactgtattaactattgggtttcacattttcctttggcttccatgaagctcctgcctaaattttttgctcaggcacagaaatgaatttatctaggttaactggataacagtgcatcgacctctattttacttatagtagaattttatctacatattatttcctgttctgttttatatacctttagcagtgtaagctaccttaagcctttgcagaaatcaaatgaactataagtcatatatgaataaataaatgctaggtctaatatagaaaaattaataccttgaaataaaggtttattgagtcttttttcagagaagaagcattcctctaatgaaaaatattaatcagaaccatatttgctaattaataatttaatgataatgtcttatgcttatgtacattaaatatatttatatataaatgataataataatgcctcacacttatgtacattaaatgcatataatatataattatatatctatattatcacttctcacagtgaccttaggaggtagacattttttctcaaattaagtgtgaaaaattagaattcacaaattccaggatttgaactaaagacaactaattctacataaagtggttcatctgtaaaatttagtgtttagaactaatgtttgctatttgcatagggctgcagtatgaaagagtgttgggaaatgtcattagcccgttcttgctttgctataaatatctgagactgtgtaatttataaagaaaataggtttaattggctcatggctctgcacgctgtacaagtacggtgctggcatctgctcagcttctggggaggcctcagggagcttttactcatggcagaaggcaaagcaggagcttgaacatcacatggaaagagtaagagtaagggagaatgtggtgggggagtgccacacttttaaacaaccagatctcatgagagttcactcagtattgccaagatagcaccaagcgggtaatgctaaacattcatgagaaaactacccacatgatccactcagctcccatcaggccccacctccaatactggggatgacaattcaacatgagatttaggcagtgacacatatccaaactacatcaggaggtaaggcatttagatatatgtgtagacttcaaacctccttgctgtctcttcagtcctctaaaatgaggtgtgtctaaagaaacaaaagctttcatacagacctgtaccctagtggagatactgagtcatgttgacaaggattaaactagtctatataggccatcacataaaaataagctttatttagccagacaacagtaaccattgtgttcacaagaacacatacatacaagcatggctgtttgctcatagtaaaattttctttcctctagccatcaaattatcttgaaaatttgctgaactcttcactgtactaacttaaaaagaccatgcaagacttataataactcattgcatgaagatgcctaagtcattaatgtgacattttttttagaaagacagccttccacaaatctatttctaaatattagaggaaattgtgaaatatggttcagatatgatagagaatcatagcccatagttttttcctggtgtaataagacttgtaacattttcaagaaatcaagtttaaagtcaatccataactctaagaagaatcctacagcctccctaaaatttgaaattatatatatacctatacacacacacacacaaacacacacgcacacacacaaacatatatatatgaaaagactctattaagataaaaatactacctagaagcctaatggggaaaatatggttaagtttgctcacactgaattggaacaaaataggattgaaattttattccaccatttaaaaagcatatgacttgggaaaattacataacttcttcacatgtcaatttcttgagctataaaaagagttcaataatataatttatctcatgaggttgttgtgaggattaattgtgataaggcatgtgaaatgtttcactcattgtttttgtaagtattgagtaaaatcactgaactggtgataaaataccaggtataaaactgacaatctatccaaattgatttttgtcttaacacattcagggcagaagaaaatgagaaaaaataaaacaggccgggcgccgtggctcacacctgtaatcccagcactttgggaggctgaggcgggctgatcaagaggtcaggagttctagaccagcctggccaacatggtgaaaccccgtctctactaaaatacaaaaatattagccagacgtggtggcttgtgcctgtagtcccagctactcgggaggctaaggcaggggaatcgcttgaacccaggaggcagaggttgcagtgagccgagattgtgccactgcactccagcctggcaacagagtgagactctgtctcaaaaaaaaaaaaggagagaaaaagaaaaaacaaaaccaaaccctaaaaacatggatacccaaatagagtaaattaagaatctagagacattagttatctgaaaactattcagaaactctgcacaaacttttgatattggattgattaactttgataatgaccttatttttggagtaaagtgaacacaaatatcagtgtattagcccatcctaaaatattatttcataaaaaattaattcatcataaaataacactacatatcaccctgctttcattttcttaactacattatagaatgatagcacatttagaagatgatgtcatctttcaattaataaagatagttgtgcctcttagagaaaggtaataatttcaagaagctggatgagctgcaaatctacacaaatatttttaagaacatatatctatttaacaattttgtgctctctcaattttatttttgctgtttttagacatatggatgtttctatttttgaaattctttcttgtttttgtttgtgatttctgttttttagtcttcctccaccaaagctgtttagtaatctagtttttttccatttcattatttgattagttatatttgattattaatctatcaaaaattacttcttcagttgtgcaacgtggcgatcaaaattgattctcaagtaaatacctcaggttcctagtaccaattattgtctcatcttaatatttattccttagtttattatttctcctttatttatattaattatttatgtattgtacaatataactcctacatatataacaggttatatttttgcattgccatttctggttgattggtctgtctattcgtaggttaataccagaccattttattgattttattcttacatttccagatcttctcttttgggcaatactttctgatttgaaaggaagtagtgaaaaagttttacaaaacagagaggaggaacatgtgttgatcagtcacatggtttgtaaagcaaaatattggggtttgttgtatagtgtttacttattttaaatattaattttttctattcaaagaaaatatttaatggtgaaaatcatgaattttggatatagatgtgggttcgaatttgaactttgtaacttaatggttttttaatctctggtaaaatccattaaattctttcaagctccttcctctctgaatgggattattaatatgaatctcatcagtttagaatgagtcctaagtgagattacagaggaataaataaagcacagcttacttgtgattgtaagttcctgtcttcttatattaataagaaaaataaaacgaaatagtgctaaagtgttgggacagcgaaaatttttggagatggtatggagagataatgggcgatgtttctcagggctgcttcgagcgggattaggggcggtgtgggaacctagagtgggagagattaagctgaaggaagattttgtggtaaggggtgatattgtggggttgttagaaggaacatttgtaatttagaattattggtgatggcctggatacggttttgtatgaattgaaaaactaaatggaataagagaaggagaaaaacaggtataaaaggtctaagaattgggacgactcaggacatctgattagagagtgcctaaggaggttcagcatagtcctgccagcaaagattatttatttacttcaagagttaagagtggcagtttggggatagcaccaggaggtatcagctttgatgacttggagaaacagtgtaaaccggcagtgtaaacaagagcagggcatgcatgagtagttgagaacggtgaataggagtatgactagacacaagatagtaggaatgacaagttttttgggggcacagtctaagttgatctggtgtctggaatgagactggggcctaataaaaaggagcgtctatacaggagctcaaatggcctgtaccttgtagcattctgaggacaggtctgacttctgagaagggtaagtggtaaaagtattgtccagtcctttttaagttggtggctgagcttggtgaggtgtgtttttaaaagacctttagtccattctacttttcctgaagacggaggaccataaaggatataaaggtttcactgaatactaagagcctgaaaaactgcttggctgatttgactaataaaggctggtctgttatcagactgtatagaggtgggaaggctaaactgaggagttatgtctgacagaagggaagaaatgactgcggtggccttctcagaccctgtaggaaaggactctacctatccagtgaaagtgtctacctaggctaagaggtattttagttatctgactcggggcatgttgagtaaagctaatttgccagtcctgggtgggggcaaatcctcgagcttgatgtgtagggaagggagggggcctgaataatccctgaggagtagtagaatagcagatggaacactgagaagttatttccttgaggatagatttccatgatggaaaggaaatgagagcttctaagaggcgggctagtggcttgtactatagcatagcctgcctttgcttgtgtgtggcgattaggcctggtggaactgccatcaataaatcaagcgtgatcagggtgaggaacaggaaagaaggaaatatggggaaatggggtgaatgtcaggtggatcagagagatacagtcatgggggtcaggtgtggtatcaggaataatgtgggaggccagattgaagtccgggccaggaacaatggtaattgtgggacttaacaaagagtgagtacagctgaaggagccagggagcagaaagtatatgcgtcagctatgaggaagaaaatagattttggaagttatgagaaatgtagagagtaagttgagcatagtttgtgattttgagggcctctaaaagtattagggcggcagcagccgctgcacgcagacatgacggctaggctaaaacagtaagatccagttgtttgcgcagaaaggctacagggtgcagtcctggctcttgtgtaagaattctgaccacactaaccatgcctaggaaggaaaggagttgttgttttgtaagggattgaggtttgggagattaatcggatacgatcagcaaggaaagcacgtgtgtttttatgagaattatgccgagataggtaacagatgaggatgaagtttgggcttgactgaagtaatgggggctgtctgtgaagccttgcggcagtacagcccaggtaatttgctgagcctaatgggtatcagggtcagtccaagtgaaagcgaagagaggctgggatgacgggtgcaaaggaatagtaaagaaagcatgtttgagatccagaacagaataatggattgtggagggaggtattgaggataggagagaggatagggtttggcaccatgaggtggataggcaaaacaatttggttgataaggcatagatcctgaactaacttgtaaggcttgtctggttttaggacaggtaaaatgggggaattgtaaggagagtttataggctttaaaaggccatgctgtagcaggcaagtgatagcaggctttaatcctttcaaagcatgctatgggatgtgatattggcattgagtggggtaagggtgattaggttttaatgagatggtaaggggtgcatgatcggtcgccaaggagggagtagaagtatcttatacttgtgggttaaggtggggtaatacaagaggaggacgcaaaggaggctttggattgggaagaagggcagcaatgagatgtagctgtaatccaggaatagtcagggaagcagacaatttagttaaagtgtctcggcctaataagggaactgggcaggtggggataactaaaaggagtgcttaaaagagtattgtctaagttggcatgagagtgggggttttaagaggtttagaagcctggccgtcaatacccacaacagttatggaggcaagggaaacaggcccttgaaaagaaggtaatgtggagtgggtagcctcagtattgattaagaaggggacagacttaccctccactgtgagagttacccgaagctcggcgtccctgatggtctagggggcttccgaggcgatccgacagcatcagtcttcagccgctaagccaagaagatctgggaaggagtcagagagccttcggccagagttccaggggctctgggagtggctgccaggtgagttggacagtccgatttctagtggtgtcctgcacagatgggactcggcttaggaggaatcctgggctgcaggcattccttggcctggtggccagatttctggcacttgtagcaagctcctgggggaggaggttctggaggaacgcctggtcgctgcgtttcagatgtttggaagttcttgtgtgctggagatgtggctggggtttgtctcacagtggaggcaaggaattgcaacttttttctattattgtacacgttgaaggcgaggttaattaaatcctgttgtggggtttgagggccagaatttaatttttggagttgtatttaatgtcgggagcagactgggtaataaaatgtattttgagaataagacggccttttgacctttcagggtctagggctgtaaagtgtctcagggttgctgccaaacgagccatgaactgggctggatttttcatatttgatgaaagagcctaaacgcacactgatttgggagaggtctgataaggaaaaaggagcattaaccttgactatgcctttagcttcagccacctttttaagagtaaattgctgagcaggtgccggagggctagaggtggaacgaaactgtaagccggaccgggtgtgaggaggggaggtgataaaaggattatagggtggaggagtggaggctgaggaagaattgggacctagctcagcctggccaggaggggagaggtagaaaaggaagattagaaagactcagcgaagcttggggttgggactgaggggacaggtgggagggaaagaaggaagatttgggatgagttacattgggaacagagactagagatgcactgacatgtaaaagagtgcctggacatcaggcacctcagaccatttgcccattttacgacaataattatttagatcttgcaggatggaaaaattgaaagtgccattttctggctatttggaactactgtcgagtttgtattggggtcaagtggcattgcagaagaaaataagacgcttagattttaggtcaggtgagaggtgaagaggttttaagttcttaataacacaggctaaaggagaagaaggaggaatggagggtggatggttgcccatagtgaaggaggctagcccagagaaaagagtagagacacggagaagggttgggggttcttgccctccagaaaagcagagaaggggttggggcacagagatacgaggtcagggcacggaaataagggatcggggtgcagagatataagaggttggggcacggaaataagggatcggggcacagagatataagaggctggggcacggaaataagggatcggggcacagagatataagaggctggggcatggaaataaggggtcggggcacagagatataagaggctggggcacggaaataagggatcagggcgcagagatataagaggtccgggtgcggaaataagggatcgaggcgcagagatatgaggttggagtatttgcccctcctctagaaaagcaggacttgccgctcagggtgaaggagaaggggttgggggtttcttgccccccagaaaggcggagaagacacggagagaaggggttggggtacttgccctttccccagaaaagtgggacttgccgctaagggtgaaggaccaaggcaggcatccctgcgtggtctgacacctctgaaacctgggtgaataatcagggacgcatccctggaatgattaaacaccaggggaaggctgccttccctagtccatgaccagcgccggagttttgggtccagggataaaacgtgtctcctttgtctctaccagaaaatgaaaggaattgaaattaaaagaagggagagattgacgtgtggcgccaagattgaaaggagaaagaggttgagggatggtgagggaggttggagaagagagtaaaaaggggctgcttaccggattttaaattggtgagatgtttactgggctggtcggtctgaggacctgaggtcgtacgtggatctttctcacgagcaaagaacaggaggacaggggattgatctcccaagggaagtcccctgatccgagtcacggcaccaaatttcatgcgcctccgtgtgaagagaccaccaaacaggctttgtgtgagcaataaaagcttttaatcacctgggtgcaggcaggctgagtccgaaaagagagtcagtgaagggagaaaggggtggggccgttttacaggatttgggtaggtaaaggaaaattacagtcaaagggagggttgttccctggcggtcagagtgggggtcacaaggtactcagtgggggagcttttgagccaggatgagccaggagaaggaatttcacaaaacaatgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacagtaagtgttcagtaaatgtaattagtataattattaaaatattcatgattattattcctttaaaatattctagaaatcttcatgttatctaatctggaaaagaatttttctagctccattgctaaaaaaattcttcaaattcaaatttatttctgtatctcttaatagaaatgaggaaacgtatttcctcttcctgtaatagtagtctcagaacacgtgactgtcacttgtgtgtctctgtgagtgactgtgtggaaagaacttatctgactcactcacttctctgtgccttggctttgggtatatggctgcaagtctctgctaattactcctatgccactttcagcacaaatatcacttattatgtgctgcttgaatattattttctttatttctaagtttggtccattcagtcctctcatggcatgagttgcttttcttatttccacataagtatttgaaaacttgtcagaatgctattttcattagacacttttcattattacgctgtcatcactgaacaagtttatttcaaagccttttgagaaaaatgacagaaaacatagcattttatttccttggccgttcattagattagaaatgtcaagaaagacttagattatacttatttttattaaaaggaatgagagacttttcttgaaaaaaagaaaaaaagaaatttaaattttgaatgctacgtcttagggctctatgcagtgaaacattttctcttcattgtttagaaagacttacattttattttaaaattcctgcccgtctttttctcttgaagagataagatactctaatcattctagaacaccagctattaatctgaaattaaatctattacgtgccagaaacaaattaccccaaagttaacctaaaatatcatcagggtaacaccttcagttacaaattatagtaacatcttagataataaatttcagcagctattaaaagagagatgataatagtacctttgtctgaggcttcttatgataattgactttaaatatgtagagcatctaatactgcatgtgaggctgaattctatgaaattactaatactgaagcatttttggcctacagaaggaacggtttcatgtggttcaaccgaagtgttgctcgttaattttgagtttcccattcaccactgcactgacctttagccaggacagtacttactaattataatttaaaggtcgcatggatagagagcaaggcagacttgttacgacaaacctgtgtcttgtctatcttggtatggtggtgcctcagttagcacagggctttcactctcttactatggccagcttcacagtctctgtgacccttcaacctgtcccatgacttctgcttacccgtggccatggtgtctactgatggcatcactatgctcactgccttcacccatatgattctcatatgtgtaatttactagccagtatccagcaaggcctgctgtgtatgggagctggtgccatagaaagtgtggatgaggttatgtgtaggtatctctgctggtggtgggttgatgataaccatatttgacgcccttaaatttctaaaattaggagtcattgtattcattctagattgaggaggatagcatttaaatggggcttaagtatgccttgtaagtatgtaaaaagatataaaattaccatgcatactgtctttcaataacataacaagactgtagtttagtgagctcaaggtgacaaaatagccattattttcttactgtgagagtcattttgtttattgtttgcatgagtgacaatttttccaatgaaactttcttggttaatagaccctttcttatacataaatatgaaataagagggtgatagaaatcagatattatatctagtttttatgactagcagattacacagaataaaaacatcacaatgacacaaaacataatcttacacattagacaaaggcatacaactttaaaaaatattgcaatcaaaaagatgtaattaaattaccctgattcattgaaactttagcttttaaaaggttcatttttgtgggtataaataaattttgttatcttaattttatacaagttacaattatattattgttaatgacagataccaaatttaataatgtcaccttgttttatgttttataaaatttgcttcatttttccacctaagcagatatgctgtcaaaatgtggtgttacctgaaattttaaaatgcatctcttttccttgtgtaattttataataaaatagttaagaatgaagaattataaaaaagttaagaattttattttgaagactgatattctaagttgcatatagcaaagaagttacgaacttttatagtcaaggacctcataacacatgatagatgctaattttaattaaatttattatttcaactttgaaaaatggggtaggaggagagtatgaatcagaggatgaagtaactcacaatttaggctataggggccacatttttctaacttaatattccatgattatttccaaaggttacttaaatccaatatatgactcagagcttcagacttaacgtcatacattttcacataggttttaatttgtggagaaaggacatattctgatattattatagaaaagccattggattctatggtgtgataataagagatttcaggtctgggtcttctttatcagtcagcttttgtattgcaataacctacaatctcaattctcaaaggcttagagcaagatcatttgctttttgttcatctgaggactgccgggtgagtttgggttggctgggctcagtttcactgggcttttgattccaggagcccagagtgaagcagcagccactatcctgcagttttcaacgcagaggacataccaggggagacagaggctgagccaaatcaaataatcacattgaaaccttttgcttaatcataccaatgtcatggctgctcatattcattagccaaagcagccacatgacttggcagaagttcatagggttctgatgcttattcctcccatagaatgaacaggaattctcatataactataattgactatatcaaatcccattgctggaagtgggtgaatagctgggaatagtaatccactgtattacatatgccaccaaatgattcagcaactttccagtttcctactggacagagagaggcctgtctctctggaaagtcgctcctcctttatatgaccgccctgacagaccttgcacttgcaacttgactccctgctgaaaaccacttctactctgttttcggaaatacctgtagtgtcagtagacaaagtagaacaaaatgagaaaatagagagaggatgggatctgaaaactagtataagtcagggcaggaaaaaaggaagagtctgaaagcaagcttggagagctgactcttagaccagaatagaaaacattttcttcaaaatattcgccccttttcaaatgcagaattaggccagttatgttttaggatacccattgccttatattcttaaaaagaaaagaaaaagaaggaaaagaaagagataacacttaatagtccataacaaagtgtcaacgggatagacacatgcttattcaaaccacagatatgatccagttaatttccttcttaaaatgtgcccatagtgtcttattgcctcatcgtaatgataataatgagagcaacaattataatggcaaaagcaaggactcctgccatttactgtttgtgtattaaatgctccactctacactaaaagctttatgtacagtcttattcctcaaaataaatatgagaaaaacaactttaccaaactcacatagttaataaaagtatttttatgagccaccacaatactcaaaaatggtgcaatactgtgttttcatgaatttcacccaatctagctttcctgactcatctcttgccttcccctctgtgattgctaagtacagacacacagaagtgctgccatttcctcactatactctactatttcacgcctctgtgagtctgtatccatgaatttctccacttggaatggcttttctagccacactactcctttgccaacctaacaaattctgtttctcttctaatgactcttctagacgcagtcctctgccacctgctctaggaaggtatgccataggtagataagttgtctcctgcatttgcttgcagtctccacacactgcagcgatcacatacacctgcacataaaatgtctttgctatacatgcccattcctgggcccacacaagtcttccacccttcctcaggtgtgaataccttaagggtcttctttattcctattttattttatattccagtgtatgttctaacaagtaatcaagtgacttgaatggaaatctcaatagccaaactgagttgttgctgtacatttttaatatttaacagagagatggatctattggaggcagtcatctgagatgatcagatataatggccaatagcaactatgctaatcataaaatttaaaatgtaaaaaattgcttcgtcaaactgttttaaaagatgtatctaaaacatagtaggctgagcatggtgactcatgcctttaatcctagcacattgggaggccaaggtagcaggattgcttgaacctaggagtttgagatgagcctgagaaacatagtgcaaccctgtcactacaaaaaaaaaaaattaaaaattagctccatgtggtggcatgcacctgtagtcccagctatttgggaggctgacatgggaggatttcttgagcccaggaagtcgaggctgcagtgagctgtgatcatgccactgaactccagcctgggtgacagaacaagacactgactcataacaaaacagaacaaaacaaaaagcaaagtcaagatttggatgttcagtgtattcattgctacttgcacacacacacacacacacacacacacacacacaagcaaacacacacaatatagttttatcagaatacacatattctgatagcagaattgaaagcttacataactgtgcaagctttggattctgctattctctggtttactcatccccagttttccaatccatcaataaggatagcctcaattatctaataagcatttcatgtgtatttcaataaaataatgcattttaatgaaaaattcttagaatagttcttggcacatgccatatttaaatgtcgccactgcctcattcatacagatcgtacccaagtaaaagtgtatatatggagaataaaaatgaaaacaggaagtaagacagtaaatggaggaagtcatttagatttgatagcatggtttccaaaggcagtgtcctattagaagtgttcaggtaaataaaacgttattggcagagacagatggtaaagccattttagaaataaaaattaaccaggtaagcacatgccaattttgggaaaacaatttattgtacctttttttctggagcttatttcaatgtaaaagtactttaaaaacttagaaaatagggtacatattaggtaaaagagagtcttgcaaaaatggatccagcaaatattagtgaagagaaaaagatgatcagaactctgagtttcagtgatttgtcttgtaccatattcaagctgtaatcactgaaggtaggaaacaaaccagcaaaacatttgtaaggtgatggtatcatttaaaaaaaatagagaaacattacagacaacttaaattggaaacaaattggaaacaatttttaaagttatataaacaccacatttcaaaaggattgcatgatatcagaatgggaatttctagtagaaagttgaaaaaaaaaatgagactcaagggagactgttagtgtggtggtaagattgggtagaataattcagatctcaaccatgggaataacctgttgaataatcatgtgaatactaacaggtcacaataatcccgtgaatgaacatgttgaatttcggcatagagagacagcattgttattgccaaaagagctgagtagaaaggaattttgtgatgagtgatttcaagctacatttctctgagtatcaatgtgcccatctggaaaatgcaacaataaacagccctcacataattgtgaatattaaaagattatttgaagtgtctaccactttgctgatagggattcaacaaaattaaatttttcataccgaagagtagaattttccgtcagtacctcatggggcatcaacaatgatgataagcagtagaggctgacttgatattagataacattaggtgaccagtgagccaagacattcacttctttggctttccttcagtaaagtaagttacctaaaatctgaattagagtaagcagatgttgacagggataaatgaataggaaaagcatgcagagagttaagaaagaaggcatctaggatatttgtcaagaaggattaaaggcaggttttatgtatgcaaacctggatggtgaaaatggatagtttactgtgctgacttcgttcagaggtggtataattagacagagagacaaagccgcaaatgtgacttaacttgggcacagactatgagatagttggcatttgtagctggaaagtgtaagggccggttccagaggtttgcactgtagcagtccattgtgatgacaagatcctggaattcatcatgagacagagtgaattatgtggagaaggaaagtgaaaacaagaaggatgaacccagtctggtggaatttatgtcttcctcccttctaaattttgactgtgaataaatcttgttgcaaaagaaaaggtcattattaatagcatcagtcatggatgaaaacaaattagaaaacttgtttgttttattgaacatgattcagcagcagaggtgatttgaaatatcctatagggaaggaattcatgcatgcataaagtgtgttggggcaaaccctactggaagcttctttgggtcataggtcttcctggccttttcatttgtgcagcctcttggcaggtcatcactactttctaattctaagtcctgaaaattgcctatgaggtaagtttctatttcattaaatgttctattaagacaagttttctattgtcagttttgttatgaccaaattcataaatggaacatataataaaatgttaggaaatttggacattttatttcatgattattgatttctaaatttatgtaaggtccattctgtgaaattcctagagaaatttaaagagttttctttagaatattttatttgcagttattgatacatgtaacaaaaatatgggtagtatttttgctttctatgacaaaatatttatagttaagatattaaaaatataacgaatattaattatacaaaaataatacattttagaatgataattcaaatacagaacccatcaaaatcaataactatatgttagtatcaataaaatgccaattaaaaatataagaaaatatgagaaaatactaagaaaatataagaaaataatttaagaaaacctcttaagagatagcttaagaaactttcttttacccataaaatcccatgccttaccacaacacggcaatgcagatatttccttcaattactggtgggaaaaaaaaacatgagatttgaaatatcaaataaaatgtgtaaaatcaaaaaaataaacagtaagctaaaacttggaggtttttattttttccctactacatctctaaggcgttgtgagattcatttaagctagaacaagtagaatgtgttctagaaatggcatccataggatagtttaataaccggaaaacaattatccacaatgtttcaaagcatacatttggtttgtttgtttttagcattttaatttgtaggttcattcaagttaccacatccaccaattaattgcaaaagacctagccacaggcaatagttgactacttttgctttcctttatttgaacaactgttattatgcagatttcttgttagaattattctgctgtaagagagtgaagtctacctaatttcatgaatataaagggggagatgaattatgagaaatatacaggagtactccatgaaacccagcaacaaaaagtacaactggaaattacaaccagagccagaagcaagagtggtataggaagaaagatggctacttcttacatctctgcctctttttcttatctttctatatatctgctctgtttccctttctgtgtcagtaaggcaataccttctgctgtttacaaggccccaaaatgactgttttacttatacctaggtgtacttgactttccattttcaaaaactatcacgtacttccagatgtaaaaggattatgtctcttggattaaattctagaggaataaaatgggattggcccaggtgttctaatggacagtatttctttctgtgagaatgaagggaagagacagcagaatatgaacatggaagccctggcccaatactttagcctaagccagtggttttcaaacttgagtccccatcagaatcactgggaggctgtgttaagacacagattgccagcaagttttcaggtgataataaggtcactggaccagagaacatactttgaaaatcactagttatgctgtgggattgtaacagttctcaacaagaggaaatggacaaatattccaacgatgtgctatctgtacctttttgtgcaattgagccgctttgattatccagcaatttttttttttttggagacgtggtcttgctctgtcacccagactggagtgcagtggtgtgatctcggcctcagctcactgcagcctccacctcctgggttcaagcgattctcctgtctcagcttcccaagtagctgggattataggtgtgcaccaccattgcctgactaatttttgtattttcagtagagacagggtttcactatgttggccatgctgatctcgaactcctgacctcaagtgatccacctgcctcgcccttccagagtgctgagattacaggcgtgggccaccatacctggtctatccagctatttgtcttcattcatttattaaagaattattgagaagttactatataagaaaatagacatttatattcctatatatacaaaaattaattccttaataaatatagttcatgtatgtgcctggatactaagcctcacagcacatattattatacattttttaatatgtaataccattttactattttattatctaagtacagaacaatcaaattttcagaaaatgcaatcatttatattttatgctttatttattttcccaaatatttatgcataccatatgtgttatattgtaaataaaaacaaaacaagtgaaatagcttgttgatgttggaggttctcttatttacaataatttttcttcatgaagaaagatgtgtacccatatagtgatggatcaaatataaagtttacttgttaccatatattaagggtcaaaatatcctgagaggaataaactctctaaactgtttcttctgaaacctggttccacagtaacatagtctcctgatttacgaatataaagccaatcaatcctcagagatgagccattcttttcgtcactgctactctcttttgaagtgacattttcctagctgcataatctgagataatgtttggttgtataaaatatgctactattatcacatgtatgtgctgaaaaattacaaataagccatgtttcttaattatgttatcatactgagtgatatggtttggctctgtgtccctacccaagtctcatgtcaagttgtaatcgcgaagtgttgagggagagacctggtgggaggttattggatcttggaggtggtttcccccatgctgctctcatgatagtgagggagttctcatgaaatctgatggtttaaaagtggaagtttcccctgcacgctgtctctctcctgccaccttgtaagaatgtgcttgcttatccttcaccttttactgtgattgtaagtttcctgaggcctccccaatcatgcataactgtgagtcaattagacctctttcctttataaatttaccactctcaggtagtatctttatagcagtgtgagaattgattaatacagagaattggtaccgagagtggggtactgctttaaagataacctgaaaatgtggaagtaactttggaactgggtaacaggcagagattggaacagtttggagggctctgaagaaggcaggaagatgtggggaaggtcagaatttcctagaggtatgttgaatggtgttgaccaaaatgctatagtgatatggacaattaagtccaggccttggtagtcacagatgcagatgaggaacttcgtgagaactggagtaaaggtcacttatgctgtgctttagcaaaaagcctggcagcattttgcccctgccctagagctctgtggaacttcaaacttaggagagatgatttagggtatctggtggaagaaatttctaagcaacaaagcattgaagacgtgacctggctgagtctgaaagcattcagtcatatgcattcacaaagagattacctaaaactgatacttatattttaaaggaaagcagagcataaaagtttggaaaatttgcagcgtgaccatgtagaaaagaaaaacctattttcttgggagaaattcaagccagctgctgaaatttatgttaagtaatgaggagctgaatgttaatagccaagagaatgaggaaaatgtctccaggccacatcagagatcttgacagcagcccctcccatcacagacctgtagtcctaggagggaaaaatagtttcctgggccaagcccagggcgatgctgttctgtgtaacctcgggacttggtgccctgtgtcccagccactctagcttttgctgtggctaaaaggaggccaaggagcagcttgagccattgcttcagagggtgcaagccccaagccttggcagcttccacatgtgttgggcctgagggtgcatagaagacaagagttgagttttaggagcctccacctagatttcagaggacataaggaaacatctggatgtccaggcagaaatttacttcatgggcagagccctcatggagaacctcaattagggcaatgcagaggggaaatgtggggttggagcctgaacacagagtccccacctggggcactgcctagtggagctgtgagaaaaaggccactgtcctccagaccctgaaacagtagatccacagacagcttggattttgtgcttggaaaagttgcaggcactcaatgccagcccatgaaagtagccatgggggctgtatcctgcagagccacagaggtagagctgttcaaggccttgggagcctcccctccttgcatcagcatgctctggatgtgagacatggagtcaaaagagattattttgaagctataagatttaatggccagcctgctggaattggacttgaatggggcctgtagcccctttgttttcatctatttctccgttttggaatgagagcatttgtcccgtgcctgcacccccactctatcttggaattagctaacttgttttttattttaaaggcttatagaaggaagggacttaccttgtctaagatgagactttggactttaacttttgggttaatcctggaattagttaatactttaggggactgttgagaaggcatgactggtttcgaagtgtgaaaaggacatgacatttggaaggtggcagaggtggaataatatggttgggctctgtgttcccacccaaatctcatctcaaattgtaatccccacgttttgagggagagacttggtgagaggtgattggttcatggcagtggtttctcccaggctgttcttgagatagtgaaggagttctcacaggatataattgtttaaaagggctagtttcctctgcacactctttctcctgccaccatgtcagacgtgccttgcttcccctttgccttctgccatgattgtaagtttcctgaggcctccccagccacatggaactgtgagtcaattaaacctcttttgtttgtaaattacccagtgtcaggtagtatctttatagcagtgtgagaatggaataatacacttagttactgagattaatattcaaaaaattaataacattttattgataagaatcacaatgttatgtgaaaagttcccacaatttttctatgtgtaactcaattagaactagccccttctgcttgcctgctctcatttaagtcatctctcaactcccaactatatcccaaatacacatgcaattataataaataatatagaatttatagttttatgaagagataaaaatgagagggagggcacaccaaaaaatcacacaattatgcttcttaaatttccctattacctatatgcagtaattattaaaatttcctttcccaaactagctactacatcactctactcaaatcttctaaaaatttctagggtatcggtttctttttctcctcaacagaaagtctcaaaattctgataactcatatattgtagtctgcaaaggttgtagctgaacagttttagaaattcagtctttagctcagaactattctgctgagggagactaaatttattttcttccaaataaaataaatattatgtctctatttgaaaatgtatcctgtaatacctagacatgttttttcatagaaggttttgaatattttatgtttgaaaggcattgaaaccaatgattctatggataggaagaaatgaaattaaactgactaatgaacaagcacctctgaaaaatttcaagaataatttttaaatattcgactgcattgattgttagaaacatgctcagtgtgtgtgttgctgtttcttttattgttctgcttggaaagcgtgaaggacccagaagggtgataattttccacactggtcctctcctgtccctgccactcagccatttcatttcaacccctttagcacatgaccttagccactaacttctttttcaccagtcatgataaactcaaactagtggatctaattagctattagcacagctaataatcgtgagaacaaactttgtctcttccatgcattttaaaccataattcctaaaatgatcagaacttcagctgacccccttggtaaccatcactaaaatccttgcccccctcaattgcacgttagacaactcctttggtctttacttatctgacattttttcaaaatggcctatagtatcagtgctctggataatttccttcccctagatggttccaggaaatccagttgagcaaagtcatacttttgtatgccttttaagatacagaaagaaatatttcttctcttccaatgcatataacatttttccaatatgtacaaatcaaaatttctattggtaataaaaaacaagcaaccaactaccaagcaagaaaatattacatcagcaattgtttttatgataaattttgccaaataacaaatagatttcttgatggcagctactactgaaaaagcttcatatttaatcaaagtttagtaacagtgtgaaaatgaggggaagttggggttaaggatgatgtcattgttttagtcgctgtgataaaaaataatagacatctaattttggcattgtttaaaaaatatgattttacatttagaaatacttagttttaggtaggaacaaggcatgtgcttacaaatatgcagaaagtaattgggaatatatataagaatcaccttaactatctgatccttaaaaccttaataacaattgtgccaggcaaggtgtgagagccctggcatcacaaagtggtgggcttgtgggtagtggggtagtaagaagaacttaccaacaacattatagttttgaaagggaaagttttggccaggcgtggtggctcatgcatgtaatcccagcactttgggaggatgaggcggacaaatcatgaggtcaggagttcaaggccagcctggccaatatggtgaaaccctgtctctaccaaagatacaaaaaaattagccgggcttggtgacgtgcgcctgtgatcccagctaattgagaggctgaggcaagagaatcccttgaaggaaaggagggagggagtgagcgagggagggagggaggaaggaaggaaggaaggaaggacggaaggaaggaaataaaaagcctcatgtttaaaatgattcttcgctctcttctgacttgtaaatctccctttctcccttactcttaagcgtagttccatttcattgtcttctcttcttcaattctaacctctctggagaaatatgaaagaaaatcgtagaaaaatataatcttgggtttttttatcagagtaattcagctttttctaacctcatgggcagattaggccttacattttcaagtaaaactttgaaatgataatttgtaaaggcctgtccgattaactatttagataaaaatttacctcttgtagcttcctagaggttgtagacagagcagggtatggttggcttcatttttctcacttacaagtagagaacggaaaatctggaatgagatcagggataccatatgggattggaaatcacctgtgaaataatatttgtaaagccaattaaagagagtcaaagacagacctctaagtgcaagtataaagggaaaatagaaacatctcaatgttcacccatttaagggacagggaaatacattaaatccagataaattacctgagaggtaatcataatagttgtgtgagttagtgcaattatcttaatttacttatagagaaagtgagatacagaaatgaacggagctaaatgaagaagtcattatcaaatgtctttgacttaaagactgtgtcctttttaggacagtaggacctccctaatgaatttattctccttcgcagggtcagaattgagaataagtaagttagaaagtgatttcactttggtagattccaatgctgtcagtcaacaagagaagaataaaaacattgccctgtagaaaagcaatctatccaggccaggaggggtggctcatgcctgtaatcccagcactttgggaggccgaggtgggcagatcacctgaggtcaggagtttgaaaccagtctggccaacgtgatgaaaccccatctctactaaaaaatacaaaaactaaaaattagctgggcgtggtggcgggcgcctgtaatcccagctcctcagaggctgagacaggagagtcgcttgaaccaaggaggcagaggttgcagtgagccgagatcatgccactgcactccagcctgggcaatacagtgagactccatctgaaaaataaaaaaaaaagaaagaaagaaagaaagaaaagaaaagtaatctatccagtaaattgagtaacttaatatgtttttattattctttccattagtctaataaatagttggcaagaatgatggtgggagcaatccaaacgttgacaatgaaaacagagacatgaggaaacagaaatagcacgtggggttatctgatggtagggaagaaagcctgaaataatagggtaaagtgcaagtgaagcgaggaagcgagaaaaaacgaagcagaaggagttgaaatgccagaggtgtcagttactaacaacacatttaatgtgagagaggcagatcgttgtggaagctagaggtgatagccattcaaagcagatagggggatcgcagcctatgatgctccaaatgctactgccaaatgacagccactggaaatgccactctggtcattgtatcataagatgttaaaggtttgccattcattagtttcaaaggaatctgaatgagtaaccacattcattatagagacaaacaacagattatgaatgtgtactttaatactttaggggctgaaaggagaaaaaaacaaagacaataaaattctaatggctgtatttaaaagtgaacattgtgtgagtctaagaaagctaacagttcacagttcagtttgtcttaaaaaatatgtgtgtctgtgtataacgctcgtattacatatatctcatattaccatgttatataactatcatacataataccattatgacataataccattatgtatgtatgtactatagattattaccattatgtatggttatttacattatacattatatgccatttaataacatttaaagtgttataaagatgcaattttaaattacaagtggatttgtgacaagataattgaatccacaatttatgtcaacagagttggaaattgttgaggcatgtttctaaacttttaaaataggtcttcatttgagtagattttctttttttttctttctttcttttttttttttttccttgagacagggtttcactcccgtcatccagactggagtgcagtggtgtgatctcagctcgctacaacttctgcctcctgggctcaagtgattctcatgcctcagcctcctgagtagctgggattacaggcatgcaccacagtgcccagctaatttttgtatttttttatagagacggggttttgccatgttggccaggctgatctcaaactcttgagcttaagtgattcacctaccttggcctcccaaaatgctatgattataggcatgagccactgcgcctgtgctgagtatattttcaaatgtagaatactgaattcagtgcaatttgatcatattttgaaaatttctgcattattatgttgttgtattggaacatttgggttttcgtagttgttttgttttgtgtccctaaggggagatgaaccttctttgtttgcttgaagaatacataacatatgggtcttggtggttgagaagaccatggaagcctaaaagaacaaatttgccctctcccagcctcgcttgcaattagctattaaagttctatgggtgatacacatattatcaaagtttactgttagggaaagccagagcataagccataatcacatgacttcagctgagccaattgtaagcaccagactgagaacaaataatgcaaggagagaagattagcaaaggctccctttgggacctggcagttcacagtgatacttagagacaaaggcaatgtaagctgaagcagctagtactgagaaaaagtagcattattgtcttcactagacagtgaagtgtggagtggtttttgactttgatcctgagtgtctagccttccattgttgcttctggttttctgagccagtgtttgaaagcatcccacagttctatatgctaacacaattaactcttaaaaaattctgtttttctttaaatcccccagagttagcttctgttgccttcaactaaaaaccttgacaagtacagtagataaggcatggtttgggatcacaacttgattttttttattttgggaatacaaatttaacttgtggagagactgatgttctctatctcaccaaaaattgtttttgttataagctgtattcataagtgagctgtaatgttaaagagaaaaaagaaaaggattttaaattgctttctgcagcagaatgggaggcagtaaaaaggacaaactgctaaacagagaaaacaagacaatagaaaggaaagactgttctaaggaggagctgacagggctgctatgaaagaaatgtagagtctggctttaaattgcacatgtgacaagaaagatgtgatggaaaaaaaaatgtttgtttactcacactccgtccacatcctcactgcaacacacccacagcacactcttctaaggaaggttcacattgctgaattttttttttttttttttttagttgggtgtatagctgccttcaataaaatatttagtcacatacttgaacacagtgtgaagtcataggtatttgtgtatcacgacaacagcagataggtatttcaatatcaaaacaaaattggagaaacctgtgtagttgtaaaaaacactgcataaaataaagggagattgaggatgggtggtagagaggaggcaaatatcaggaaagaagggaagatgtccatgtctgatacggattttctcagctgtaaatgctgaggactgtttagtaaccctctttttatgtgctcatcaaatggacattaaaatatctatttgtcatagtggtttgtgagatatattcatatagcaattaatactgtgaagcgctgaaacttgctctaagttatacaaagagtggagacagagatagccaattggaagccggttacatctaggccatgtgttatttctgtatttacgtagtcttctctgtgtaattagaactgctataggtgctaattgaaggagaactttagatcctagatattataaaaaataaatagaaaataccattgctatggactgaatgtttgtgtccccaacatttatatcttgaaatttaaaccccaaggtgatgataataggaggtggagctattgggaggtgattagttcatggagttagtgcccttgttaaagaagccccagggaactgcgttggccttttcaccacgtgaggacacagggtgaaagcgccagctaatgatgaatcagaaagacttcatcagacactgaatctgtggatgccttgaacttggactttccagtctccagaactgtgagatgcacattcccgtggtttgcaaggcactgagtctacagtattttgttatagtagcactaatggactaagattactatgggggcataaatcctctaaaccagattttctatagatataaaaattaaaaagagctatgatacaaagagtccccatttgctctatatcccatgatttattcatttgatcaataaacatatgtgcagggatctaggtataacaacatgagaaagcaacaatcctcgtggaaatggtggaagcaagagaaattagaatttataaatgtgtagtggtcatacatggacttcataataatctagtgaaaaacaccacatgatttgttcttaatcatgttaatattataacttcttcagagctctcgctaaacacagcagcaagaaaatcagcctcaatcaactttgggagaacttttaactttgcctagtgtcagtcgaatgaatatccaggaagctcatgttatactcagaaaacaggaaagctctgaccattagtctgtggtgtttatcgtagttacctttgctctttctactataaggtggtgctgaatcttgtcctctgccctctattgaaaccctgaccctccacgcagaaatctttagaaccacagtttaatggctatcttttatggtcatcctatagtcagttaactaaccaattggaggtgccacaagtggaccaaataaatcttcatgttgcaaaggaattaaaaaacaaaacagtacctggacccagccctaagtaggagaggcatgactccatctcccctctggctgaataaccatccatcttataactccctgcctttcagagttcttttgtttacttctatctggatctgcttttccatctccaccaccaaaacagctcctgagtagagtggtctgtttttcaaacttgcaacctaaagacacccaaatgaaaagaggaaaatgaaagaataattcatttagttttttcttggaatagaattaagggaaaaatagctcacattctttcaagagggaacaaaaggtaaattaatattttaccatgttatccagtagcatatccattatttacgtggtcttattttattgattggtcaaaagattcacaagaagaagatagttcaacatacacctgtgttttgagggtgaaactcagctgaaatacactggaaacaatagctgtgaaagtctacaaggcaatgggagtgaaaagcataatttaaaaccatcatctttacctaatgatcaaagcctttggcctctaacagagattcttcatagcagttcacaaaagagtgccatactggggacataagagggtgggccaggtggggtggctcacgcctgtaatcccagaactttgggaggctgaggtgggcaggtcacgaggtcaggagatcgagacaatcctggccaacatggtcaaaccccgtctctactaaaatacaaaaaattggccaggcacggtggcacgcgcctgtggtcccaggcacttgggaggctgaggcaggggaatcgcttgaacctgggaggtggaggttgcagtgagctgagatggcgccactgcattccagcctggtgacagagcgagactccatctcaaatcaatcaatcaatcaatcaatcaatcaattagggtgtaatgggagagttaggaagggatcctatcctacagatggggtaaaggaaatgttatgtaaggtggcattggtaccacctattgattatgctaactgatgcattccaagttaccaaattagatctcttataaacttgaaattttatgattaagtattgctagttttggtttggaaaaatgatccaaaatttatgttgcataacttatagttaaaggaaaatgtagtacaatgatactgtattttactgttgaagtctttgtgttgggattaagtattaagaagaaaattactgttcaacataacaaccgaaagggtaaacatatttaaataattacttaaacaaatgtaaacattattaattccaactaactctgtatacactttccagcggttgcactgccttgttcagatagctgttgcttcatgtgtggcatggccaattggcttcatattatgaaggatgagaggcaacctgaactggccaaccatgacagcagacctttcttagggaagtcaagtccatcattgcctttttcactcttcagtttcaaatattgtaagatcttttatatgctgctgtctttgttaaacatgggaggctcaaacatgtcatcactcaggacttcatacctgattcctctttcagtgtttatggctactgtcttaccccaggctttcattttactcttattgggaccatttcaagggtcttctaactggactttctcccattactcactccatcctccacattttcacgatggttatttttaaattaggagtctaatcatgttgttcgtctgccccactgcctacagcgtaaactatagtttatgtatagaattttgtatagaattcttttgtatagaattcaagaccctccatattcaaccattaatgattcttgtccgtaagcacttagcacagtgctcaacgtatggcagacactgagtagataaatgtgtgctaggtaaaatgaattaagggcaattgagtggcccttccaccagatgatgtcctggtgtctagaaatagatgaattttgattgtttttggcaattatcttaaagatttcatatccagaaacttcaatttcataatttttctgattagcccattccattttattcagttgctttgatgataatcaataatagtaatattgttgacttcatacagaagaaaagaagataacttttaaacaattttaatatttccaaaagatgttttatgatcattttttacataaatattatattctttgaatagattatctgaaatagaattccaggaccaaagattatctaccactttaagccttagattgtaaaatggtctcttaaaaaagcacatcagctcagacccagatttataatgttctgactaaattataacattttatttaattgtcgataaaaagcacactgtttcacacataacacaaatttaactttttaaatttaaataccttaaagggtcaattattgcaaaagacagattgagacattcaacaaacatttcttgaatacctaatatgtacaagaccccatcccagaaaactatatagagttatagaaattaaattaagtgaaaaaatgagtatgtaaacatcaaaataaaaaagttagtttggagtcaaatgtaagcatttgttcttaaaaatattatggtttcctccaggattattctttagtagtacttgccaattttttctcagaatgtgttgtcctatggtttgctttttttaatttcacaaatgtcagaggtacaaaagagtcttacaccttttcttgcaggatttctaaaaatcgtatttagtcatcaagaccaaatttatcatcaaaccttaacccctgaaaccaagaaatttatgtatacattttatttatattttcatttatatttacatctcagcagtggcaaatgatacttatatggttttatgtattttgtacagaatcaccataggattattgttttgatgtatctaatattagactgtctagttagcaagataattggaagaattttacaaatttctgtaatattttaattcttatctaattgaattaactccttagcttcaaagtccctaataaaaagtataaaataatcaaaagtatttttaaaaagcttttaatttttaaagtaaataatatacggtttattcactcatacattaagaacttgtgaaaacagaaacatacttcataatgttaagttaaaattgttctattttagttttcaaatatttttaattttcttcaaggagaaatgttaaatgaaattataaccattagtttttataattttgaaaaattttctctattactctgatactttagagagccacaattttcacaaatctttgacattttaagttgtttcttgatattttcttaaattaaaaaccatgtttattcagatttatgcacatctttatttcagataaactattgctacaacttggttaaaacaaaaataaatattttacaatttttaaaatgctggcttatattaaagttggtttacattagaaaaaggctcaaagaacttgtattggaattcttctaccaataaattccatcttctaccaataaattcatgaaaacatttaaaactttataagtaatcaaataaaactaaaataatctaacactgtgtattagtccatttttacactgctaataaggccatacccaagactgggtaatttacaaaggaaagagttttaattgactcacagttcagaatggctggggaggcctcaggatcctcacaatcattgtggaaggggaagcaaacacgtccttcttcacatggcagcagcaaagagaaatgctgagcaaaagggggaaaatctccctataaaactatcagagctgagaactcagtcactatcatgagaacaggagcatggaggtaatcactctaatgattctattactttccaccctgtctctccaatggcacgtggggattatgggaactacaactcaagatgagatctgggtggagacacagagctaacccatattacattgcaacactgttattctcctttctccaattggctacattttaataaatgataatatgccactttcagcaatgaccttggagtgaagtactctggctccccgctggtagaagtccaagcacggctttttgaaaaggttaagatgtgacctatcctttaactcggcaattccactattgtgaattaatcataaagaagtaatgagcatttacaaaaatgtgtatgtgtttgtatatcagtgtgtgtgtgtgtatgtgcacacacacatccacatacaaatatgtgccctcatgtgtgtgtgtggacaagaagtcagaggcaatagattgaggagtaaatggtgacaaaggcattgattgtaaacaagtcttcctaggaaattacttatgaaagatagaagaacaaagtagctggagcaagaggtaagacctgaggaatctttttatgttagggaagatttgaacctgcgtaaacattaatgagaaagaacaaataggctaaaatagatgagaccaaaggagaagtgaaggaggagttcaccaagaagcgagaggtatagaattggcagcacaggtggaggaagcacctattacattgggctgggagggagtgaggtacagattggcacatgtgtgggatggtgagggtggaagggtgagagaaagagaaagagagagagagagagagagagagagatcagaaaggagacatggggagatatggaaaatttaaccagaggcaaagccacaaatttctgctttgggaaatgtatttttagtattaaatgcgtcacgtgcaaaaaaaaaaaacaacaaaaatcagaactcattccatctgtattataaggactgatattttcctaagactgcctaataataataaaaaagattattcacaactataactaggccaagtgtaatataaaaatgtaagataatttcttatgattttgaacaggagttgatgatctttatctgtgaagtgccagctagtaagtatttcggctctgtaagccacacaatatatgtctcaaatactcaatcctgtgattgtggctgtaacacaaaatcagccatggattatacctaaagaaatgggggtgggtgtgtttcaataaaattttatttacaaaaatagatgacgggccagatgtgctaacttctggtctgaaataaaatcagtgaagaacttgacactggtaagctaaatttttgttctctcagggtattttaagctcatgcctgattatcattatatatttctgtggatcaaagagattttcttctatttatagcagaacaagggaaagaacacctattctgcggtctgtggtcctagattttaaggacgacccttttacttgtactggccggttacttaaaacctctgagccctagtttccttcttcgtaaaacaaggcgatgaccctgtatttaatcctcacagatcagaatgagaataaaatgtaaatactataaaaatggtatattattcatacataaggaaatggtcatttgcaaccaaatcagaaaatgttagttcgatctccttatgtgtaagaccttgacattatatatacatatatatgtgtatatatacacatacatatgtaatagttgtaactattaagtgaaataataatatatgcaaagtgcttggctgcagtgcctaatataccttatatgctcagtaaatgccagataatgttcttaatttctaaaggcccattaaaattctccagtgcttgtgacacatagcgcctgaaggggcaaaatcaagttattccaagtcaagcacaatgctggcaatgccagccatgggcagggcagtcacagcaacataccttttaagtaagcctcccagggctgctttgcaaatggcgtaagaaatgggtattgacaattgtcatggagcccagtgactcggaagctgagttttgcgttctgagttgaatatcaggagagagttttcattcttctatgatttggaagttacagccccagactaaaaggaaggcatctgtttgattctatagtaacacaaacataaagagaccagatgagacggcatagctaccccggggcagttttaaaataaactgcaaatgtactcatcagccctttggaggaacatttgcccctatttgttcagtatgtgcagtttgttcaccagaccagggaatgcttagttattatgtgattccaccccattaaagttcttcaagccacccaggagaggcagggtaagcagcaatcggttttccatggatgaagaaggattcaatgagggagaaatgggcagtgcaggagcaattctaactcatttctgagtaaatatatagaaaactttgtgtcaggtgtgattcaacagaaggaaaagcattctctataacagttaacctacatttcgagcaaagagtgggcttttgttccttgtcttttaaacatttttatttttagtttttatctcagtgaaatcagtgggaatctacactgatgccaggttatgcggtgttattcaaacatgaaccttcacctgggacacctgttatctgcaacagagatgatttggcttttggcacttaataagctatttgccctctatagttttaaatcccaggctttcatatagacttgtttttgacatggtgcatttttagatcctgaatatgaagataatacgcactatgcatttggttcaaacatcggatacaagtgtccattgaaagtcaattctccctctcattttctgtatcaaatagataagatttttcacatggatcttttgtcatgttcatattcatcatctcaaaaattcatgacacttattgtttataatatttatttgtaatcattcaattgtagaactttttaaaaatgttaaaaaatagtaacttaacaagactatagtgaccatgaatagaggaaggattcaaacccagatcttctgactccgaataagtttttaaaatagtatttcttattcagaatgatcaactttaacataaataaaaacacttaaaatagaagggtattgatataaagaatgatatgatataaagaacacagaaaatatattgtataagaagtttgcttcagtctgtatttctgtaaatgattatttccaaagctgaagatcaaagtaaacccacatgtgtgtggggtgtgttcacaaattatattaaacttgtgtctcccttctggcaaattggctatagataagaaatgtaaatcacataagatgctacacgttggtttacatgagcctctatatcttcctaagcacacatatccactggcaaccacaagaatgcgatgtaggcacaatactagtcgatttaatgtgattctatgattctcgtttatagaactggaggtttcgcatttcccattcctacctaattcaataactcagattgcttgatttacttttagagcaatgattccctcctgggagcaattttgcttcctagcaaaatttggcaatgcctggagacatttttgtttgtcacaagagggggttgtgtgctactggcatcttgtgggtcaaggccgtggatactaccaaatatcctataatgtacaagacagtcacccacaactaagaaatatcctgcaaaatgtcagtggcaccagaggagatgaatgcaaacatgctaaccacattcctagagactagtacgtgaaccagaatgccatttattaatttgcaatgatagctagaactgtcaaggggaccaagacaatcatatttactgatgaatatatttactccctctggaaaacctatacaaaaagccaaattagaaccagacatttatttgctaaacataaagtcaattctaagaagatagatactcctcatagaacttatcacaatgaaaactgatcatttgtgtgattatatatgtattcctcctctttaagtctaaaaactctattgggatatggaacctatctcaatatgcatcatcttaaccaaggcatctaactgtactgcctgtcatgtagtaggtactaacaaatgtttattgaatccatgaatgaatgaatctttaatgtttcagtttaaaaatacatattaaacgtataacatatacaaagcacaatttgaagcactgggattacaaaatataataagataatccctacttgtgtggaagttcctgaattctgatggactagatggacacttccagttatgtcaggctgctgaagccatagcctgccctgccaacaggcaccatgaaagagctgagcctcagcagccatgttaggtatcatgtgactctgtgccttgaccacatttgaatggactgaggtgaaagagtatgaaagcaggaactggcggcatcctatcatctgagctttagcaagaagatgtggaccctgacaaatcagattcctgtgcttgggtatttaaataaaaatactaaatgactgaattagaagtgtaaagagaagttgcaaagatactgtagtggtttgaatggtggccccccaaaagacatccacccagtacctgtgaatgtgacctaatttgaaaaatgtctttgtactggtaattaagtgaaagatttaaagatgagatcatcctgaattaagtgggtggtcataaatccaatgagcgtgtctttatgcaatagacagaaaggtagaggacacacaggagaggttcatgtgaatgaaggcacagacagacagtgcacatatgtagccacaaaccaacggaggcctggagcaaccagaggctggaagaaggaaggaaggatcctcccctggagacttcagagggagtgtggtcctgccgacaccttgatttttgaacttctggctttcagaactgtcagagaatatgtttctgtttctttcaggccccacactttgttacggagccttaggaaactaatataaatacctagaaagaagaaatatataggagtaaaagtcatgaacggcagcttgcaaccactgatgttacattgaacaaggaactgaataaacaaaaagctttgcagtagggaaataacacagtctggaggaaaatactgagccagtcagtggtaaaagacacatagaattggatcatagagagcagccacgtcacttctctggttaagttctggtgtaaagatacacagattcctgctcttgataatcctgctgctttggaagaagcttttatttcctgcttatccattaagaagtcaggcatgtttggggtttatatttgtttaatcttacaggaaacttcccatcatttcctaaggctgaaacattttgtaaagaattgtaaatagaaaattgcaatataaaacagaaagtagtaaacaagtccagcatgccaatgaactaatggactccaaacaggaacacttggtctggctagaaatttcatgaaaagcttcctggatgaattcattaaattatccctggcatatcttgaaagtggagtgggtacttttcaactgactaataagagatgaaaggacaagaaagaaaaattttcaaaaaagaaaataaaaagaaaactgaaagcagagatgcataaaatcatttgggttatcatcttactatgtaacgggatcgagctatgggcacgtgagggagacacagaagcaaaagatactgaaatgttattgtcagcagattagcatgccctgcctcccacagactttttttggttctatgataagcaacctcttgagacaactgatgtgcctatagttttagatgggctaatacaattccattcctatgagattgcttcaaagttactaactcaagatatatttgagatttttccattttgccccttctgcagatagctgatgtaatttcctgcatttcttcttcccaatcttttgacaaagtaaacatttgaaattctgagtgtcttgaaatatagggaaacaaaggtctctgttctttttttctggaatttgaattaatgccttttatgtaacatcagtgtgaagatgatgaataaagaatactccatagatgagaaatcaaaggagaagaaaagtttaaaaaatatatgtgaaaataatctataaaatagtaatgttctatcagactcccactcactaaaaaaatgaaaaaagtgtggtttctatttagtccctttggttgtaagtaaatgatgtgtctagtctgtgccaaacactgtgctagcttcttagtataaaaaggtaactaaaagcacagcttcactcaaacataaattatgatttagtatgtcttgaaggtatcattttgcctgacagtataagcaaaaagcagaaaatagtgattgattaaccttattttgtagtgatgcaggaatctaataaacccaaattaaggattgaaatgaagataacaaaattgaagtaaccaatatttctggttggagcccacttttattacagcgctaaaaatagtcattgacataagaaaggatagatgaatgccatcttgttattttccagcactgagataggtttagatgagtatgtcggagataggaacattaagaagttggtagccctcgcacatatgatgaataaagatagatcattataaatggcttcaaaactcttttcttcgaaggttcttactgggcttattataaaaggaacaaagattgttagaagatatgctgtcttcactgtctcaaaaacaatactttttgaaaccttctcaagaatatagtgaaatggataaagaacctctctgagaaactcctgttgtcattggattttgaaagttgtcataaaccacctctgtacctaacctaaataatgaatgttgttgtctttgttgtgtttaaaatataagtattgctaccaagtatattacaatattatgctgtatcactaatgtaaaattgtgttttgttaaaacaaagttatgcatttttattgaaaataaatatggaataatataaatgtttagaagctggttagaagaaattattcatctttttcatagaagttcttgttacttcattaaaaaattcatttccttaaacacacacacacacacacacacacacacacacacttccacacactaatcagtttctgtgaacaggtaactttgtagtatcctatttgtatccacatttatatccatgttattagaaattctaataatcttatttaaaggtagaaatttccaagttaaaaattaatattcaagttaatgaaaaaataatttgtttagaatttccacatgaataagacataaaaataataagtataatttataaaagagggaataaaattgcaaagtacagaaaaaatataactgtagtagtcatcaaagaaatgctaatttaaacatggacacaatttttcattcagcaaaattattttgcaaccttttaaaaaataatatgcataataatttttaaaacatgcttaaggaatcaatcaataattataaatatataaataggatattagacatctaaaacaaacttaaaaaaatatataatgtagaaaaaagtactatatactaataagtgaaaggaactgtagaattataaattactatacgtatcatattatgaatatactataattatgttataaatgttaaaagtttaaactagattgaagtaactataccaacatgttcaattagcagtgtttaagttaacggtaggatttttactgtgtgtgcgtgtcgatgtgtgtgtgaatgtttgtgtggaagtcacgtctatcttttttagtaaaagcagttgcttttatcagaacaattcttgtccgaccaaatcaggaaactccaaaattcagctaaaatatgacatatgcaaaaaacaataggtgagaaaatactttccaaaaatactttatgtaagtggaagtgataattgttgtctttgcaatgatcaagaatgagccttaagtgaagtagttgatacgaacttttattttctttcctactttctttttttctatatttcttcctccctgtcaacaggtgtctgcccttttttcacgtctcaaggaattaattcctatctcactcttcttctgtcatcaatacttgccttttgatattaaggccaggtgaattgctgatcactccctgcacttggccgctcctatcttgtcttgcagccacatgaattaggtactagtaatgaaccctcattggagagtctgagcctcagtgattctgaattctgtctccacattatgtatcatttgggcagattttcataagtagggtcatcggctgcccacttcatgcatgctttcacacctccacccctagaatctgatccttacttttctggaatatggttcaggcatagacattttcaaagctcctggggttgtttggaggcccagccagctttactaactcctggcctaatcctaccaatagaatctcattctctttgctacagtgcttgctgcaagcttgggaagctctaagccattcagtgaccagccacagggactggctcaggaaccttctgagccaaagagacaccatgcaagattacctgaggaacttctcagggtgaggatgggagcagaaacttccttttcctttcctgaacatttcagaagtgaccgtcaattcctggaaaccttggccatcttgctccctctgtgaggatgagggttgacctacaagaattacagagagaaggaggcagaattctacatgggccaaggcgggtcacagctctatgtttaattttttagatcatctgaaccaaaatatatgcatttttctggtgttagttcaagtttgatttttctgttaaaacgagtacattccaatgaacacagtttttcttcacacagaggtgtaaaaaattgatatgacataatatgatcctataaccagaggtattttcattttaataaaggttgagtaacttcctactaaataataaaccttttatggtagaattttaagcatcggcaagctgatgaggtaaagagggtactttcctggcatttctgaaatcaattttaactaattgaacacttaacaaaaatatattgaaattgaaggactctgattcgtacctcagtcttagcttttcacttacctcgtgtatgacttcagttaaattacttaatttcagctgggcgcagtggctcacgcctgtaatcctaacactttgggaggctgaggcgggtggatcacaaggtcaggagtttgagaccagcctgatcaacatggtgaaaccctgtctctattaaaaatacaaaaattagccaggtgtggtggcgcattcctgttatcccagcaactcgggagactgaggcaggagagtcacttgcacccgggaggtggaggttgcagtgagccaagatctcaccgttgcactccagcctggcaaccaagtgagattccatctaaaaaaaaaaaaaaattacttaatttctttaggtttccttacttgtaaaagtgtaactatatcataggattctagtgaggataaaatatgaaataatgtgcataaaatttattagtgtgcagtggctggtgaattaataaagatgggacattctattttattataaattgtaccttaccatatgcctatatgctttgttcctcttagtaacatagtagagacctaaaagccctaaaatcaaaaagtaaaggaagaggagaaagaaaaagtttatgttagcattgctgtttgagtctccacagatgtatgttcatcagtgcttgcctattgaccagtcttttatttgatagctggtagacatgtgaacacacgccaattgtgtatagactcatgacaatgctacacctaaatggtctcgcttatccgtgatctttcacctctgaccggacgtttgtatcttttgcccccaacgtggcagctaaaaaggcaaaggagaaatgttttaaagctccaaagcaaagcttggttctctgatgcttgcagacactgtctacatacctagctccatcgactgcatctgtgaccttgtctgtctctcctcctggtatgaaatgattatatgtaggcagagactttccaaacctgccaacactttggataattgttaaaacaggtttaatgtgtaggtgaaatccaaaccaaaagttaggacacagaaaagtgattcagggaggtgcatttatactatttcatttgatattaatgaagttttaaaaactgagattatgtcctagagtaacatatgtttgctctcagaaaaatcactagataagataagggactatttaggagtaagttcctgagacatctggaattttctatcagtgataccgttccctatcagttaaaggtaggctacagttttaaaatggacaaaattctgtgtatgagttttgagtaatagatactgtggctgtattcttaaaacacagaatgctccagtaataggtcagagtatttgaagttttgaaacatcctagtgaagtttgaactacacattgctgaagttaggactgctgtcttctacgtggcacagctgaatttggtagatgattccaatgattaattttaatattaaagttttacattttaaataaaacatgatcctgaaactagaatatcacatcttcaaatatttataaaacgctgtgtcctaagtcctagcaattattgtaagacacataacattgcctgaaattatttagatggacacagtgaatgtttacgtaaccttttaataggaaactcgagttttgtgttctcttcaatacaagctaagacacatttctaactaagttgatatttaaaatacataccacctaagtgaacactttgtaagttcaaatttggtattattgtgaaaacttaaaaacatcaaatatacctttgaaagtttcaagtgaatattgactcctaaatgagtatgaaacagatcagacaattccaaatctctatttaattcaacatttatttatactactaacatcatgggagaaaaatgagtggttctgtttttcgttttgttttgtttttttaacaaggtcttgctctgtggctcaggctggagtgcagttgtgggatcacaggtgagtgtagtctcaacctcccaggctcaaatcatcttcccacctcagcctcccgagtagcagggaccacaggtgtgagccactgtgcctggctggttccagatcattttaaagaaattaagatgtatttatttgttttattggcaattcttagttttatttaggaattgattctcaaagtaaaggtgctagcaggatatggaaaatgaaatatgggaagaaaaacttaaacctatttttaaaatttttatctacaaatagaaataaattaggaaataattcggctttgttcatatttaatatatggatagacactggtgtttccacttccatatgtcacatgatcatattttatgtgtggtgccaaggtttcccagggagaagatgggttgactacacacctattgtatttgtcttctacgtcttctaaaatgaaaggtggctaaagaagattcttaaaaaaagtctcagaaccagtcttacaataaaaatgcaaacaaaatcaacaagaaaatgacagggttgttatttatactcccaatacaaactctttctttgtcacatcatgaggtaaaaatcaatgatgatttacaagagattgatcagagataaaaaaattacctagaaagcaatttgaaatgtgaattcatccactattgttattaaatctgactttgtatgtgtattattgatgattagctagtgttcgttttagaatggaaacaatgtgtagaaatagaagcattatttttcaaaacacacattttgggagaatgtaaactcaaaattgtatcgttagcattgcacaatctaaaatattcggagatgagtaatgtagcgccaaagtatattaaaatgatttcacctggtggctaaaataacaccaaaaacaatttatagacattttataatttatcaatttctttttaaatatattatatattaaattacataaaagctttacaaggttgatgctgttttccccactatataaatgcaataatcaagattttgaaagattacaacttgtccatgggcgtaattaataaatagaacagcataatctgattgctgatcttttgattttaaattctatatttttctagcttccagttttagttgcacacaatctacttagctaaaactgaatttggttaattgtcaaccaagactccaaaacatctttgttatctgatgttcttcatttttactttttaaaaataattgaaatgtcactattatattgacagtaaattcaccagttgttcgatgagattaaccttcttaaaggatgatcaaagcatgcagtgaagggaacctgacggggtttgactgctcagtttatcactgaacagggcacaggtaggctgagtgataacaccactcgtctctgatcagggactcatttgtgccatctggattagcaaagatttcccttccatttctctgctccctgcctcccacaggctatgactatgcttcttgtggtttcatcgcttgctgctgagcggtgttaataactacttgacatttggtttcccaatgatgttcacccaatttttctctaatatacagattctctgcaacacttctcacagtaattccagtgctgtagatatttcttggacatttatacaaaacatttaacttgtttccctgtaatagatagtgtaagttaaggttcacaaagaggaacataatttgcaaattttaaaattgtcctccctttactttaagtaggtaaaaataaagatgcaattgaccctgtcgatattgacttcatagagacatggatattaatatgtaaaacaataatctaaaatgagttttgaaaagaggtataatataaatccttaactaattaaccttgactatcataagtgcattcacatttcacttgcttatagtccatgacatggaaaactactcaatcaatagttattatacagaaacatctgaatcaggcataaagaatttggctaacatcaatcctttatgttagtgaaaactgtaaaaaatttgtataccaccgagaaaacatttaaggttttattaagaaggttttattaagaagtgaactatttttaggtaaactgtgaatccttgggaagaaaatgttatctttctcttttggagtggaggtgtcaaaatttacaaattagggtcaatagtagactagagtttgcttcacagtgaccaagctgaagttttctttatttttccctccctcccctcctcttccctcatctcccttcccctcccctcccctcccctcccctcccctcccttcccctcccctcgcctcctctccgctcctttcccctcccccctcccttcccctcccccctcccctcccctcccctcccctcccttcccctcccctcgcctcctctccgctcccttcccctcccccctcccttcccctcccccctcccttcccctcccccttcccttcccctcccctcccctcccttcccctcccctcccctcccttcccctcccctcccccttttccttccttccttccttccttccttctctgtgtgtgtgtgtgtgtgtgtgtgtgtgtgtgtgtgtgtgtgtgtctctgcctgtctttctgtctttttttcaaggagttgaagtttcccaggcagttggtttataggggggactctctggttcatgggcaatcgaatttcttacaacatagtctatgtgctgaggtggggaaagcatgggagatttggaatcagacagagcaaatgagctcattttaatccctaactaactttgtcacttgggagaattatctgctttatctgagtcttagttccttcctctctaaaatgagaacaatgataacttctctctctctctctttttaacttttgatgtttcattgattgtacataaaacctccataataagagctgagttcagtccaattgttggtgaccgtgcaaagctagacagtggtaaattcatcagggtacatgccacttagtcacactaagtctttgcaatagaaacttctgcagagaccagtctacctttttttgttgtctttagagcaatttaccaaatcattaagaactttgcttttcttaacacttgccatcttcatactcagccagaatgttcttttcaaacaaaaatgtgattttgccactccctgttaaaaacccctgaatgacttcctgtcattcctgagacaacagcccaaatcctgaatacaacttctagggccttccttgtctgacctcatccgacccctacagaaacagagccatgatccataaacgttctactgttcacctccctgactgtggaaagtgattgtccttcagtcttgacttgacccagtgcatttctttaaatctatatgtaataatcagaatataggagctgagcacagtggctcaggcctgtaataccaggactttgtgaggctgaggtggaaggatcacctgaggccaatagtttgagaccagcctggcaacctagggagaccctgcctctacaaaaacaaaacaaaggaacaaacacaaattccccccaaaacaggtgatgagaacgtccctctggagcaaacagaacaacctcaataagaagagcaagtattgctaagagtcacctaaaagcaactgcaaaatgaatgtgaacttaaagtaaaagcaaataaggtagacagggacatttctgttgttaccacctttttctaaagaataaaaatgtttttaaattattctttctgcctttttacaaactaacaaaatttgatcttcctggggagtgggaaggagggatgactcatactgctgaaactcacgtgagatcaatttgtgtgctctaagatcaatttaataatttacactggaaatatctcttcaaagtaggtgtccccactgggacattaaattagcattggaaggcttgcttggcgaatattgaggctgacttaggcaggtgctgagaggcagataagccttctgaacgtaacaggttgcctgtaggggcaacttctccttagtgttttgaagacatattatgatttttctcctccccacaatccttgtttgcaaagatatgagcttattttccaactcattcttacctccatgttgacctcaggaaaaaactgaatgcttcagggagagagctttcaacagacgctcatcttttcttaaggcttgtgacttctaatcacaagcctccaactaagcaaaatatgcttacatacacagatactgcctaaatggggagattatatttagatatatttgagcgcatagagttgatatgacaagattctcaaactaagtaattttcaagtttactagaattttgctgcttaaagttcctgttaatacaagaaaggaccagaagatatctcatttgagccttggaattctaactttgtgttaaaaattattgttatcttacctggagaaagacatctctaaatgctttgtaaatgttacatctgcttaagtagaagtataaaaatagttgtctccaaaaatttaaatttgtattaaattttctcttatgtcttaaaattagaaaatcgattcctatgcacttaaacaagtgataaagaatttgtgttttgggccaggagcagtggcccacacccataattccaggattttgggaggcctaggtggaggattgcttaagaccagcctgggcaacatagggaccccgtctctactaaaaattaaaaaattagccagtcctggtggtgtttgcctgtgttcccagctactctagaggctgaggtgggaggattgcttggacctgggaggccgaggctacagtgagctgtgactgagccactgcactccagcctgggtgacagaatgagatcctgcctcaaaaaaaaaaaaaaaaaaaaatttgtgttttcttggtttgacctttggagtgtacaagaaggcttggaagttatagaaaagttaattgtttttggtgatttcagaatatgtacagcaggtcttcaagtctttgataggttcttagaaactgtgactttaagtgaaaggctgtatagcaggccctcagataatgttgtttgattagacgttgttttattataacgttgatgagaaaaaaaagtgttttattttatgccattttacttaagtcccagtttccaaaaaccttaaggacttactctatttgaaaaatgaaatgaatattattaatattaatatttgttgactgaataaagctgtgtaatagcccaataggctaaatgtttaaaatcaggaaattacaattactactgtattttacagaactgtaggtcacttaattacttttgtaatctgcctataagtgtaaaggcaaagggtagagtaaaattagtaatttttttttttttttttttttttttttttgagacagaatctagctttgttgcccaggctggagtgtagtggtgcactctcggctcactgcaacctctgcctcccaggttcaagcgattctcctgcctcagcctctggagtagctgggattattggtgcgcaccaccaccctggctaatttttgtatttttagtagagatggggttttatcatgttggccaggctcgtctggaactcctgacctcaagtggtctgcccgccttggcttcccaaagtgctgggatgacaggcatgagccaccgcgccctggcagatgaatacatcttatgccatatgcctgaccactccctcagacaaatgagaaccaatgtaatggctgaagaaatggctgcttttttccattgaccttggtgcatagtttctctcctctccttacacaaaaagtaaatttaaatgaacaaagttaagaaggcatattttatgtttataaagctttgattcatggtacaaaatacaagttttcttggagaaacagaagctatttaaaatgtagaatgcagagagttgcattgagccacattccttcttttatctatctcatgggaattaacagacaatgaaaatattgactgtgtttatgcttaattttccctcacccttaatacatttttctgttatgattaattactttcctgtaaaattttgaatgaaattatttaaagagtgctatagataagtgtgtttttactaattttcattattcaccattgtggtataaaatcaacaggtacaagtcaaattaagccctgctgtctgcatgggtactcattattaaatatgagcgatttgggccttcagcaaacgaccatttatattccaaatcgtatttaaaattaatttactcttttatcagaacaaagaaaatttcacacacacaatctcttttactaaaaaataaattttatcataggaaattatctcattttatattccagagcagaaacatacaaaggtgagatgaatctttgtacaatatgtctttctgtcaaacattctaaaacattgtcaatttcattttttctagtattttcaatatttattttgtgtttggcaataaacggagctaatacgaccacttttctcttatgcttggttattattattttaagaaatgaaaacttataaatcatatagcttggaagattgctggcagaataagaaaaaataattttatcttttgtatacatgaaaagtttaaaatatcaaactataataattagtaattacatatgtaacctaggttacatgtatgtatgaggtatggctcacacccatcatcccaggattttgggaggccaaagttggaagattgcttgagaccaggagtccaagaccagcctgaacaatgtagggcaacacatccccaggcctgggtaattttttatggctccatttaaagaagcagcatgacaatgaaccttagatgtcatccagttgagttctcctacttgagcatgaatcccgtcttaaccctcagtttagcaaaccctatcagttatggagagcagataaatctcagcctacttaaacatgaagacagaactcagaaacagttcttcaaggcgctgccccttgttaagctggttctttaagaagcttatccgccaattcacaattctgaagcacagcaaagctgtttctgtattggtgttaattatttattaatgcagtgaaaacactttaaattcctattaaattgtcactaattacttgtgaactaaaacgtaagatgtttagttttttgcttccttctgagaaaatatatttgtatcgccatctttgaagtcagttctactgtaaagagcgtgtatttgggaatcagaaaaaactagatcgaaactgtttgtgttttattgggcaagctacttaaacactttgaacatcatcaggtttttaatttatgatgtaagaagttcagacgaatgaactgagtttatttgcctgcttaaattaaaacatatagaatccctatgtttcccccagtctactcaaatgttttcattgcagtatcaatgccaagaatattgtcactgcatagcaaagcattggagtgaagtagctgatatgtattggatgacttagtttcaaaagctgtttttcctataataccgtaattccttcctcaaacggaggcaacagaaattgcagtagagttcccttgccaactacaaaatgttccatttcattctgcttttctccatttcctagaatcagttacatcaatttgaatctaactagactaagataaaacatgatgaatatgtttgtgaaataaaaacttgacaataaatccttaagatttttctaagaaagaagtttatgaaacttcagagaataggagaatatttcctaataaaaaatagaaagcatgtaagaatatcttctgtcttttaatacaacaaaccaggggcctgcaaactgtatctcatgggccaaattcagctaggtgcttttttgcgtagcccttgagctaaaaatgatttttaaatttataaatgattgaaagaataaaaggataataatatttcatggtgcatgactatatgaagttcacgtctcagtgcctataaactttattggaacacagccatccccatttgtttatgtgttgtctatgttactttgagagaggtgagtggcagccacagaaaccatatgtgtccaataaagcctaaaatatttgctacttagaccttcacagaaacaatttgctgccccatgttcaataaacagctgaaggcagggatggtatcaaatctcaacacctgcttaagtacttgacacatagatctgcacagaatgagtaacagcagaaagaatagatttaaaaaattaaaattattttctcattataaaaaggaccaaatatctataatttttaaaaagccaatagacttacacataagatctgtaatgtaaaactactagaaaaaacacaggtgaatatctatgaggtataagtctgggcaatgattattttggatttgaccccaaaagcataaacaataacagcaaagatagacaaatgagattacatcaaaataaaaatgtcgtgcacataaaaggaaacaatggaatgaagagacagccctatggattgggaaagaatatatttgcaagccacatgtctgataaggggttgatatcccaaatatataagaaactcaaacaaatatatagaaagaatacaaataatttgattagaaaatgggcaaaggagctgagtagacatttttcaaaagaagacacaaaatgaccaaaaggtatatgaaaaaatgctgagcatcattaattatcagagaatgaaaatcaaaaccacagtggataccacctcactcttgttaaaatgactgttgttcccctccctttgtgcatgtgttctcactgttcatcttccacttataagtgagaacatgagatgtttgattccctgttcctgcattagtttgttgaggataatggcttccagctccgtccatgtccctgcaaaggacatgatcttgttccttttgataggtgcagcaaactaccatggcgtatttacctatgtaacaaaactgcccattagcacagaacttagaataaaaattttaaaaaatgagtgttatcaaaaagaaacaagagaacaagtgttggtgagaatgtggagaaaaggaactcttaacacactgttgatgggaatgtaaattagtacaagcgtaatagcaaacaatatggaggttcctcagatattaaaaatagaactgccatatgattgagcaatcccattactgggtatactgggaactgaaatcaacatgttggagagatgtctgcactcccatggttagtgcagcactattcagctttacaaaagaaatgttgtcatttgtgacaacagtgaaattggaaaacgttttgctaagtaatataaattaggaacagaaagtcaaatacgttatactctcacgtatatgtggaatctaaaacagtcaaattgaaagaagcagagagtagaatagtggttatccgagacgctgggagagaggggaatgaggagttaatggtcaagggtacaaagctttaattacacaagagaaatacattattctttgggatatattgtaaagcatggtgaatataggaaataacatattgttatttcaaatgttctcaccacaaaatatggtatttaagatgatgaacatattaattagcttgatttaattattcaatattgtattcacgaactataacaccagtttgtgtcacataaatatatacagctataatttatcaatttacaattaaaaaataaatgaaataaaattggatttaaatgaaacagtgaaaagtcttcatatagatgacaagcacaataacttcattttaaaatttataataccatgaacataggaattcccaggagaaaatttaggtttatgagactatatccattgaaaactctgttggacattttttctgaagttgttcagttttagacctgaaacaattatcttttatcatttaataaaaatggattagaaaatcgctctgtataattaatagtttgacctagtcttctatgatggtttattgattgtttcaactccagagctggctagcaacatgaaactctcatggaaaacctgtttataatgaaggatgcttctgaaacaatatacactattatatcttgattgatagttaacatttagtaactaagtacactagtacatttgacttacaggccatcattttcccttaggagacagtaactttgagtctatcccattcatctcctctagaactttgtcaaacagaggtatatatggcttttgatgctctcctttcatttcacgttgttctttcatgtttgatttgcttaatgctcattgggtttctttttaattcctctaaattatctaatttgaaaaaataactattattaatatactctcaaaaactgtagaaaaaataatttctaaataatttaaaaggtaaaaaatatcaacatggagaccttccataatgtaaaagtggttctttttttaataaagccttttctctactcatttaaaaaagtggagttggaggggctgcctttcaaaatttccacataaaagcaaccaaaaatttgttctaggaggagcactgatggcagtttctgaaaagatttccgtgacaccttagataagagtgaaaaaatcaaccccataaggaatttgtcttcattcactccatactttctggactgggctttcccttctggctagtgattagagctgacagacaattcgacagaatcacaaagtggagaagttctttttaaatacaagttaatggttttgtaaatttagtgccttaagcaaaattgaattaaacattcagtcattcatcttaagcatccttaaaaattgaaagcttcacaatatgcccagaacccagaaattcaagtaacttttacccagagcctacccagccggactgcgcaaaggactgatgagacgaaaggatatttggacgctgccctctaggaaaggtagcctagaagaggagaggacactaacagactaacgactccttcagaggggaggaccacataatcagccaatgtcagctggcccagatccaaacagctttctgcttatgcaaaccttgtgtggtcgttgtgttaactaatgcaaagatatatgattaatgtacttgtcagtgtcctgtgtttagttttctcacaaaacatttcttatataattgagataattactttcacttacaatgccattggtttaagttttaattgataatgatgactttacttttcagtttaccactatagacttttatttttagagtaccattcagagtcagagcctgaaccttagagaattaaactcacttaagattgaagtagtagtcatttcatactttgtgtatttatccatgttttgagctaattccagaatgttgtcagtcatattgggatgcgatatagtaatttggtttttaagtatgattttggaactctaagttactaaaatagtagcttaatttttgttcaccaaaagaatttataactgaaacttccattagagattatatgctttttatttactacttttagccattaaccaattaattataaaatatagagattttatgttttcatctacatatacaaaattaccattaagatgaaagtaattgaattgattgcatattcagttatagaattccaaatttaagtagacacagaaagtcataagtttacatctaaaaattcacgaggtagtcagtcatagtcactacattttagccaactatggaacgtgtactatcatgtactatgagtcagtccctgtactgaagatatcaaaatgaatttgacaatctggtataaaatccaggactattatttgtactgccagcctcagggagagatgaataaaatggatttgtaagttagaggctgcaaaaactgttttttttggtttgttttgctttttgtttgtttgttttcctgcaaaagcatgtattcagggtacaggtggtggttctacccttccagttttctaggctggctgatctttataacttgttgttcataaagatgtatgtaaataagcaccatgtctcaaatttagattgagaattgttctcccagagtattcaaatttttaagagataaaacaattaaaatctaaaatatgtgataatctaaatacatattatacccccattcacccattaaaatattttttcttgctaataaaagaaaaaatcgtttttatggattttcctatccctcaaaaataaggacaataacattttgcctatttttaaaagatattggttagatgaatcttgtagatctagctcaattgttcccattctagaaagcttagaattattatcctgaaagcagaaataattgttaaaaatgaaaacatgaaaactttacataaatgacttcattttcacctcgtaaactttattgcacagcaccgcactccagcctgggcgacagagtgagactccatctcaaaaaaaaaaaaacaaagaaaagaaaaaaagaaaaattttattgatttagaatgcttgacagagcaaagtgaagctgtcctcacagggttagtaagtattctggacagaaacatagttataattaagcattagtcaggctgtattttgacctacttccttacaaccaaagtcacatagcactagatactgaccatttgcatcccattgcttgtatagataggattctgatgtaggatagataggatctctgatgttggaatcacaaggctttttaggaattgcttaagcagatcctaaattccagcagaacagcggaccccagccagtttgaagacactcacagaggaactgagtcacctgagaatagtttctttatctccccattccatgacctcaccctgcactcttcaaccaattcatgatctccacactttgggctacttcagagcctgtgaaaaccctagtcccagactccccaaggtgatgtgtgtgaggttttctcctgtctcctcctttggctgccctgcaatgaaacccctttctttgctgcaaactggtgtctccatgtattgacttgttgagcatcaggcaacagacatatggttacaaaagcagaattttctcttgagtatttagagagctcctaggctgttctgattccaggcagcagacttcaggaggtagcatttctaattttctatcatgatgttaagggaaatatgctgcctgataagtgtttggatattggatattgcatggttgtcccatgtcccagtaaaacacacatttttgctttgtcctggtaattaacaatacaaacaatataaattaatttggccacgtattttagtataaataacacagttacaaataatggtctgtttgtcatcctgtcacctaaatctaaaataccgagatccagatgaaatgaaagagtgcacattttaagttgcataaattatatatatgtatgaagacttaaagttcagattttcagaaaactaaaaagttcttaatcatttttagaaagtagatcagcaaagtactgagttattttgtataaagattaaagcaggtattatctgtgtgtgtgtgtgtgtgtgtttctgtgtgtgtgtttgtgttgttctaatattaatagaaacaatagaaacaatatttctttaatattacttttcaagaagatagtaaaagccaagaagtaaaagtgttttaattcttgagctgttaattcaatttttttcttgaatgattgaatattatttccatcatttgttcattgtaacatttcccaatacttatagatgatatatagaaaaacaatttaaattgaaaatcattaatttcccagtgcatttcctaatatatctatattcagatctgtatgttttcttgttccataaagaaaaagataccttcgtttttttcaaattaatatcaagagcattaagttttattgaactaataatcttcagtgttgtctatggatttaaattccattttattgccattttgggagactaaagacagaaagagaaaaggaagaaatatagatgggtgatcaaagtaggtaaaaccataaagatgtgtgaaataaaagtgaaatagaagaaagagatagccaaatgaggaaaacaaatcacagaagagaataaaggcatgtaaagcatacaaaactagaaaaagtgcaggaaagagaaagaaataggtagataatatagaaaaagttttgaaagtttcagtaaatatgataaggattccatgtaggtaataactatcagagagttataaatttatatgtacttctttgaaatgtatagtaattggcattaatagcttttaggttattccaatgtttatttgtagtgctatactcataagcataccttctataaataagcacattctttatgctagaaagataatgaaagctctatctggtaacttgttttccatgttgaatgctacaaacacactctctaaacgtgttaatgtgaatgtgtgtacccttgcatacacagacacacacgtaaataaaaaaaactttattatatgaactgctagcacaaatatgtgtattttgtttgaagaaatactctggtaagtttcttgacacttactataaaacgtgagatgctgtgagcatgaaagaaagtggtcattaacatacccaaaggaagagatgatccttctatgctataaggaaaggaaactattggttttcttacagaaaacaggaggtagaatcaaagaataaggcaagggaggacaagagaaaaagacagtctgggactttgtgaagagccactatttgcaagttgaatgtggttttttgctttgttttgttttgtttttcttgctattattgagttattgttctgtgtttcttcacgagtcttcaaaaagtctatactgttcacagtgcttggagtgacagggttttcctgcagaaggctacacattcaagcataaaaaaagaatgtacagcagcttagctcaagaaacagaagatattactagtaaatacatcacccccacagctttaataactgcccaccccctgcaaaaccttaggaaaagtttggaaaggatttgacatctataatctgtaaagttgcagtaacagcagagtctcaaggcaattttgcctaaatttctgagaagctgagggtcatgaggttgcaaagccttctgtccagatgtggggctatcaggggatttggagtttagctttgtttggttgttccctatctcatcaatttacttttcacaaaatctgcctctgaacgttcgatccactgtgaatatgtttgaagcatgtttttgaatgcatgttcaacactggagaaagtagattacagttctgctcttggacagctctggtccagcactgcaggtggtgaatgtaagagtgatagtgatgtgatctcttagagaagaatgatgtgttaattaatttgaggaatggaagagcatgcccttgacagtcactgtgacttgagtttgcgtgctagcacctccatttgagctcagatttatttaccttgtaattcctgtagaatatagatgatatgctgtacttcaaaatttcattgtgaatattaaaagaaataatacggccaggtgtggtggatcacgcctgttatcccagcactttgggacacccaggtgggatcacttgaagtcaggagctcgagaccagcctggccaagatggtgaaaccccatctctactaaaaatacaaaattagccaggtgtggtggcatgtgcctgtaatcccagctacttgggagggtgagccaggagaattgcttgaacccaggaggtggaggttgcagtgagccgagatcatgccactgcactccagcctgggcaacacgagcaaaactccatctaaaaaaataaaaataaaataagatagaaataatacacacagtgttcttagcaaattccttggtgcacaattatatggtagttattattatcaaaattataaagcagaaaaaagtctcaaagccaatgattatttatttatttattttagagttggagtcacggagtgcagtgtcacgatcatagctcacagcagcctagaacccctgggctcaagtaatcctcccatttcagcctctgaatacctaggactaaaggcatgggccaccatgcagctaattttttagttattttattttattttattttattttgtagatacagggtctcactttgttgtccaggatggtcaccaacactggcctcaagcagtcctcctgcctcagttttccaaaatgcagggataacaagcatgagccactgcaccaggcctgggaacttacagcctagtatattccgcaattatggagggggtacgacttatgtgaaaccttcaggaatgcatacccttttagagagaaataagtcttaagttagagatgagaaaaagcatgggaggctaccttctgaatattgaaggtaggtgtaagattataatggtagagaataagttcagatatgaagaataggcctaggttatggcagaccttgaacttcagagaaattttagctaaatatgaaggttagaaagagccattatacatttcagaccatggaagtaatataagctggtcgtttagaaaatttcatcaattgcgttatgcaagagtaactgaagttcaaagagatggtttttgagaaggtgactggaaggatttgcagttatcaagaaatgaggtgaagaggacttggagtaattttggctgagaaaaataaacctttacatacagctctaagtctataagaacaaagaatatataacaatccacatgtagagtataaaataataagaatgctatcagtaaaacaatagtgaaaaagaagcatcacatttagtccataaattaaatcgtgtccttaacttagtataaaaagatctaaggattatggtataaatattgcacactttttatgtggtggacatgaaagcaatttctgtgagtttaaccaatggaaaattggtactcttggataaatgattggccctatacttgaaccattaaaagagagaacattaaactaagtagacataattttgagagttccactacattaaaattgaagaacagcttactaaaaacagccagacttaagggtaccatattgtataaaaatgttatattttccatattataaatggtttggctgatagatacttaagaggaaaaatatagccagagtcttttaggttggccatatagtttcaagttttcaagttatcgaaaatcaacccatttatttatttaaaactcatactcacctgcttggagacataatttggaaatttataagttgtatatacaacttcataaaatctgaagaaataaatcaaaataggcattattgaaaagcagcaacataaatgtatgtcattgggattctacaatgggtttgctgtaattatatcgtacattgatgttaactctcagtttcctgacagctaaaacaaagagaaaaaaatattataggtattaaaatgtttatacaaatcatttaaatctgcagagacatgcatgcttgtatttaagtgctgagggtggactgttcaacataacagatgattagctttcacctgaattttacaaacatgctatttaaggcaacaaatacattaattctatatagaagttaagagaccatacttcagtggagggatttccttaagagaccagcagacccaacattccaggtcaacagaatcaaagcaaatgctgtttataataatacaatttagggatagttgtggtaaattttaatgacatttccaaaaccaattggagcctatgcaccttaatttgaaacattgtgaaatggactcaggattaatttgagaatagaagaaaagaagactattccataatttcttttacagaaaattatttatcttctttccatttaagaagacatacatggtgaccgggcacagtgactcacgcctgtaatcccagcactttggaaggctgagacgggcagatcacaaggtcaggagatcgagaccatcatggctaacatggtgaaaccccatctctactaaaaatacaaaaaaaattagccaagtgtgacggcagatacctgcagtcccagctgctagggagggtgaggcaggagaatggtgtgaacccgggaggcggagcttgtagtgagcccaaattgtgccactgcactccagcctgggtgacagagtgagactctgtctcaacaataacaacaacaacaacaacaacaacaaaaagatatacatggtatcatttcaagaccactgcctacctataatgtccaaagttgcatgaatgatctccaaataaatgcacatgtacattcacagtggtgcaaggaattttctggaaggagcaaacataaacacgggagggacagcctgtgtgctgggtgtggaagtaaccaaagaaattgttgtggtattgtgaaggaggttgatggtaaacctcttgtcaactaatgaaagaggaatgattatggctaagttgtaagttccacctccctcctcatttccaaaaatttcctgttcaagctacctcgtaggacttggaaaaggtacaactcttcttccactctttctgaaaaattaatgggagtctgttttccacaaggatagaagaatattatcctgagtagtttgtcagtggttgtagtggataatttttagtgtacagcaaaaatataatgacatagtgataggacaaatattttctgcaaagcaaaaagaaagtaaggcatcatatacaatttgttgctacatgacaaaatgaaagatttaaaaatttaaaatttatgcaccccttttcagtcccatataatagaagtttgttttgttattatttacagatgatttaaaaatatttagacaatcgcaacttctgtatccatcaatttggtaaggtaatattaaatgacacaacttgtcaactaagttagtcaaaatggtttatatatgtgatctttcattcacttagtcaaaaatcttaagtgcctattgtatggcagaaatattaacagctgacacatatagtatctattctatttcagagatagtattaaatgcctgatgtatattaacacatttaatcctgacaaagattcttcaagatttatggaaggaaaaaactgaagcaaaaaagctaagtaatttgcacaatattgcgtatctaaaacgtgttggagttgagatatgaaaagacagttcaacgttagaggccgaactcttaaacagcacggcatatggcctcttgagtcccgagtgataagctcagaataaaatgtgggtcaaaccatacaattccagccataaaagtgatgaatgtagagctcttaccatcaccatcatcatcttattattactatgttattactttgctcttacagacatgtgctatacttctgttactagaaattcatctctggagacatatttgttattcaaacaggtgaaaaagttatccccataaaaatatgacctttgtaataaatgtattattcaacaagagttaccagttttctgtagtatagcagacacagcttttggctggtagaaacaggtaagtacatgattaaatctaaagtaataggtactaaagtaatggtattgagattcagagatgggagaaactaggtacacctttgtgtgcatgtgtgtgtgtgtgtgtgtgtgtgtgtgtgtgtgtgcgcatgcatacatgaacacgtgtcatgggagacatgggtagggattcacaaagggattgagaaaatcaaaagtgatggggaaacaagagaaaagaacactataggaaatgacacttaggcatagcttttaaatctgttttcaaacatgaacaaaaattgagagaatgacataataaacactcatgtacctctcatttgcctcaattataagcaatttgccagtctcaaatcatgtaccctcctcagtttttaaaccttattttaaagtaaatacaaaacagaagttttttttttaattattgtagtaagcatacaacatgaaatctacccttttaaaattttaagttcacaatacattgatgctagctataggtagaatgttgtacagcagttctgttgaacttattcctgttgcataactgaactttatactggagcaggtttttcagtttccatgtagttgagcagttttgagtgagtttcttaatcctgagttctagtttgattgcactgtggtctgagagacagtttgttataatttctgttcttttacatttgcttaggagtgctttacttccaactatgtggtcaattttggaataagtgtgttgtggtgctgagaagaatgtataatcttgatttggggtgaagagttctgtaaatgtctattaggtctgcttggtgcagagctgagttcaattcctggatatcctttttaactttctgtctcgttgatctgtctaatgttgacagtggggtgttaaagtctcccattattattgtgtgagagtctaagtctctttgtaggtctctaaggacttcctttatgaatctgggtgctcctatattgggtgcatatatatttaggatagttagctcttcttgttgaattgatccctttaccattatgtaatggtcttctttgtctctttcgatctttgttggtttaaagtctgttttatcagagactaggattgcaaaccctgctttttttttttttttccatttgcttggtagatcttcctctgtcccttttttttgagcctatgtgtgtctctgcatgtgagatgggtctcctgaatacaacacactgatgggtcttgactctttatccagttttccagtctgcatcttttaattggagcacttaggcaatttacagttaaggttaatattgttatgtgtgaatttgatcctgtcattgtgatgttagctggctcttttgctcgttagttgatgcaatttcttcctagcattgatggtctttacaatttggcatgtcattgcagtggctggtaccggttgttcctttccatgtttagtgcttccttcaggagctcttgtaaggcaggcctggtggtgacaaaatctctcagtgtttgtttgtctgtaaaggattttatttctccttcactcatgaagcttagttcggctggatatgaaattctgggttggaaactcttttctttaagaatgttgaatattggcccccactctctgctggcttgtagaatttctgtcaagagatctgctgttagtctcatgggcttccctttgtgggtaacctgacctttctctctggctgcccttaacatttttttccttcatttcaactttggtgaatctgacaattatgtgtcttggagttgctcttctcgaggagtatctttgtggaattctctgtatttcctaaatttgaatgttggcctgccttgctattttggggaagttcccctggataatatcctgcagtgttttccaacttggttccattctccccctcactttcaggtacaccaatcagatgtagatttggtcttttcacatacttccatatttcttggaggctttgttcatttctttttactctttttttctctaaacttctcttctcacttcatttcattcatttgatcttcaatcacagacaccttttcttccacttgatcaaataggctactgaagcttgtccatgcatcacgtcgttctcatgccatggtttttagctccatcaggtcatttaaggacttctctacactgtttattctaattagccatttgtctaatcctttttcaaggtttttagcttctttgcgatgggttcgtacatccttctttagctcagagaagtttgttgttgccagtcgtctgaagccttcttctctcaactcgtcaaagtctttctccgtccagttttgttccgttgctggcgaggaactgcatacctttggaggagaagaggcgctctgatttttagaattttcagcttttctgctctggtttctccccatctttgtggttttatctacctttggtctttgatgatggtgacatacagatggggttttggtgtggatgtcctttctgtttcttagctttccttctaacattcaggaccctcagctgcaggtctgttggagtttcctggaggtccactccataccctatttgcctgggtatcaccagtggagtctgcagaacggcaaatattgctgcctgatccttcctctggaagctttgtctcagaggggcaccctacgaggtccataacaaaatggaggcagaaataaagatgttctttgaagccaatgagaacaaagacacaacataccagaatctctgggacacatttaaagcagcgtgtagggggaaatttatagcactaaatgcccacaagagaaagcaggaaagatctaaaattgacatcctaacatcacaattaaaagaactagagaagcaagagcaaacacattcaaaagctagcagaaggcaagaaataactaagatcagagcagaactgaaggagatagagacacaaaatacccttcaaaaaatcaatgaatccaggagctggttttttgaaaaaataaacaaaattgatagaccgctagcaagacaaataaaggagaaaagagagaagaatcaaatagacgcaataaaaaattataaaggcgatatcaccaccaatcccacagaaatacaaactaccatcagagaatactataaacacctctatgcaaataacctagaaaatctaaaagaaatggataaattcctgcacacatacaccctcccaggactaaaccaggaaggagttgaatcactgaatagaccaataacaggttctgaaattgaggcaataattaatagcctaccaaccaaaaacgtccaggaccagatggactcagagctgaattctaccagagggacaaagaggagctggtaccattccttctgaaactattccaatcaatagaaaaagagggaatcctctctaattcattttttgaggccaacatcagcctgataacaaagcctggcagaaacacaacaaaaaaagagaattttagaccaatatccctgatgaacattgatgcaaaaatcctcaataaaatactggcaaactcaatccagcagcacatcaaaaagcttatccaccacgatcaagttggcttcatccctaggatgcaaggctggttcaacatacacaaatcaataaacgtaatccatcatataaatagaaccaaagacaagttggcttcatccctgggattcaaggctggttcaacatacacaaatcaataaatgtaatccagcatataaacagaaccaaagacaaaaaccacatgattatctcagtagatgctgaaaggcctttgacaaaatgcaacatcccttcatgctaaaagctctcaataaactaggtcttgatgtacatatctcaaaataataagagctatttatgacaaacccacagccaatatcatactgaatgggcaaaaactggaagcattccctttgaaaacgggcacaaggcagggatgccctctctcaccactcctattcaacatagtgttggaagttctggccagggcaatcaggcaagagaaagaaataaagggtattcatttaggaaaagaggaagtcaaattgtccctgtttgcagatgacatgattgtatatttagaaaaccccatcgtctcagcccaaaatctccttaagctgataagcaacttcagcagtctcaggatacaaaatcaatgtgcaaaaatcacaagtattcttacacaccaataacagacaaacagagagccaaatcatgagtgaactcccattcacaattgcttcaaaaagaataaaatacctaggaatgcaacttagaagggatgtgaaggacatcttcaaagagaactacaaaccactgctcaatgaaataaaagaggacgcaaacaaatggaagaacattccatgctcatggataggaagaatcaatattgtgaaaattgccatactgcccaaggtaatttatagattcaatgccatccccatcaagctaccagtgactttcttcacagaacttgaaaaaactactttaaagttcatatggaaccaaaaaagagtcagcattgccaagacaatcctaagccaaaagaacaaagctggaggcatcacactacctgacttcaaactatactacaaggctacagtaaccaaaacagcatggtactggtaccaaaacagagatacagaccaatggaacagaatagagccctcagaaatactaccacacatctacaaccatctgatctttgacaaacctgacaataacatgaaatgagtaaaggattccctatttaataaatggtgctgggaaaactcgctagccatatgtagaaagctgaaactggatcccttccttacaccttatacagaaattaattcaagatggattaaagacttaaatgttagacctaaaaccataaaaaccctagaaaacccaggcaataccattcaggccataggcatgggcaaggacttcatgactaaaacaccaaaagaaatgacaacaaaagtcaacattgacaaatgggatctaattaaactaaagagcttctgcacagcaaaagaaactaccatcagagtgaacaggcaacctacagaatgagagaaaatttttacaatctacccatctgacaaagggctaatatccagaatctacaaagaacttaacaaatttacaagaaaaaaatcaaacaaccccatcaaaaagtgggcaaaggatatgaacagacacttctcaaaagaagacatttatgcagccaacagacacatgaaaaaatgctcatcatcactggccatcagagaaatgcaaatcaaaaacacaatgagataccatctcacaccagttagaatggcaatcattaaaaagtcaggaaacaacaggtgctggagaggatgtggagaaatagaaatgcttttacaccattggtgggattgtaaactagttcaaccattgtggaagacagtgtggcgattcctcagggatctagaactagaaataccatttgacccagccatcccattactgcgcatatacccaaaagattataaatcatgctgctatgaagacacatgcacatgtatgtttattgcggcactattcacaatagcaaagacttggaaccaacccaaacgtccatcaatgatagactggattaagaaaatgtggcacatatacaccatggaatactattcagctgtaaaaaatgatgagttcatgtcctcttagggacatggatgaagctggaaaccagcattctgagcaaactattgcaaggacagaaaaccaaacaccacatgttctcactgataggtggtaattgaacaataaaaacacttggacacacggcggggaacatcacataccggggcctgttgtagggtggggagacgggggagggatagcattaggagatatacctaatgtaaatgacaagttagtgggtgcatcacaccaacatggcacatgtgtacatatgtaacaaacctgcatgttgtgcacatgtaccacagaacctaaattataataataataataaagaaagaaagaaactttgtacttactgaacagcaaacaacagactatcttttaaacccattttactctgcttagttttaaatattgagtgcaggtgggagaactagatatgagaagaaccacctttttattattggaaatgaccaagggcattgttttggttaaagtaattttaggatgtttccattgaccattgatatcttacatacatttcctgttttaacttcggagcgagtcattttgaaggattttgctggactttcagaacgtgtgatttgttttaacggtgctctcgggctgccatatgtgtttatgtaggctgtgtcctgaagaaggggtctctgttagggggtatgagtacgctgaaaatgaagcactctccaagcagcacagaggtgcattttctcatctgcagtaaggcatcttagcggccagtggtcctgacagcagcaagtagatctcaaagccatttcacgggccttctcatattcacactaattctaaatcagacttctgttaagaaaggagaaataggtggggcgcggtggctcatgcatgtaatcccagcattttgggaggctgaggcaggtggatcacctaaggtcaggagttcgagaccagcctggacaacatggtgaaaccctgtctttactgaaaatacaaaaattaatcgggcgtgttggcgggcgactgtaatcccagctactcggaggatgaggcaggagactcgcttgaaccctggaggcggaggttgcagtgagccaagatcagcccattgcactccagcctgggtgacccagtgagactctgtcaaagaaaacaaaaaaaagaaagaagaaaggaaaggaaggaaggaaggaaggaaggaaagaaagaaggaaggaagggaaagaggaaatagaatttaacaatttgaacaaaaaaagggggaatagaatttaacaatttgaactaaatacaaataaagtcctttgctgctatcaaaatgcaattgtgacatagagttagtgcaaatatgttattgtgtaatgactgtgcaaattgcttttctgtatgtttgtcttatataatattgacagtactacatagtgtgtcaaaaaactaaacttggtatttttaatgctaaaatgagtaaacactaatcagaatgccagcaggtacaatatctttgaatgaaaataacacattcaaactgctgtttctgttctctttggtacacggtctgcatagttagtatgataaatgcgaatagaattttcatgctgacatttaattaaaatgaaattacctatcattgttacccactacacagaagctattatttatgttgatattattctaatattgtattaagctgatattgaatttgtatcagtgttttttatgaactgaattatttctgattcctcagttgtttttaaaagccaaggagtagatactattgcattgtgcgtggatagagcatattttcctcttatttgaaaagttagaggtggaaatcatgtagttcagtgtaactataattgtactattttcctgtttttttttcttttgtcttctttggctattttgatgccttttaatgcatccccctgttgatgtacagtttaatatctgatataacactaagattaattttttaattgttaatatatctttgactagtctttccctatattattaccattgtgattacttttacttactacgatcaaagtagcaacttgtagtcagatagcagtgatattcacggtctatcaatttatccattcatccatttatccatcctacttttcttcccttcccccatccatccattatgtactgtggatttgcactgaagtcaattggaattaagtattataaaactctattttactaatagccatataaaacccttaagaggcaattcagacattcacaatacttggaattttaacagttacctctattgactattacaatatagcataatctgtaaaatcactctggcaaaaatgtgtatctatgttttagttctaaggaagcaccactcagtacaatgaaacaggaagaaatgctagtgatttacattgttcttgaggaagttaaaaaaaatcaattcattgtgattctgaagctttctctttaggtcagatattgttatattgataacaaagcaatgacaccacacagtttttgtgctccaataaatgtgatttcaaattttacaaataaacatttttcccttttaaaaagtatatacgtctatctgtttagttggacaaatgaagacaaagcaaatttctgtgacccaaatccaagtctgagtactcaagtttgggtttgtacagtttagtttaacttaaaaacaagtgacttgttcatttctacgccacaaatacctaaaacaacaaatattacacatcatttttggttgagaggaatgactaaatcattgtttctagtgattgcttcttatgacaaatcaacattgtttattaaaaatatgagattttatagaggtcaggcatggtggctcagacctgtaattctagcccttgggaagcggaggctggagaatccctcgaagcctggagtttgagaccagcctgggcaacaaagcaagaccttgtctttacaaaaaaaaaaaaaaaaaaaaagaaagaaagacagaaattaggaaagaaagcaaagaaagaaaggaaagagaaagaaaagaagaaaagaaagaaataaagaaagaaaaagattggctgatctgagtgcagtggtgtttacaactaattcatcacaaccagttacagagatttatttgtcccatctctacacctaactccttcatttaactagaaaaatatatatatatattagattttataagaaggaaagtagaacatacaaataatattaagtacttatctattacttgagatataccaactagggaagacagaggaaggacaatcaatataaatcatatttaaacaactactctagtaaattgatcaaagtctggttagtattatctgctttaagtttttctaaggattttcaatgagagaagaccgtatcatttccccacaacccaacctatccagcgtttttctggaagaggctattagcaacacataagctgccagcaatgtaaaatccccttatttgctgccttaacatttgggataaaaagtgttgacaccattattttttaacctcgatctcattgaggaacttcctgaattttctaacatcaatttactgctaaagatctatataataaggagattttgaatgttaggaacctgtgattatgggtgagagttagttgatgagagggtgagagttagttgatgagaggattcgaagctctaacatctcggaataactggtaacacatatctttgcaacatagcttcatttcactgttaggctttggtgtgttggcgattttttatgtgtgtaattaacatattttattgacaatatttatgtatatctgtaattacatatatctgtacaatgtgacatttaatctatgtaggcattatagaaagtttcagtcaagtgaattaacatgcccttcacctcaccaatttatcacttttctgtggtgagaacattaaaactttttaaaaacaaatctgaaatatacattattattatctgtggtcaacatacaatgcattacatcactaaagttcattccttcagtctaactaattctttgtacctctgattaacatcttctcttccctccactcctagtttctggtatccacatttctattccttgtttctgaaatagaccactttagagtccatatataagtgagatcataccgtatttgtctttctgtgtttagcttatttcatttagcatattgttctacagtttcatccatgttattgcaaatgataaaatttccttcttttttaagggtatatagtattccatagtgtatatatactgcattttctgtatgcattcatctgttcctggatacttatattgctttcatatcttggctattgtgaataatctaaaagaaatctgggaatgccgatatctccttgacatacagatttcactacctttggaatatatccagaagtgggattgctgaatcacatagtaattctatttttagatttacgagttactcccatgctattttccaaaataggtgtactaatatactttcccatcaacaatgtacaagggttaccttttctccacatccttgccaatacttgttggcatcagtcgttttgataatagccattctaatgggcatgtggtgatatcccactgtggctttaatttgcatttctctgatgattggagatgtggagcagtttttcatatatctattggccattcatatctcttcttttgagaaatgtctgttcagattctttgcacattttataattgggttgttttcttgtcatgagttaaattcctcatatgacgtggatataaacccctcatcaggtgtatagtttgcgaatattttctttaaatctggtttctctcttcatcgagttgtttcctttgctatgcagaagctgtttagtttgaggcaattccgtttgtctatttttgcttttgctgcctgtgcctttggagttccatctaaaaaataattacccagaccaaagctgtggagatcttcccctgttttcttatagtatctttgtagttttaggtcttatatttaagtcctttatcaattttaaattgatatttgggcctggcacggtggctcacagctgtaatcccagcattgtgggaggcagaggcgggcagatcacctgaggtcaggactttgagaccagcctggccaacatgctgaaactccgtctctactaagaacacaaaaattagccaggtgtggtagcacatacctgtagtcccagttactcaggaggctgaggcaggggaatctcttgaacccgtgaagcggaggttgcagtgaactaagatggcaccactgcactccggtctgtatgaaagaaagagactccatctcaaaaaattatatatgtatatatatataaattgatatttgtatttctagtgatatggggtctgatttcgttcttctgaatatgaatattcggttttcccatcagcatttgttgaataaaatccgtcatttcctattatgtattcttgtcacctttgaaagaaatcaattgatcataaatacttgagcttattttctgggctttctaacctgttccattcgtcagtgttcctccttaatcagcccagtcagagattctaagtgcctctaagttttgtgtttgtccagcctgctgtctttgttcttagtggccccaatacatgggagagtatcaagttgtgctatcgccttgagagacatttgatagaagccagtccctaggaatgtggctggagaggtcggggtgttagatgcgtgttccagttctttctgtctctcttttcagagaagctgagagccagagtttctttctcatccattctgccttactccaaggaatgaagctgagatagatgcctgtacccttgatcatactgctcactttgaacctggggagatacttgttgaatgtttgcaagtttaaaagtcaccttttgttccctgtggtctaggagattcaggagcgtggagttctgtcaactcccagagccaggtgatttaggagccagtcccaagcaaagactgtaaaagttgaagtatttgatgcatgtagaaactgcctccagggagggtcttcagatctatatttactgctgggtcaagctggggaagaaggtgcagagagtgcccacagtcctgcttgagcattcagaagacgccctccctcatagcaggggagacttctggtctggagtgcccactttcctttaagacatgaagaggtctctctgcttccttccaataagagattgcggagtttatctctagagcaagctgagggagaaggcacaggagtgctgtccctcccagtcttgctgggagaagacttcaactcttcacagagagactgcagggctgggattagcactggagaaagccagggaaggccctcgtaggtgctgtgcttcctgtttaggctcaagttggctttttctttattgctttgtaggctcccagagactgacctgttaaaggccaaaaccacagggaactgctgtgaagccaaaccctctccaggggaagggtggaagctggacagatctaggggctaccgctgctgagagtgccctcagaggcagttcaaattcttctttgtttttgtgcttgagggaaatctcccaatgtgctgtctctgacattctgcaagtggggtgatctaagagcccctcccccttgcagtgatggtaaaagttgggcattataggtgtggtgcaagcctgttacccctcaggaagaagctgggagttgaggtttctttccaaatgtaaggcactgtgctcagggtggggttatgcctgagtgtatctccactttttctactcatttgggtgtattttcatagttgtcaggtgtgtaggagtctttgagctggattctggctttctctgggacagaactgatccactcatggctatttacttggtgtgtctgtgggaggagggagcatcaagagtctcctctctgccaccttgctgacttcctgtgttgaatatttttgacttgtgtttatttacattttgtttatacatttgtattttttcaattagtgatactacaattcatgaattctgctttatgctatcaattatgagtagccttaggttaattgctatatttaatttcctgttacagctatagcttcttgtggcttagaattgccttagaatgtaataattctagcaacaaaagaaaatagattgaaatgggccagacagacattcatctgttctctcttttcataaaaaggaaaactaaaaagtgcttataatttgagatattgctgcccatttgaaattataaaaagtctctaaattaagacataactgcttatttctttcagttttttgaaacaaatcaagtaaactatacacagaagatacatgatcatttctctcatgatttaattttagacaatgccttttaatctttttatttcattttaagttaaaaaggccatttgccttctgtattaattattttgtttatcaagtcatctgtaattgtttgtagataatgataatgtattttgaaagcagctttttttttgttcctatataccccaaatgttacttcataacatttttattttatttttctttcttgatcttcaagtgaaagagataaagcctggtgcttccctttcttgtcagttttagaaattaaaggagagagaaaagaggctgaacaacagatgcaaggtcagattaaatgtctcattagagccttttatgcaaatgctgaaccctgcagtcttgaaccgacagacatttcactgtttgggatcctgatgagtcaagtagagacaaggtaagagtcatattggttatttagataaaagacttaaaccaaaacatagggctgagaattaggaccccgggggtgataaaaaattacatattaaaaaaaattatgtcataagtccacccgtggtgggagataactttcatgaagctgtgtttggtcatgagaagttgctagactccatggtggaacatacttaacatacgtccataagatacgtttacgcaaaggataagcaggatgttttctatttataactgtgtcctgtatgacagaagttttaaatgtgttcaggttttttaattttttttttttttaataaaaactactactccaatcactgtgtggcttctccaagcacacctactctttccaagagctatcactctatcagaggggcactgctgctcttctcacccacctacgggaggtcgtcagaggagggacactgaatccagaagcataggggccttgttcaatggggattcattcattcattcattcaatacatatttacaaatcactcaaactaaacactttcaattgaaaattgtgttatgtaccgcataccatgatggataataccacaacttggtacgtcatagagttatgaagattgataaacatttgtattttcttagtccctttttatttattcatatacattttaatatctgattatcatgtttgaatttcctttgattataatgttctttataaatgcaatacattaaaattagaagttagcagttgactttataagaatcattacaaaatttataattattcaaacaacacaagcaaataggtaatcatctatactaagctctaatataagttccaagacaggctaaatccagtatactgccttgtatttttttgtcccatctttctgagaatctttgtataatttgacaataatgtcaagtggaaagagaaataaatccctctttttcttttcctgcatgttgtacctgagagtgttttttccttttctgacactccttttgtatagttctttcagcagtagcaatttattctaataaataggcactcatcacatgatctggaaactactgatttcgtctcagtctgccacaaatacaattaagctgttctgtttccatggttagccatcctgttttctaaaataggaggtttctaaacctctccattttctacaagttaaaaactggagctattcttttttaattggttcttctgtattggatcaaagcatgctatgcaattactgatgctgtcatattggcagaaagaatacgcagaagttcaagctaacattacacatgtcatctttccttgaagaagtacacacagttaactcaatcaaagcaatgtaaagcttgttttttgaggcattgtttccaataaaaagatgaaattggccgggcatggcggctcacgcctgtaatcctagcactttgggaggcgaaggagggcggatcacgaggtcaggagatcgagacaatcctggctaacacggtgaaacctcatctctactaaaaatacaaaaaattagccaggtgtggtggcacgcacttgtagtcccagctactgtggaggctgaggcaggagaatcgcttgaacccggtaggtggatgttgcagtgagccaagatcgcaccactgcactccagcttgagcaacagagcaagactccatctcaaaaaaaaaaaaaagatgaaattaacatttttatcatactattattggatgtaaactagtgattataatgattatgaaatatatagcaaaatggatcagagttttacacatttagttctgttttgattgtttttcatatttaaaataataaagtgttgagaattctactaaagctataaaataaaaagctttcatcttaaaacaatcttatcattgtagatgatctgattttcataccgataaacatgccatgttacttcattgtcaatatattatacaggcaaaataagacaaaatatacgtcacttaaaaatttaaaaaatgtcttataggcttctgaaaatgattaggcacatactatcactttttcctgtgaaataaaaagagatagtctttaatatttagaatgattgttcaacttaatgccttctctccctatttacaaacactctgtgtttggaaaacacacaccttaagcaaaatgcaggtatatgtaaaagaaacagatcttgtttcaagagagaagatacgaagaaagcatttaaaacagtgaatgtcttcaccattactcctcaaatggagtaatggtgaagccggtgtggagggagtgtataaaatttttgtaacacagttggcaatacctgaatacttaaatatgtaaattgttaggataccttagaattcagtatagaaatgttatatataataatcttacataataaagtaatgcaatacataatatgtatgtataatcttaactcttatgaatgctttgtaaatataaccgattgacagccaaaacagtccttggagacagatatctcttctattatcccattttgcagttgagaaaactgaggcacaaaaggtagagtaatacgcccactgtcacagatccaacatgtcttaggggtgggatttgagctccggcaacctggctctagaggtgttggtctcgaatgcctcaatctttttgttctccatgataagatgtggcatcacagaaccctccttatcctctaggtcagataacttttactgtgcttaggattttaatgtctttctaagacttaaatgataatttttccttctcagcatgcatttaattttgaatacatcatgctattgtactctaagtcatgtatatagatccacagcaataaaaatactttaaaaaacttgtcataattacacattgataaagggatttcactgtcatatcatcattttcagaggctatcatattagtataatttaaaatatagtagtaaaagcttgaatctatgtgtctggataagactttctcaacaagagagattttagtagaccggggtacaaattggacaaacaaatgttagaaaataatgctgaagacaaaatatactcaactcacttcttatagcaaatgtgttaaaagtgtacagctcataaatttgaactcacattgttttgatttcttatactctttgaagccaggcttgacgtatggatgcatatttaagatgtgatcggcttcaaacatgaattgattattctgtttgatgttcattaacattaaataatttgagtggggcactgaatctgattgtgtttattttagtgtgtgttagtgaaaacagatttctgtgtagctgatctaatgtaggtggacagcaagtgtctgggctgtgtctgcattcccatcgttcgggcatggctgtgttgtcagctgctgactaatatgtcccttgagtgacaccacagttctgctacatgaagggaggaaaaggcgagttcattcttttgattttacacagtaaacatgccaatttcctcttaatgtatttcataggtaagcaaaataatgtaactgtcgccccccccaccccagttttagtacaaaaataattaaaactccattaatggttttatttggaaacagacatctgaattaatattttttctccattactgcagcaaaaaaagactctgagtataaattgtttaaaatgttgatgaggattatatcattaaaaaattgacatcatgttttgaaattgtcatttttgtaataataaatcatcatatatttaattttgaatttttttctagctataacctgaactttgcagatattatacctctgtagtttgaggttttgtttctgttttgtgtggtgtcctagagtggctgttgtagttatactccaaaaaagatgttaatgcaaaaatataatgcttataggataaggggtataaatagttcactttctttcccttcaggaacaagttacgtaaattcattattatactgaggcagaatgttatacataagaagaagaaaatggcaccagactaaatagtacctcttgaaatgtttcatttattttcatgttacggttacaatgtgaattgatcttccttcccttcttcccctaggaatctgactctatgatcagaactaatttttttcttccctttaagcatactgagggtttggagatagctcctatggttttcaaagtggtggattgatttaattgaccaaaacatagcagggagtagtcatctgattatacaagtataaaataatacagaaagggattttttatttccactgatacaattcaatcaagtttctttgagttgctgagttcaaacattaaagttaaaaaaattcttgatttataaagaaaataaaagttattttctaaatggtttgatttccaaggaacagggaaaaaatgaaatattgttaagattttctgaacaatgaaataaatattgagtattaaataaaagatataatatcttttaaagaacagatatcagttaagggctattaaaattacttttgttctagagttcttatcagaagctctaccaagtttttcagtgtttacaaacagactaacagaccaatttcataataattttcaaaaaaatattgtaaagtaaagtataaggtaacatgatgtgatttttaaggtcaataatatttttaccttaaagatgatgatgcgcttattaggaaaacagtggggtaaaatagggtagccgaaatgaaaccaaagattaaaaaacaaaataaaacaaaccccaagttatcaagtacttaaatggggcattatttcctttgagtatttttattgtcatagaatcagatataaattatgaaagaattaaaacgagaagtttttaaatttgttttactttttagggatggaaagattagtgccattctatctggttttcactttaaaatcgagaacatccctctgagcctttggagtggagagaactcactgtgtggatctcagatccctcttgtttaatttgcctgagtgcttcactgagcttgcaccttcctccacactgagaacaaaagcaggctactgaattaccttttgaagcactacctcctaacagaccccttggattgagaatatggcaaataacagtggctgcagccgccttaaaaacagaagagaatggagtgtggaatgcagacttaacctcagtgtgattttgctccagaataaagcgacatagctctaagtcaggacataccatggggcaagggagtgatggacaaagctaggaaaagagatgttctacacacacacaaagaggttcttctgagtgtggatgcttaaaatctcaagaaggaaaatgtttttcatctgtggtcacaaaggcacaagtaatctagtttaaaatatctagaatggaaagcagcctctgtatgggattagtggctccattatttctttttttcacagcaattttacatgagatctgaaattctttcctttgtaatctaaaccttttcagtttttagatatatcatttaaatatgaaaaaaaattcagggaaaagtaattttattgttttagtacaggtcatggaccttggagtcttcataatggccaggccacatggaaataaattcatagggaaaaccatgctgtaaggacaaagggatctggagtgggttgaggggaaggaaggtattaggtaaccttcactttttattctgcctaaggccaatactagtggtttcaatctagtgacatgcatgttagggcacattttagagcatgtcactgatagctgcctgaaacagccagtatttgcactgtcagataaaagatattgcctgcttcacagtaaagaattcccctttccaggttttaacaggacaagggacggctaactcagatgtatgagctttggtagtacctcagctggtccattaaaaatgtgcatgatgtttagaggcattttatgatttttacaagcataatgttttcactggaaacgtagcagttatctaaatgttcagggaaggttttcttccaggtattgttgcttgtatcctagaatgatttcattcataggtgcagtctcagaatgaaacatacaaatttaaatttgggaaatctattggatcctcttttatttttagggactttttttctcctgtgaataagaggagactgttgtgttcattctcttttttttttttttttttgctggctatgacggtaactgacactcagtaggtcttccctcaatatttgttgagtgaatagatgaaagtacagtggggaaaggaagcagggcataaacacaaaaacggataataatagaggtggtgttaatgacattgaggccaaaatagaaaatttgattctagtggatggtttatcgcatgatacatataatgggttatgaactggaaatcagagggtgtgaatttgcttttattatagtaggagagaggagctgatgagcattagaaaataatgaaaatgagtcattttcttacaaaatattatctttcagataatatagcatcatcagagtctttggatttagagccaaaagagccttatatgccatctaattaaatgtcttatttctaatgtgtatggggagattttctggaaaattacctatatgtgacctaaagtttttggaaatgccgtgtaagaagtttttcttttcatgggaactggaagggataaaaatctgattgcttttcttcagcaaagcataccagcgtccccattaggcaagtgattatgcagtgttgaaaggtattttcttgagaatgttatttttttccttttcattaattatgctttgtctaaaggttctttgtcaaagctctggctagtacttgaaattgtaattgatagggaataaaagaaagtaaaatctttgatctctctctcggtgttatgcaatatctttattcttgagatcaaaagactccgagtataatgctgaccaaacagaggctacagtactgattttgacagagaccaaggacaacagctatgaaagttaacggctatataggcatgaaatgacaaaatcaaaacaaacaaaactgtgagagtgcctctatgctaaacatccttgcatccttacataacataaacagacacattaaaataataaattcataaaataggtacacaatattatccataatatggatctatgataggtccataaataatattgttcaggagaagaggtattgctcttctaggagaaactataggacaagcatatttccaggaaggcatcaaaataaacatttattacagaaaatcctgaaggaatagcttgtacctattcttacagttgaaggcttctagggaaaactggtatctagaacacatagagttccttatttcataataaatgcatcatttattaacattgctccattccctgtatcacttgaccctaagagcaattatgaagttaataaagtttatctttgatgtaatggacatccctttctattctccccagattctttttgtctcaagtatttatttctcgtcatatggcctaaagacatttctcttataaggactgtgcattggtaaactaactctcagaagacttaaagtgacatcatgctttgccactctgggaattatttgaatttaaaatacccttaaaaagataacaaggcttgggcatgatggtgggtgcctgtaatcccaggtacttgggaggctgaggtgggagatttgcttgaacccaggagggggaggttgcagtgagctgagatggaacgattacacttcagcctggatgacagagagactctgtctcaaaagcaaagcaaaacaaaacaaaacaaaagaaaaagagtaaggcttaacctaagaggtctgaaacctaagtagggagagttatcatggggtattgtaaccaatggtgctctcattcagttaagaccatgaaggtacataaatagacacatcatcggtggtagttttgctgtgtgattcctagccactctcacaaaagcttcccctgtgtctcctgtttaaattgaaattagcagtatctggtacttttctctagacgtagtagaaatacttagatggcagaggatttctacttcctttcagtattacattgattcctgacatctttcagtcagggttctttgattaaagttgaatcatctatcattttattctatttttaattgctttgctttttctaataaatatatattcccctcttttaatgatatcatgaactttgaaaatgtttcttcctttgtccttccaaaaattaacttatttcagtagggaaggctacaaaaatattggaagagtaattatatatatatatatgtgctgatataaaactattttatcaaaaccaaaacgaaaacgaacttgaaaatcaattatataggaatatgcaattttagtataagaaaataggaagtcaaaaatcatggatcattacttaataaaacaaaatagtaaaaatgacaatatagtttttttggatacagattcccactctgttgcacaggctggattgcagtggcacagcaatggctcactgcatcctctacgttctgtaatcaagcgatcctcccgcctgagcctcctgagtagctgcaaccacaggtgcacactactaccaattttttgttttttttctttagagaggaagcctcactctgttgcccaggctggtcttgaactcctaggctcaagaaatcctcctgcctcaacctcccaaagtgctgggattacagacaatatacttctaatttatatttgcaaaacatcaaatgtaagacaattagaaagtagaaaaatcttgatgagttttaaaaaattataacataagtttcttaaaatgtacaatatatgtacaatattaagaagtagtaaaaaagtcatatttctgactttgtgaatcaaagccaatgtattcaacttgcattcttccccattttgcatataggtatttctccggccaatgaaaacctacaatattcagatctacatggcttactgaatattgtctttccttttgtcctgttttacatatgtttttatagccccttgtataatttctatttagaatctcagttgaaaaactgaaggggaaaaagacagacagatggacacgcccccctatacacacacacacatgcacacacacacagggagagagagagagattaaatatgaatatggaggtgaacataggcaggactggcacatgacaggtatttaatgcatcatttccttacttccatatttctttccatcttccttcattcctactttccctgcttaagacattttcaataaaaaaaaactttaacatttaaattgggtcaacaagacacatcatgtgcacatagtttgggtaataataattaacttcacggttaaatatgacatgatatgatgacatcagacatgtttattaagatgttgtctagctatccatctggccacaaactgagcttactttaccagtcttcaaaagaattgctcaggctagaaaaatgttaatttccctgtttatgttgcttaaaccctgaaaagttatattctaactaacagtattaagatctaagttaatgattctatctacaattataggtaattattaagtgcttaatgcaatgctcagacatggtagatctaacaaatattctcactgttcaatttctcaaaatcctattttactaaagatcacacacacgcatacacatacacatgcactctcacacacacatgcctgataatgcagaggaaaaaacatatttgtagtgatgccagtggaaggactgttgcattaatttttcactcatttatatacacgattcagaaaatcaataaactattcttgtttgttttctcaaagtcttcaaaacgaattaatgcatttcaaagttttggagctagccttgcatatctcttttcctgaatgctcctgaatctttattccatgtcagagctttgatgaatcagttacatgacagtgaatgccatttgctgatagcaaatgaattcaaatagccctcaatccatgtaggacaagactgtcgtatacttcttggtactattccttgtgttataaaattgaggtaattgagcatttaatatcccatttacaattttgtgtatgttgatgacacaccacagccgcaggaagctattaaagtgcatagacaggtacatacaccaatcaaacttttgccacagaaaagcatctccgtggatgaaaagagtggcgactttttattttaaattatgacagctctgggcagcactactggcagccaactcacagaactaatttactatcacctttgtgatagaaacagcttgatctaaaatttgttaactatgtaaccagttggttaacatgctgtaaattggatgttcagttcttatggaaggaaattcacatttcatttattatatttttatgtcaattatgtcgaagaaaatatttctcttcctatgcaaataagtaatctgatatatttttattcccccagagaaaagtataaaaatggaactattgccctgtagaatattcaagaccatggtgccacttattttatactgcaagtagtaaaatctgacatggtaataatatagatagtaaaatctcactgggatggagggatcaagggagaaatttcactaattccctaaacttaattattcaagggtatttgaagaaaaaaaagaagatatttaatatttataggactccatggttccatttcattcagtggagcttacacaaaattttgatttaagagcaatctgaactagtcaaatagtagactgtactgtaaacaatatgctatataactgtttgtatacaatgaagtggtaatattggttaaacattaaatttacaagaaaattagcatcaggcagatggcagaaggcaactcttaagtaataaacacaattgtatatctggttgcacagaaagaatgaaactttgataaacacaaattctcttctgttcattctgcaaaatttcacaactgtaatagaatgtaactcctgaaatactacaaatgaaattaaaatttgaaaagccacatccatgacttacagttcatctagcaagcagtccatacattgtttcattgcttatcaacaaatgagaaagctataaatgcccaatgcattttgaaggtcaatttttatggtggcataattttaaactagctcatcctcagtggcttttgtaataaaaagggataaattaatggccccttaactaaagtgaacttttgatacggaaacaaaaagaatattaagcatgtcctattttaagtagaaggattaagagctttattccatgaaataaattgggcaggacctaagattcaagactttgaattggtttctaggacattaacataaggagaacaagagaatttgacattgctagaaagaggcacaaaaggatgtagtatctgttagaggaaagattttcacactagctgacagtaactacaggacgtatggtggactgaagtgtttttctcagtttaatctgtgtcttcaaaaggcggcctcaacccttgggccacagaccggtactggtccatggcctgttagggacgtggctgctcagccggaggtgagcagcaggcaagtgagcactgctgcctgagctcagcctcttgtcagatcaacgatggcatttagattctcataggagcacgaaccctatggtgaactgcacctgcgagggatctaggttgcgcactccttatgagaatctaactaattaatgcctgatgatctgaggtgaaacagtttcatcctaaaacatcccctcctgtccatggaaaaattgtcttctatgaaactggtccccggtgccaaaaagtttggggaccactgttctatcaaaatatcttctcctttgtttttccagctttattgaggtatgatcaataaagaaacaacgtatatatttaaggtataaaagtgatatattgataaatttgtacattgtgaaaagactacgacaagttaattaacacatccataattcacttagcgacctgtgtgtgtgtgtgtgtgtgtgtgtgtgtatggtgagaacacttggaatgcattctcacagcaaatttgaagtatacaatatatcattaactagtcactacattgtatataggtcctcagaacttgttcatcttataaatgaaagtttgtactctttgaccagtatctcctcttctctccagcccccagctcctcctaatcaccattctcctctctgttaccaagaatttaacttttgctttagactccacatctacgtgagatcacgcaatatttgtctttctgtgcctggcttatttcactcagcacaatgtttgtcagattgatccatgttgtcacaagtggtatgatttccttttttactaccgaataatattctaaagtttctataccacattttctttaccaatttatctgctgaaggacacgtaggttgtttatgtatttggctatcatgaataaatgttacagtgaacatgagagtgcaaatagctcttcaagacactgattttatttcttttgaccatatacccagaagtaggattgctagaccatatgggagttttatttttcatttttaagaaacttccataatgactttactaatttccattcccaccagcaggacaccagggttcccttttctctacatcgtggtcaacagccatcctaacaggtgtgaggttctatcacattgtcatttggatttgcgtttccctgatgattaataacaagacatattctccttgccaaaattacaaccagaccatttttaaaataactttaacctatcatgttccaaacaaaaaataccatcctctccataagtggctatggaaattatttcttcttttctgttctttccctttttatttgtgctcacatctgacatatatggaggctagctgcccatttgtatctttgcccagtattacttcaagcgtgagtgttcatcttactcattttttaaaaatatattttgggagtccagcagaagtcttgcatatagcatgtattaaataaatacttgctggctttaatttggtttaatgttgccaagtgtctttgccaatatattgccagtcactttcacttgaaaacctcagcttcgatttttattatgtcagtttctctactctcttgttatgtaccaaattctaatgatattttaagtcagttctattctcaccaaccagccttttcttttaacacatcggtattactgcaacactttctagctgacctccttgcccaacctaaggttcttctaacttgaaggcattctatgtacaactgtggtactgaatagccacattacttccctgctcaagcattatataacgagtcttcactacctactgcatcaaagtgtaaaattatttcccaaattttatacccccataatttagttttttatttttctccaactttatttttcattatgctgaaatattttcttcgttaaaaatctcatttattgattcaacaagtactttctttttttttttttttttttttttttttgagacagagtttcactcttgttgcccaggctggagtgcaatggcacaatcttggctcactgcaacctccgcctcccgggttcaagcaattctcctgcctcagcctcccaagtagctgggactacaggcatgcaccaccatgcccagctaattttgtatttttagtagagacagggtttctccatgttgatcaggctggtctcgaactcccgacctcaggtgatccacccacctcggcctcccaaagtgctgggattacaggcgtgagccactgcgcccggctcgacaagtactttcttatcaccagtaatatgacaagcactgttttagattctggaagcatcacaaagttcctgtatcttttttgaaggtggtgatatgggtggctataaaacaaacctgttctcacagagcacacaatcaattgtatgtataaaaattactaaaatatgtcaagtggtgataagtgctatgaagaaaagtaaagtatgatacaaggacagagaataatggggacatggagggttttattttatttaaagtgctcaagaaaagcctttctcatacttcaatgaagggagaaacaaaccatacatatatctggttattaaacttttcatcgaaagagaacagaaagaccaaaaaccctgaggctggtttatacttggctgttggaggaaaagcaagtggcgattttatggtggcttggattaggatagtagcgacaaaaatggggggaaatgttaaaggcagctacaatttttaaatttgcctattggcagtatgtgctagtaatatattacatgtccgggccagtacagggacctcatcctttcttttcaattagcccaattataattgtgatgaggatttctggagaaaagtaatactatgctttaatgattctaaggtctaaaatataaccaaattgcctgtaagatataagcaatgatcagaaggtgttgttcaataaccaactatcatggccgggcgcggtggctcacgcctgtaatcccagcactttgggaggccgagtcgggcggatcacgaggtcaggagatcgagaccatcctggctaacacggtgaaaccccgtctctactaaaaatacaaaaaattagccgggcgtggtagcgagcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaataaaaataaccaactatcatataaattattcggccctttattgagtatattccatttatccagcagtgtgatttctggctgtctcagttattcagtatataggctcagatcagagtaagcagaagaggactttgaacatcagagagcagtcagaactggagaatctacttgcagatgagggatttattacaggtctagtgactcattgctgtttggtatctcatcctccaggggtcctccaggtggtctgggtttgttgtgggatggtgggttctgggcatcatactttctccatggctgctgattggcctcagagccagtgttccaaggaaactcaaaaaaaaactgcagggtctctgccgacctcacctctgacattccacatcactcctgctgcattctgttggggaagcatgtttcataaatagaaattggactctacttgtcaatggaaggagtaacaaagaatgtgcagtcatctctaactggtcacacagataatgcagaatttaatgttaatgcagtagaatataattattacatacgtgaaggtgcttttaatgtttctgagaacaagttaaagcatgttcaaagaactgtttcactaaaggaagcaggctatcacatatttttaaaagattttcattgaaaaatttaaaagtaatctttaaattctcagttatttattaccacgtacatatatatgtatgtgtatttatgtaaaaatatatatacatatgtgtgcatgtctatgtagatacacacacaaatatatatggtatatttatgcaaagatcccactgataaatacatgtatctattttatttattaaatttattatataactaaatttaaatttctaaaaatgtagtaaaatttttattattgaaggcccaaagtaactcaaactgttaacttttataatcgaatgcatatttttatcttgggattgtttaattttaaaactatttattcaaaaataaacatataaaaataatagtaaaactcacacattcatactgtttgtttctgctgtaaaacaaaattggaaacaacaggaaattgattgcctaaaggaaaacttaaattaaatataatagcttaactattatgtgagcagtaataaagttgaaaatgcatgccctttgttgtaggactttgagccaactgttattttcattgaataatttctgatttatttatctagtcaatccgaaatcagcagttatccttagaaatatgtcacatattctattatctccaagcatgaattatcagatcttagagaaatttccaaatagaaagctatatctatgaaagtcaaagtgaatcgttaatacaggcttccattgtctataaacaatgatcacttgagaattaactgttcattaacatgcttcatttttgaagccaacagtaaatattatttaacatgaaaataatttttcagttttacttttttggatcctagattcttgtctgatttttacttgtgaaacatatccctaacccagaaagtatcattctatgcatgtccaaatttactatgaggggtaaatgaattaaagtgctcccagagggattagaacctgagggcaatttcttcttctttttcttcttctatttttttttttttttttttttttgacaggtctcactctgtaacccagattggaatgcagtggtgcgatctcggcttactgcaatctccgcctcccaggctcaagtgattctcctgcctcagcctctcgagtaggtaggattataggcgtgtgccactactgcctggctaatttttatatttttagtagagatggggtttcaccatgttggccagcctggtcttgaactcctgacctcaaataatccacccgcctcggcctcccaaagtgttgggattactagcatgagccacgatgcccggcccccatttcttcttgtagaagaatagattacatcaacctgaaactgctttaagagtcaaaatgatgcagctattcttgcaatgttgggtgatcagggtgatgattgtaatttacttttgaattttcaaatgttttgttgacctaaactataagtaaagatgcactgctcagagaagccagtgaatatcagagtagaaacacaagcctgttatctcatgcccggaaaaaaagtaagaattaagtatgttaacttcttagactataacacacatttaatttctcactgagtattagttttccatggtgcatgtttttatgtaaggagaggaaaaatccattttcaaatccaagtcacatttctctcttagtaatcatattattaatatcagttaaggagtattttatttaaggcaacaagtgttaaaaaataaattcctaaaggtgtcatggctcaaacatgatagaaaattatttcttgctcatttacaaaactggtactttcggttggtaactcttttcaaagcaataattcaaagactctagctcatttccccaatgtctatggaatcctcatcattggcttctaggatcaccatgcttatctgtactagactgaagaaatatggagaattgtgcctggaaagttttcaagggtcagtcctggaataaatgcatttatttaaaactcagtcacatgaccatacctatctgccaaggttccagaaaatataatcctgatccatgactaggaagaagataaaataagtttgatgaatagttacccagtctccaccatagcagaagaagcccattctatttgagattcagagatcggcaaaataaactcagtaggcaagaggcatagagaaggttggaagtcctatagcagcttaattaaagcgccctggccgggcgcggtggctcacgcctgtaatcccagcactttgggaggctgaggaaagcagattaggaggtcaggagatcgagaccatcctggctaacacggtgaaaccccgtctctactaaaaataccaaaaatgagctgggcgtggtggcaggcgcctgtagtcccagctactcgggaggctgaggcaggagaatggcgtgaacccggcaggtggaggttgcagtgagccaagatcgtgccactgcactccagcctgggcgacagagcaagactccgtctcaaaaaaaaaaaaaaaaagcatccaatcagtctccaacactcaagaattatttgtgagattcttatagaactaaaatctgtcactagctagttctcctgtcttctttcatggcacctgagagtttgaaaaataaaaggttatgaattgtatgcatgccattttttttttctgtattgtatgcatgaaaccatcaaagatggaattctttctacctgtagatatccatttctcctccaagagatctcaggtcccatgacaatgtcaccacttctgctcctcctctgcaagtgtaatgaagagggtatttcagtggaagcaatgtattactttccctctcttggattatgacttgaaagaataacattcacacatttgtgaacctgttcatgccccacttcagttatcagtattattcctcattgcttccctgcacatgtaggttaatatcctcactcaccttttctattcttgcaccccttccatgcaggcaaaatgttatacagttttcaaccctcattgatcacatcccaaactccctccactttgatcacttgtagtagagtcagtgtctctcacccataagactttgagttctcattaaactgtgaagtcagagcttattacatttttatctttgcatccctagtacctagcaaaatgtctgccagtggccaaatgctcagaaattactggtaaatgatttgaagatttccactgactatgctggtctaccctgttctgaacttcacatcaaaacctatatgttgagagttttcattatgacaaaaatatactgtggtcaacatcttgaatgtagtgttagttatgatgatatataccgtttctaaaatttctccatatgcacattgaaaatgaatacattttattacatgtaaattcttaagagatgtaattttaaaaaagagctactgaaatgctaaacaagacagaaaaatgtccctcgagattcttgctattgagctgacgaccaaattcaggcacttgcagagtagttgaccttctcttaagaaggagccctcctctgtgccctcactataagaaggagcctcccaacattagattttctcttgaagagccctttggactgttgttctgtctgagagctactggagaatctctttgatagctttgcttttgacggttttctctggagaaaggtctaatagaagcaaacagttaaaacccttttccatccttcacgttttttaaaaaaagtctcccttttaatatgattttctaactctgtagcttctttgtgtcattttgttcctacaagtgttcatatatacttttaggtcacatgcatttccacacacaatctgaatgtttcctacaccatagagaaggtgttagagactggatacttatacaatgttatttaggggtcggggaagagggagactctattccttaaaacaaggaacacaaaattaaaaatataaaacatgatataaaagtaaatattggccagggcgcggtgacccactcttgtaatcccagcactttgggaggctgaggtgggcagatcacctaaggctgggagtttgagaccagcctgaccaacatggagaaaccctgtctctactaaaaatacaaaattagccaggtgtggtggcacatgcctgtaatcccagctactcgggaggatgaggcaggagaattccttgaacctgggaggcggaggttgtggtgagccgagatcacaccattgcactccagcctgggcaacacgagtgaaactccgtctaaaaaaaaaaaaaaaagtaaaaacaatgtaaatatttatctatagtgagacaagtaatcaaaaccaaaatatggaggcttggagatataggtccctttcttccaggagctctcggtaatttactagaaatgcttccacagaaatacttttgatttaaagatagatttttctttcacccagaactttctctaagttctaccaaattatctcaatttgattgtaatttaaatggaaaacataaaactacaaacttttagaatataacatcgaggcacatttttgagccccagggcctgctgacatgttcttagacatgataccgaaagcataatccataaaggaaaaaaaaaacagaattaattggactttatcaaaactaaaaatatttcatctacgaaagtaaaaaatgtatgtatgcacaacaatctgtacatgattgttcacagcatttctatttttaacggccctaaactggaaaaactaaaatactcctcaataagtgaatagttaaacaggttgtggtacatctatatcatgaaatactgctcagcaaaaacaaaagaagacctaacaacaagaagaacaacaaaagtgttgttagatgcaccaacttggatggatctcaagggcagtatgctgagtgaaaaaagccaatctcataaggtcacaaccttcttgaaataaagacaatacagggattggaaacagattagtggtggtcatgggttaaccatggctgtagtgcagggagaggatgggtctgagatggaacagttttgcatttagattgtggtagtgcctataccttacacatgtgattaactgatataaactatatacatatattgtatcaatgtcaatttcctggtttaaatagtgtgctatagttacgttaaatgaattcatggcagaaacttgatgaaaagtacccaggacccccctgtctttgcaccttctagtgaattcataattatttcaaaataaaaaatttaaagcttaaatgttagcacttacacaagtggattactttattacttctgggatatgtacaaatttgggtcctcttagtgtctccatgattttacatgaggttgttctaacataaaaaaaaaaaaacaaactacgtaaagagtgtttttaaaagtgagaagaaactactgctagtttgagaaagggctagatcctaatcagtaaatagaaaatcagttaacattcaaatcatgtttaattattttatcttggaatgcacacgattactgttttattttttactttttagagacagcgtctagctctgtcacccaggctggagcacagtggcatgaacacagctcactgcaacctcctcatcccaggctcatgtgatactccaacctcagcctcctgagtggctgggaccactggaatatggcacatacctggcttttttgtttgtttgttttaatttttcttgtagagatgaggtctcattatgttgcccaggctggtctcaaactcctgggttcaagcggttctcctgctttccagcctcccaaagtgctgggattacaggtgttagccaccacacccagcctatgattatgattttattcattagtctatgtaccaatatttaaaagaagaatttgtatcttgcatgtgtgcacaattataccttacacataaatgagtttgaaatggtaaaacggcaaacctctagactatgacagccaaagacaggtatttgatccttgaaaatagaaaataatataggcaatgacttttgcaaaatagtgagatatttccaggtaacatttattctgaaggatttgctttcctatcactgcaaagatggccttttcaaccctctcaccatcatctcatttgctgagatgagagagaggagagaggggacaaatggatatacagatatatgggggctgggggagacagagagaaactgtgttttctggggcaggcataggtaacatttacagatacctgtccaaagtacacacatatatttctatagtcctagcattgcacacgtattactctaaaatgctggcattttctgtcaatctgcttggtagcaaatgctgaggaacaaaccaatcactggatctaggagccaagaactaacagagactctgtgctttatgtgtgagcatttaactactgtagatggagacctgcacgtatttaaattgaatatcagtcctgtgtaaagagtgattattctgatgcttctccgcatcagatataaagttatatggagtccaaagaccatcaatagaggattactcgtagcccatctaattttggaaaacaatagaggagttttctggtgtgaggtgaacagcctgctgttttctttgcctggaatgcattttcctcctcttccatgcttcacctccactccccttacctagttaatacccactcatggctcaacatttgctcagctggtgtttacctacgaagccttcttattccttagatgaaaataattaccccatgttccactgcccagtcagagttaaacagaacttctttttttttatttttctttttaagaatatagagtctttaatgtggtcagaattaagttgctatcagtttaaaatagcctgttacaagtgtattttatataagcctcatagtaaccacaagcaaaatctatattagatacagaaaagattttttttttaaaaaaggtttcaggccaggcactatggctcatgcctgtaatcccagcactttgggaggccgaggtgggtggatcacctgaggtcaggagttcaagaccagcgtggccaacatggtgaaaccccttctctaataaaaaaatacaaaaattagctgggcgtggtggcaggtgcctgtaatcccagctacttgggaggctgaggcaggagaatcccttgaacctgggaggtctctctgtctctctcagtcattatctctctcttcttcaaacctgtaacaaaactccataaggaaagaaatttcattgtgtttgtatttgtctccatagaatctagtataatgctatgtgtacatatgtacacatatgcgtgtacatacgtgcatgcacacacagacttacatacacagggcttgcagaggaataaattctgcttttaaattttctatttaaaaagatacttcaaaattcccttcaaatttgatgaaaccaaaagtttgatttacccagacgttgaggttttttcttttatgggatatacaattattccatagtgacatgtcctaagataattttcatattcatagaggaggctgaaggtaggattttgtgaatctttgataatagttacatgaatgttgaatgtttgtatattgaacttgcatattctattaataccatctctggaaatagggtcatttggttataccaagttttttgtatttacatatttcaagaatatctatttaaatatatgtaactagagctactggcagataacttaggtctatatggaaattatgaataaacaaaagtagatgtgaatgaagccaagaaactcctagtgatataacatgaagtctttactcaagctttgtttagaaccagtaacaggggattttactcttttcgtgcaatggtccatttgtcagtctaattaaaaaaaaccacaaaacaccctcctcggagtaatataatgttattaaatacataaaatgaaatacagcggggcatggtggctcacgcctctaatgccagcactttgggaggccgaggcgggcggatcacgaggtcaggagatcgaaaccatccggctaacacggtgaaaccccgtctctactagaaatacaaaaaattagccgggcatggtggtgggtgcctgtaatcccagctactcagcaggctgaggcaggagaatggcgtgaacccgggaggctgagcttgcagtgagcggagatcgcgccactgcactccagcctgggcgatagagcgagactccgcctcaaaaaaaaaaaaaaaaaaaaaaagaaatacatagggttgaagagagaaatgaatcatattgaaagccaattttaactcaggagacaggataacctttttttgtttgttgttgttgttgttttttttttttttttggttaagcaacttggctttcctaacatctaatacttttcaaagttttccatatttgtttgctgcttatgaaaaccaaattaatgatgttttttcctgaataatctcatcatgaccttattcttataatgaaagaaaacagaatgctaaagctagggttgacagataaaatatagaacatagcttaattgaattttagataaataatttaaaaatagtataaatatgtaccaagtattgcatgggtcttactaaaaatttgttatttatctcaaattcaaatttaaatggacatcctgtatttttatttgctaagcaggcaacccttcaaaaactggtctaggttaacaaatgttagcgataaaattgccatgatcatgccctaaggaagtagaatcggatctactaagattcttattttatctccgcctgaaaaatattagccttatgggttggtttcagacctgtccctacatcatattttatgagttttgggaaggcaaatatttgctaaaataagatttaattctgtgctttaatgttttattgatgataatataaaagtggtaataaaagaatacttcacttttgcaaaaggcaattgaatatactgactgatatttttccagaaagtctgtctagttgtagtgacaagaagaaaatatctcttcctagattatctattgaaattccttttatcagcaagaaagtgtaattcactacgttttctcttttgcctttctgcaaaaggctaagagttcagataataatgtttaatagttattaaagtgaacttatctatccttttgtttaaacattttgatacatgtccgcattttattttcattttaactatcttattttattcatgttatttttctaagcctgatcaatttttacagaatgatcagattataagtcctaaatgaaatgccactaatttgaatcatattcagaatgtaatttgttaagtaacaaattttacaagaaatgtgatagatcatgcaaaaattataggtcttaaatcctacatatctcgaatcaaattattttaatactaattttcattgcaattaaaggattcagtaaggattgtaagtactttccattatactgaagacttggaacaagttctgattattacatattttagcatagatgacaggatgcatgcaatgtatcagcatgtaaaatgaaggaaagatagaaaaacagttgcgacaattttgtgcagtagtactatcgtgctgctatacaagtaaaacaatttaatcacacataacatagtaataatgcttacttattgctagaaaaacaggattttaattattttaatgataaatctgctttataattaggcagaaaagcaagctgtgaaaaagcaactttagtatttaattctagtgttaatttcaaaaacaaaaacaaaaaaaacccctgaaaaacaaaagaacacaaagacaggttgaaatgttccttttagggtattacatgctgtacagtgctttgtagtttaaaaagttttatgcccatgcctgaatgcattttgattctcaaagcatcttttggggtaggtttggcaggcactattgttcattcctacaaatagtttaaaatttttaagaaaaacattttagtactttattgaaaatcctatatttgcagccttcattcttaatgtttgtagcacattgaattttattgattgtaagacaaatttatttcaactggattgttgaaataaactctaaataactctaaaaataaactctaaaaatcatggtcacggaggttgagtcagattatgcttgccatttacctgtgcatgtgcaaacctcaaatacctcagccttaaaacttggagaatgagtgttcctgtggaagattattcttcagagatgatagtggagtactcttgaaaaccctaggtaccaaattgctgcagaagtatttgaaggacctggtgaatctaatatgttttaccaacatactacaagttgaaatcaaaagttgactgctcgtacataattgcaaagtcagatgtcagatgccaacatcaaaagctcttcaaaaataccacataaccaatgctctttgtaacccaagggatgacactgtgtggaaaagcacaaacatcaagaactctaaacctaaaagtgatttagacaagttaaattccaaatgtgaagtaattatagactgttaatatatttgccttataaatttgtatgtatatgcatgataaaaatctatcactaattaagggtaaaaaacttgcaacaaaaataagctttctagatattaaaaagcatatcatttaattgaatagatgttttccttcttgttacacagaataaggtgtatctatgtaataaagacgtgtaggatttgagtaatgctgtgctaaatacttactatcttgagttctggtttggagctatattgtcccatttatctgtctgtcaattcttatgctagtaccacaacatttcaattattttatgcctgtaagacatgctaacattttagggtaagatattatttctctattattcttcatttgcaaaattcgcttggctattatttcatattagtttttcaaatgtaactgcagaattagaatgcagaattgcttctcaagcacaccacactgtgcagcaagtgaaactgcactggagtcatgagcaataggcattttccacacttgggatctagaaacacaagatgcctttccattttttctgtttttcaaacgttactgtgtttggtaaagaaggttgttttttttttgtttgttttttgttttctgctctgggctatatatctttcaatgttaactttattctctaatagattatttcttctgcttattgctgaaagatgaacaacaaattttatgaagatttgtgtaagaatagtggatgaaaattttggtagatgttagcatttgcttatttggaaacacacgcttagagaacattcccactctgaccagactagaaatctgaggtttgacaagagtgacttaatttcacaccttctctctctgtcttttttttttcgtgtaaagaaaacagtcatcagcataagatttaaaatcttaaatgtacaatatgtttgactcatctgatacgttccgcctttgctgcaatggccttcaatacagtaaaaataaccacactcatgcgttagaatcatctgtgcaaactaaagtatatggcaaaattttaaagaaatcaccaacttcaattaatttattttgaaagaaagaaaaggaatttgcagtaatacttgaaacatttaaaatgaggattttttaaaaatatgctattaaaaatatgaatttatttaagacaatctgagatgactgaattataaattgtgtaaaaggcaatttagaatttttaaattatcaatgtatgtaaaatataggatatttcatttgttgcattgttaaattattgcttattttttaatagcataaaataaagtaaaggctatgttttagaccaatgttagtttttactcttatctatatataattggtaaatggagaaaatgtcagtgagaaatctaaaatcaaaataagatatgatttttaaataaattgtacagtaatttttctgttgaaattatgaacaatataaatattttatcatagttttctgtagttttcaaaatatcatatttgtggatataacccctgtttaatcataaaaaattataaatgactaaagataaaagaggaaaggaaatagagaagaagctattgtaaaaagaattgaaaagcagtgttttcctgctatttaactttgaaacagaaaactttttttgttgcaatgattcttcactacaataccaaaattctgaagagaatgttttcaggttaccatatcaccaaatcagcatagccagagaccaaacagtgagctctaaactatctttactagatttgaaactccagcatattatatttaccaaggtaaattatccctcttatgacaagtttttgttatcctaactgataatttagaaaactaaaggtcatttagtgtaaaaaacatagttgaaatacaattactttctcatatgtatcttaaaatgatatttcaaacttccttatgcagtgttgctatctgttaattctcccatatatcttattgaactagctttttttttttttctttttctttttttgagacacagtctcactttgtagcccaggctggagttcaatggcatgatctcggctcacttcaacctctgcccccaagttcaagccattctcttgcctcagcctcccaaatagctgggactacaggcatgggccaccatgccctgctaattttcatatttttagtagagacggggtttcaccatgttgggcaggctggtctagaactcctgacctaagggatcagcccacctcggcctcccaaagtgctggattgctggcatgagccactgctcccggccaactagctttaactagaatattatcttcagcctggcagttaaacaatttagtccagtagttacataccttaagaacatttagagaaaacaccaaaaaattactaaaaattctggtaaaattaatacccatgactagagatatgaaagtctggcattaactaagttgagaaagagctgttggaacagtctggagaataatatgaaatgttagaatgcaaggtcaatgaacagatggttctgcatttttatagctaacactactaattggaatggatttaaaatttagcaaacagagttcttcaagtgcaaattgttaagaaagagaggcatacattctttctaagtggcttggtggttgtacttgattattatggactggatgtggactagataataagatataaaattgacaagagataccatggcctgataatggtactcattttttatgtgtatgcataatttaagctatgtttttcactcatatgttctaatcactttgcattttttctcctgtactgtgtgggatttgagagtcgaggtgaaaggaagaacccaaacaaagagattgttcttaaaggcatgttagggtcctttgggttaattatacaaggtttgctgacagcgcctgataagaccgttgaggtcattctgttgttgacgtctcttcaatctcaatacgccactcagcaaaggccaaggcagatagagcttttccactatctttatagcacaaaatgctacgctgaagagagaaaacacacactctctctctcattcttacacccacacaaaacctgagaagcccaaactgccacacactttgttgatgacaaggtcagcatgataccttagaaccattcatttctttccactccacttcactttcaatatgcaattttaaacatcataatttttaccaccagaatgttacaaaaaatgtctgctaattgctttgtgtccaaaaaagaaaccaaaagaaaatggtattttgctttagacactaacaaaatgtaaagggtaaatgaagctatgtcttagtagtatggcagaggcagaggagcagggcaagaaacggtatgtaagacacgaactagtcactagtctcacagttctactgaaaagtgagctttatctagttgatgacatcatgcagccccatgaataataaatgaatacatatttattgagtgcttattaagacctccgcaaagctctgcctctgtataaatgagtgagatgaaagcactgttctcacaggaaggttataaaggagctgggggaaacattaatgcaagacacagatcataagagagaaacttcatagtaaaaacgataaagaacacatgagttcttccagagcaggggtccccaacccctgggccgtggacctggtacctgtagtggcctgttaggaaccaggctgcacagcaggaggtgagcagcggtgagccaggaaagcttcatctgtatttacagccgctccccattgctcacattaccacctgagcttggcctcctgtcagatcgtctgtggcattagagtctcacaggagagtgaatcctattgtcaactgtgcatgcaaatgagctgggttgtgtattccttgtaagaatgtaactggctgggtgccatggctcatgcctataatcccagcactttgggaggctaaggtgggtggatcatttgaggtcaggagttcaaaatcagcctgaccagcatggtgaaaccctgtctctactaaaaatacacaaattagctgggagtgattgtgcatgcctgtaatcccagctactcaggaggctgaggcaggagaagtgcttgagcccgggaggcaaaggttgcagtgagcagagatcactgctctccagcctgggtgacagaagatcactgctctccagcctgggtgacagagcaagactcggtccaaaggaaaaaaaaagaaaaagagagacagagagaatctaactaatgcctgatgatctaacgtgggacagttccatcctgaaatatttaccctacacccaagtttcatgggaaacccatccctgctgccaaaaatggatgggggctgctgctccagaggaccgatagtgcatgaccattaatctgtgtcatgggagaataaggtttttttgtttgattgttttttattgttttttattttatttttttttggagcccccttctgggcaagaaagaaagggatcgatgaaaaatatgcctcctatacagaaccaagactaaaagggtcgaggtggaataaaatgttcctatagttcgtaagcagccgtagtttggagtgctttggcatgtatcaatggaaagccaggatagtgtggttaggaatccatactctgtaaaaaaaaaaaaaaaaaaaaaaaccctgcctgtgccatttggcatgcttagttcaattattttgaatgctataaaaatagagatggaggagaaaaaaagatttcaaagtaggaaatgaaataggaagaatgttcaggcagagattgaggcaagaagggagtagagcccaggcagatcttatcaatgtgaatcagtctcaccataagtcctaacttccctgttgggaaagcaacagctcaaccagagaccagaatcataggttactgaaattgaagggcccagagaagtcatcttgtcaagcttctgcatcttttttatctcatggatcctactgactggtcataccctccaaaattctgagatttaaaaaatgcttacaataagttatttttctctgttaaatttctcagtcagcattggctttttttatttgtttgtttgttttgagacagagacttgttttgtcacccagcctggagtgcagtggtgtgatctcagctcactgcaacctccacctccctgcttcaagcgattctcctgcctcagactcccaaatagttgggattacaggcacccaacaaaacaccttgctaatttttgtatttttagtagagatggagtttcaccatgttggccaggctggtattgaactcctgatctcaattgatccactctccttgtcctcccatagtgttgggattacaggtgtgagccacgcattttcttctcttgtttctttcaaagtgaaacattacatgcccaccacaggaaattctttaaatgtgaacttcggaaattctaagaagcctgcatctgaaacagttatcatcagttggagttttattaacggccctgcgagactaaacaaaaatctgtgggcctttacagctagttcagagaactgggaatgagatgagttgtggttgctaaaaacataaacttactaccactctatgatattatttttccacactggcttttaataaatacgaagccacaggctgggcgcagtggctcactcctgtaatcccagcactttaggaggcctagtgggcgagtcacctgaagtcaggagttcaagatcagcctggccaatatagcaaaaccctgtctctactaaaaatataaaaaaacaaattagctgggcatggtggcaggcaccagtaatcccagctatttgggagactgaggcaggagaatcgcttgaacctgggaagtgaaggttgcagtgagtggagatcgtgccactgcactccagcctgggcaataagagcaaaactctgcctcaaaataaataaataagaagccacagaaacatggattaaagcaaaatttccacacataaccttagtgaaagttaaaacaaactaggattctaaatagtccccaaagtgtatattaatttacaattaatttattcagaagttttacttgaaaacttttctctagcatttataactcttcttatttatgctgttaagtgtcatggtatatatttaaatcacacttgtttggaataacaagtttgttttcactaaacatttctgatgtattaatatcatctgctttttacctgctatcagtaggaatgttaacagatttcgatatcttgtctcgttaacaccaaacaatgggtgttaagatgttttttaaaaaaattccttgttctcatgattatatataatatatgttatatattatatataatatacttaatttataactattgtatatagtgcataattttcaaagacaaaaacaattgaataagagatagactttcttcttataagttcatcagtttcaaataatcttgcatgtattacccttcctttttattgtcgtgttaataaagcagttttaaatatagctgagcttaaaatcagaatgtgtgacttttctgttagttcatagtaagttaccacaaggcctgggcccttggttaaagggtttgcctgattaggtcaggcttattcaggatgatttccactttgattaattcagagtcagcttgtaagagttcctaattacatctaaaaaattctgccaaattctattcgccagaaataaatcacaagttctgtcaatattcatggtaggatgtgggtggggaacgaggtcatacataggtgtccggtactaaggtgtgacaatcacagatgccatcatagaattctcattactacctaagaacgaattcaacagcagtatttcacccggaacatagtagctctcatttctaacttctctcctgtctgagctacttatggcataatgaaaacaaaaacgaagagctaattgcaaacttatgcatctataaaaattttcatttaaagttaatattgttatgtgtgtatttggtcctgtcattaggatgttagctggttattttgctcgttagttgacgcagttttcttcctagccttgatggtctttacattttggcatgtttttgcagtggctggtactggttgttcctttctatgtttagtgcttccctaaggaggtcttttagggcaggcctggtggtgacaaaatctctcagcatttgtttgtctgtaaagtattttatttctccttcacttatgaagcttagtttggctggatatgaaattctgggttgaaaattattttctttaagaatgttgaatattggcccccactctcttctggcttgtagagtttctaccgagagatccgctgttagtctgatgggtttccctttgcaggtaacccgacctttctctctggctacccttaacattttttccttcatttcaactttggtgaatctgacaattatgtgtcttggagttgctcttctcgaggagtatctctgtggcgttctttgtatttcctgaatctgaatgttggcctgccttgctagattggggaagttcttctggataatatcctgcagagtgttttccaacttgattccattctccgtgtcactttcaggtacaccaatcagatgtagatttggtcttttcacatagtcccatatttcttggaggctttgttcatttctttttattcttttttctctaaacttcccttctcgcttcatttcattcatttcgtcttccatcactgataccctttcttccagttgatcgaaaatttttgcaacctactcatctgacaaagggctaatatctagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactgtccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactaattcaaccattgtggaagtcagtgtggcaattcctcagggatctagaactataaataccatttgacccagccatcccattactggttatatacccaaaggattataaatcatgctgctataaagacacatgcacacgtatgtttattgcggcactattcacaatagcaaagacttggaaccaacccaaatgtccaacaacgatagactggattaagaaaatgtgacacatatacaccatagaatactatgcagccataaaaaatgaagagttcatgtcctttgtagggacatggatgaaactggaaaccatcattctcagcaaactatcgcaaggacaaaaaaccaaacaccgcatgttctcactcataggtggaaattgaacaatgagagcacatgaacacaggaaggggagcatcacactctggggcttgttgtggggtggggggagggtggagggatagcattaggagatacacctaatgctaaatgatgagttaatgggtgcagcacaccagcatggcacatatatacatatgtaacaaacctgcacattgtgcacatgtaccctaaaacttaaagtataataataataaaattaaaaaaaattttcatgtgaacagaagactgagggtcaaaagaattgagaaaataaaataagtttacttgaaaaaaaagttgcaatgaaatctgattgcagaagaattggctgatcaaataaaaacataatgtgtattttaaggaaacaatgcaaaattatcaaggttaccaagtgtacatcagtctaagaatttgtttgatgggtttttatgtttgcttattttaaagaaaaatcaatttgtaagaatttcaaaacagcaaaaatgcttcatgttgtatttatattaaattgacattgattaaatgatgcctacttattccttagaagtctatccatgtaacatgaatactcttattaatgtcttagaaagtttacctgtatcattaaacccctcaactaaacctctttgattcttcttaatttttttactttatgttcagacagttgaattaaccatattttgttatgatacaaaaactcagttcctgtttattgttttaactttgtgctttttctaagttaaatggctctcacattatattgccatcgtcattagcattatctaagttcttctaaactttattgctgtgacaaaaatgaggaagaaatactgctttctaaaatgacattatgacttctttgctgtgaggtctgtgttgtaaatcatcacctctattccccaactgtgaaaggtaaagtccagtctctattgctctcttgagttttaaaacaacataacgtatttggaggagttaaaagaccttgctaaatattggtctgtgttaggaagtgtcaaaacatagacattacatacagaggaaagaagacttcaagggttaagtacattttcaaggtcatgacactacaaaatggcagagttggggcacacatacagaatttcagagtccaaatttttaaccaattttactttttttatatcgcattaagaggaatttatttgtatttccatgtatttacatgttgtacactattcatcttgtaacagcgtcacagtttttcaagtgaaacattttattatatttaaaatttttgtataaatatagctggaattaaaataattacataaaacaatgtttttaatacttttaacatctttcttttagaatagtcttagatggatcttgcacacgtattccaacaatgatgtaattgattaaaaataattgaaactatttattgaatagtcatctttttaatttatcatatgccttttattatcttaagcatgtaagatttccattgtttgatattagatttgaatttttggaaataagcctaacagtcatagaaaacagacttggtagataaaatatacaaccagcctgaataatacatttctttgtttttcctcaaaatgatttcataatcattaatcggcccatggcttactcctttggtaccatggtgtgtaaaatctataacatttctatgaaatcatcctcatctttgggagatttattataaacaatgacaactgaggtaaaaaaaaatgaaatagatatagtcttctcttataatttcaattagcataattctgtttttttttttttttttttttcgagacagagtctctctctgtcgcccaggctggagttcagtggtgcgatctcggctcactgcaagctccgcctcccgggttcacgccattctcctgcctcagcctccctagtcgctaggactacaggcacccgccaccacgcccggctaattttttgtatttttagtagagacaggatttcaccctgttagccaggatggtctcgatctcctgacctcgtgatctgcccacctcggcctccccaagtgctgggattacaggcctgagccaccgcgcccggccaggggatgtcttatttctctgcaaactttacaacgaaactcttaaaaaagacatgttagtactatggttttaatttttcttgtctcatttttaataatttactctgattaggctttcgtctccaactttctacaaaaactattcttgtcaatgccgtacatattaatgcctcctcctcactgagtctcatgcttagtcctcatctttcttgactcaacagtagtacttgacatggccgaactatttgcatccttaaaacacggtcttcacttggcttcagacattacttgatcttgattttccttttacattatggatcatatttcactcttttcccagtgttcttgaactccaattgttgacatgccattcttctcagtgcttgggcctctttatctacattcatggattgcatagtgttttatgcatttaaaaatcacccattcagtgagtattcccaaatttatatctctaatcctgtcttctcctgaaagcctcagacttgtatcccaactgcttatgtggcaatgtagactaataggcatctgagtgataaaaaattttcaaatctactaaggtagtttgaaatcctcttaaataagaactaagcatgacagtcaagctccttgggaaactttacctggaaagtatgttatatatccatacacctgacaaaggtagtagcagcactgggatttgcaacctcttagattactagggcctattaaaacaataataataataataataataaactcctctgtaggataagagttataattattgatctgtatgaataagataatacatggcaacaaacctttatttaaattgatttacaatttaagtttataatgcattaattacaataaaagctgtatttgttcaaaaatattgctaggcataaaaatagataatatttattaacgttagctaagtcaccataggcccttcacatatactgctaacttaaattgaggaaactattagtaagacttctgctttacactcaacgagataatctgcagccctccagaactctgtgctccacatttagataactactcatgaagataattcaacactaggagtcagagaaatctattcttgttcatttttcgctacttaccagttatgtgactttgataaagccacttatccactgtgagctttagattctaaatgcgtaaacagacatcctgttgcgtggtctgccttgcaaggtttttataagatatacataaaattaaacttgaaaacacctaaatgtgagacattatagttatttctgtagacacagtctaattattattgtagacacaggtatattttattcttcagttcctctcttgttagtatttttttttttttttttgtttgagacagaatctcactctgtcgccccgcctggagtgcagtggtgcaatgtcagttcactgcagtctccacctcccaggttcaggtgattcttttgcctcagcctccctagtagctgggattacaggcacctgccaccacgccaggctagtttttgtatttttagtaaagatggggcttcacaatgttggccaggctgatgtcaaattcctggccttaggtgatccacccacctcagcctcccaaagtgctaggattacggaagtgagccactgtgcccggcccctattttgttagtcctttaagggaccatataatcatataatatagtgggcaacctggtctctttctctacagattcaatttctaatcacgaaggaggagaaagaaattgagttgtgtctttgggtatattcttgtgaaatgaaattcagtggagtaaggaggaaaatatgaggcatatcaatggcataaatatttgtattttgagtggtgtagttggccaaaggattggcactagcttcaggtgtgtcctacttggcagtggtacaagtcaacatggttgtatgtgtcagttttgttacatattcaaatgtacagtataacaggagtctcagaggacactgtgatttctaaaaataagtaaggtaaaaatgggtttgtagttttagctgtttgtcctcttttgttccaattgcatacacatcaaatcaaattattcttgtggactgtttttctttatatgttcttcttctgtacccacatagaagaaatcataaactttaacaagatgataatttacatatcaaaaacttgatttaagccatagccagtacataaaaattcatttttgtttagtaggtttatgtctaattagctgaccaacagggggtgtgctaatagtgtcagataactgaagtaaatggtatttaacagcatggggttccaataacacaggagaacacaggagcaaccttctaggctttatttcattcaagtccataaagtcccctgtggtcgcagcagtgcatatttaaaatcagttaatcatgttactcatgggtgttggatatctttcaaaatggcctctggtaatgagctatttgtcctgcattgtgacaataagtctcttccataatttataaagctcatgcagatgatggttagagattccataagaaaataatgcagggatgttctacttcctgcttaattcctacttaaatacagttagatactataagtgcataaatctacatagtccacaatacttttgtgaaatatcatttcattttattatgatgatttttgcttttgtcttgttcaagtagttttaaattttggatgtgttggtgggtataggagtgactaaaagagagaaatgtctattgacccaactggtacttttcatactttttttccattctgtcattgtttgtcttaagtactctacattttgtaagcattgatctcatctttgcacactgtagtgataaggggtatgcatattcttacacatacagcttctcccctgacttaaccaaatatatcaagcaagaaaaacaaccctcttcagctagaagtcttcatcaagaaaacatatatgaagtatacatacgaatacacacacacacacacacacacacacacacacacacacacacgggagtttacaaccatacattacagagttctgcaaactcaaatagcattccattttctggacaattctatctgtagacatcagatgtactcgcaaaccgtacattgttgtttaaagttcttcaataagagattctaggcttttaacctgtgtttataattctaacaatctttgcatttagaatgcaaagtcttgaactctaacctttaagatgctggttttttacctttcagaggtcttctgacagggccctgccattgtacttccccatttcatatccttattgcccattaattaatagcttcaaggtttaaccgaacatagcctgtggataagttcttcttcatgtgggggtgtgggaggtgtgtacttcctgttctcaattccagctacaggaacatcctctctcaaacattgacatgagaacaagacagtgtaagacagtggaatcaataagctaatgaacatcaatacaaagtaaattctttcacctcaatttgaatgtgaagtaagattaatccttattaagaaagaaaatgatgcaaaatggataaatgtgaccattttgttttatcatgttattcaattcatcctaactgagcagttagagattttctagagtttggatggagaagtggatcatggtttcatgtaaaatattgattcacatggttttcagctttactagatcttggcaaacctttcctcctcccttcaaacacacacacgcactttctttaaacattctactttccattttcctttaagctcctaagcatgacaacctgggagcccactgtaaatgacttttctccaggtcgctgcttatggttacaacttctacacagaaaacaattttgccagtatttccctcatctcatcaagcacagcttcctttctgcaaaaacgacagcatccaacgtgcaatgactgaagttattataacatcttgttcaatgtaagcacagctgagttccttagaacatggtttgcctaaaggtcagatgctcaggctcaggttgggagagaaatgatattgaagggacaaaatagcaaacataagaagccacctttgctcatttctgcttcccagcataatttcccaaagcgcttggccctgtgacaacatacagtgctccaaaaaaaaaaaaaaaaaaagaggtcgaaacaaaataaaacataccccactacgtctcttgcatgagtcagtattccttaaaaaataaatgaccctaatcattgcttttttctaacataaaataatgtctgataggattaaaaattatgcctctataatctgtaatcatgaatcatataatctatcagtatcatataatctataagatcatatcttatcatataatctatatgagtgtagcttatagattacatcttatagataagatatactcttgtccctcattaccttaggggaagctctcgttcactggcagattgccatggctaattccagctgccgttcattcaaatgttaatacggatataggattttatttatttatggtagagttgtaggaaaacaaaatgtctctattaacatttctctattttgctaaaatattctgaaattataggctctgataaataatatgttatatcttataggtaagatacactgttacatccaaactttaatataattttacaggtactaaccccccattacctatatgtaaacatcagaatcaaaaattgatcccttgacttaactgaatatttaaacaagaaaaacaatcatctccaggtaaaagtcttcatcaaggaaacaaataagaagtatacacataaaagaatgcaccccgccccccgccacacacaggactatacaaccacacattaaagagttctgcaaactcaaacaccataccattttctgggcagctttatttatttatttatttatttaattttatttatttatttatttatttattttttgagatggagcctcgctcgcttgcccaggctggagtgcagtggcatgatctcggctcactgcaagctccgcctgccgggttcacgccattctcctgcctcagcctcccgagtagctgggagtacaggtgcccgccaccatgcccggctaattttttgtatttttagtagagacggggtttccccgtgttagccaggatggtctcgatctcctgacctcgtgatccaccctcctcagcctcccaaagtgctgggattacaggcgtgagccacctcgcctggcctgggcagcttgatttatgatccgtaggcatcagatatagatataaagtaaaaccctatgtcaaaagagtctgaagaaacacctgtctaaaagattttcctggactgtagactttagtctatagtcctcaagaaaacttctaaataaaacttacttccattctttaaaaacttaattttctttcactcaacgcagacctgtggagactaatgaaagaaagatcaaaggaagatattccagctggattatgaaggttgaggaaagatcgtattaatatgtatagaatttcaataacagcaagctaaagattgttgattagaattcattattctagagagtgttaaccagtttgaagagtggtctttttctaatttcaaaagaatccaacaacttaaagcagtctaaaatgatgattcaactaatcactaaatttaaaataaactgagcttgatatgattttaggttaagaaacagaatctacaaatgagaaagaaagccagtagtttatcctcctcctttgctgggttatgaggctggagtgggaaggaggtcttggattctgtttctataggtgaagaaaatcaggggcttgatacatcgccttactaggatgatgccaacaataaagatttcactgttagtcctaaatcttgtctgcaaagcagctgctgttatcttctctttgctgtggttcatcttaattagaaagactattttatggtaggaggaagtatagtcccatttattttgattatactacatgagaaattctaaaatcagagggttgaccctataatttagagagaataggaattttcagaagtgaatgtgtgagactgggcacaatgccattgtaatgaagcataaggcatagacatgccacttggaaatacatataattttttatgtaatgagtctgggaagttgaggaaaacctctcaaggctttcaaaactttctcttctgtgttcaagaaatagatatgaagacatgaatcaagttactttcattcctaaggcttcagtcatctcatctgtggaaatcaggcacttggcttccacgatctctaaagtctatctaactccactatgctgtcattctaactcttgaaatttttggtaaccacagaacattctaatgaagaaacagcatattgtcccttattaccttaggggaagcccttgttcactgacagattgccatggctgattgccgctgctcttcactccaatgttattatggatatagggctttatttatttatggtagagttgtaggaaaacataacatctctatgaacatttcactattttgctaaaatattctggaattataggctctgataaataatgttaatattaatcttattataatgtaatagcatattttatgagcttaaattcaaaagtatcccaagtgactttgtaaaaggaattctatgtgaatatatgtgtgtgtgtatgtgtgtgtgtgcgtgcgtgcgcatgcatgtgtgggcgtgtgaagttttgcagcagcaatagaagttgtgatgatatctcaaataaattcagtgactttaatattcttcccttttaatccagagtaaagtattgtggtctgactgatctctttgatttataaatctgaaaaaacttctctttgcttaaggggttcaaattaccttagtataaaatgcaaacttcttaacataaaataaagtacacctcagtaccagaattctgttagcctgtgtaagctttaggtccactgtttctctacctgatacaatctgaaatccagccattctgacctactttcgaatgcctgaattttctattttctttccagtgttaagcctttccagtgtctctctcctttgacagaagtacacttcccttgcctccttgcccgcaaactccttttcattcaggtgtcagctagacacatttgactttcagtgagtgggttataatcctttcatgatatcagttctacatctgagcacaaagatagacctaagattttaattgattagttaactaattcatatttaatgagcatctactactactgtgtaaaaacgtcacaaggaaacataaatatgaacaagatataaacccttgtttaaaatagaaatgtggaaaacacagacttattaatagtatagaatatcacatgcgaaatccaagtgctatgaaggtttagaatagagggagttacattttgttgaatttagagagcaatttatgtggatgttaccatattcaaagtttgcaagctgtatttgccctaaagacctttagctctgaaaggtacctctcaggctgctcttgggtgatttggccaaatatcaagtgagcaggtcttggatccccagattccagttcagatggagcagctccactgtattctggggcttaaattttgaaaaccactgtgtttcgactgcaataatggtatattatgacactaatggatattctccaggtgtttttcactatcaagaaaattgatgtataacaaacgtatccccttgaagtggcacttatttccccagtcactgacatgaaacagtgattcatcaattcgtggccttaagtgatactgaggtaactcaagacactatacacttgtcaggtgcattcattttcttctattagtatttatcagaaattacatataacatcgtgatgtttaagaacagcttagtaccctatgttaattgcaaacatgtcaatattttgtagcaggaattctgggttttgaaagcaagagaaaaggacatttcccttaagaacgacaaattcctgaaatacctgtggaagaaaaatgacatcttaactacagtacgactgacccatgaactccacaggtttgaactgtgcagctctacatacatacagcttatttttcgactaaatgccatttggaaatacaatcttctcaggatgcaaaatttgcatattcagagggcatactttttgtaaatgtgtgttttgtagggctgactgctgggcttgagtatgtgcagatttggtcatacctgggggttctgtaaccagtcccccacgtgtaccaagggactgtattttcttcacttgaatatgtgtcatagtacatgatttaaactactttcaatttctgtcttaatcctgttttgaactaaactaagtatgcttctctaggattcaagtgttcactgtatgaggtaaattaactcttccagtgctctagggtagcaattaatgccccagaggaggtaaattgctaaatggtaccccacagctttcggaagactgattctgtgtcgaatggttatgttcctctctggtggagagtagattactcccagtggttctttataggtcaggatccattttcaagtgggaaattagatttcatctgattggcaagctaaagcttctgaggtgtgtcatacaatagtcacgattagcctattgaagacataaatgtcggttatggaagctcaaaaagacagtaaataaatatgaaggcatgaaacaaaatattgggcagtactgcatatttgaagttttgtaagcaagtgagatttgtattttatcatgagctggaattttatatctttacttagaagcatagactattagtggtactccacaaacaccacaaatagtattcattcctctcttcatttattaaaaaatatataaatagatatatagacatgcagaaaacttttactctcgcctcctctttatgcatggttttgtgtgtattgcttgaatactctcactgattttaaaacacagtgctttttctatggatcttactctttggaaattttactttattttgaaataaaaactactttactatatgttatttgctcataatgtacaaatagttttgagtgcctattaagtatgatgcactacacggtgaaaacaaagcctggaatcctgacttcttgagctttacattctaacgagaaaaacgaaaacaaagctacacacataaattattacattgtgaaaagtgcaaggaggaaaacaggtaaggtatgaggtccaaggtagacagcacctggggtcagggaggtgggaagcagccacagatgaagtcgccattgagcacctcattcataagaagacacgcttcatcccgaagagtgtgaaggagcagcctgtgaatggcagagtggggtcaagtgattaagtgcaaaatcccttgaggcaagaaatatgttttcatatctgaggaacttcaaaaatacccatgtgactagaacaagctgggtggtatgagttcagatggagggaaagttggtgtcaggtcatgtaaggccttgtaagctaaaaataaagaagctgaattctattctaagtctagtggaggaagggttttaggtaggggagtgacacaaactgaattatagcaaaaatagcaatgatattaaatattcacacagcactttttttttttttttttttttttgagacggagtctcgctctgttgccagactggagtgcagtggcacgatctcggctcactgtaacccccgcctcccgggttcaagagattctcctgcctcagcctcccaagtagctgggactacaggcgtgtgccaccacgcccagctaatttttgtatttttagtagagatggggtttcaccatgttggccaggatagtgtcgatctcttgacctcatgatccgcctgcctcgacctcccaaagtgctgggattacaggtgtgagccaccgcgcctggcccacataacacctatttataccagagagtagcaatggtattaaatatttacatagcacttataataggccaggcatttttctaaggaatcaacatgtactaattttttctaataatcttatgacatagaactaaagcacagagagattagatgacttccgtaaaattgtggagctaggatgttgctgaaccaggattcaaggctgggcagtcacttacctgtgtggtagctagtgttctatgaatctgtctctatcgtctatctaacttctgtatttccaatctatttacatcaataatttaactgttaaaggttgtgcataagcaccataaaatggcacttgagttcatgggaacagattatatttttcagagaaatcattgttagaacacccaggactgagctctaagtgactctaacagtagagactgggtagaatgatgaaactgtcaaaagaaattaaaattagtaacccagtaataagaggaaactcaggaggaagaggtggcgaggaagaggtggctgacataggggagagtcctaagacaaaatcagaggtcaatgctgcggagagttgaaccaaatgacacgagaatatttgctagattacattgtgggatgtgtccatgaccctgagaagggttttcatgaagtaggaagttgacagacaggatcaagggtggatgagagagaatgctgacttagaacagggaggcagctcttttgaatttggtgttgtgataaaagagaaaaacagctggagaagaatattgggtcgagggagaacagggagccactggggatgccgaagagaaaatgataatgaaaatgttggctatgtagaccttcttgaagggacaaagcaagagagaattcaaagaataaatggaaggttcagcctttgatggaagagggacattctttgatcatcatacaagagaaaaaaagttgcttgcagggttgataaaggatggaaaagggcgaatcatgagtaagatctaataccgtttgtaaggaaccacactctatgctaaatgttttacatatgttatttcaagtaattctttcaaaattttaaatcattattattttttaaatttttaattaacaggcagtggatcttaggctcagaagaattaagtgatttgcccccaactgcaaatccactaattaccagagctgaaaaattaaggcaatcagcctcactccaaagcgtgatcagagagctaaaaatttacttagttattgaccagtcaatttgaagcccggagaactaaggctgacttacagagtatatgcaactcactgctgacagagtttcgtttagaatgcagttctcttcactcctactctagtattcttttcactgtacttatctatttttttcaattgctttagaggcagtatacattttaaagtaaaaatatatgagtattaattataaactttattcactgaaaatgtagtggtaattaagggaggaaactgtaatgattaaaattataagaatcaaatataattggttttcaagagagaaaaaaataagttaaaggactccgtatgactactataaattctcctagtgagaacaccaagtatatacaattagtttaaaaaaagaattttccaagttctttattaacttttaatcagaatgcaaagataattagacacagcctgtttatgtatggaacaatacaatgaaggacagtgttctgctttttggaagacacatacactacaggaacctttgaacatgcaattcagaggaagtttaatccttctgttaacaaatctgattaaaaatagcagtggcaatatttcaaaagttacatgtgtgtgtttgttaaatatttcttcccaatgtaatcgttttttaatcttcaatttttttcttataaatggttgtcaaatttacaagcccttactataaaatcccaggagaacttttaaattccataagaaaactgtatggtttttattcagtcttattatttattgtatactttcactctaattatgtaaatgtggtatcttgcagaatttttgtttgttttctttcttttatccaactgcctccaatgcaccacttcatatgcatgtcttttactctagccattgtgtgttatcataatcatgtctacccagagttcaaatggcttaatacaggtgtcacctcacagcacctctgctcagatcctgcagactttgcctctctctaaggaccctcagcagggcccacaggattgagcccctgttcctcaaaatggtggccaaattaataataaaacttgttttggtttccctttttccttttcattccctcattcttcacacatgctctccaggatggcaaactccaatgaactaagcactaaaacacttatagtaattaaatttctacctggagaagcataaaggacagatacatgtgtctttacttttcatatctaagtgacaaaatgaatcttaccttatcaaaacattcacagacacacacacagacttttatgtcagtgttttacaactacttgtctaggtttgtgattttataaaacaaatgttttagattagttaaaatattagaatttaactcattatgcacaaatgaaaaatgtgaactataatatggcaatgagtcagttgtgttttctttaaattaatcacgtggtcaaatgaaattcacaaaagagcctggggcaaatattttttgatatctgccattagatatgaaaacatgtctattaacttaataagccagaaataaaggggctgcttccactggaagtgaaaatgagagtaagtgtgcaaagtaactgaagttaaaccagtggtactattcctaattgcagtcacactaaatggaagaattcttatggtctacatcaatgctatacattaaaacgtgtattggcaataatagtgtctataataatgggagtatccttatttttacttcaattttcctctcatcatataatttgctgtgtcagactcaggtgaaataaagagggatgtatatatggatatagatagatatgtatagatatatatacacatagatatttgcatactgatggtgatttttgtgcatgaaaaagtgataatgtgttttctactagatttaatcattttctcaaaattctgtgacatagtgagaatttagacctgagagttttttcttaaaataattttttttatccgttagtctagaattttttaaatgccagaattataaattcattttgagtttttgggatgtatttctgataataacatttttctaatcaagtataagttattagagtattaaatactttaataagtatacgttattaaaaaccatttatccggacaaggcacgtcaattgctttgaatctgcagggaagaaaccgtgtgtcacattactcttcagacaacaatcataagaaataaacctacaaacaccaaacttcaaaaaaaaaatcctgcacaaaaagtatttttgaaatcagatgatgggcccaagaagaccaaagggatttaggatatgtggtcaaagttgttctttgatgtgtgtttgtgtattcagcttgtccatccatcaagggctccacctgtcttggagatattgtccatcatttatttatgtgcagagagactaaagtccgaactgatcttcatttcagtcatgcactgaatataagaattgtggaaaacattttggagctaagatacaccctttttttctgaaaagagaagttgtacttcacaggcattttggagtcttccagctcagatttacttttggaaaatgacataaatttcatagataatcccctgatccatctttagacagacctcaacattttgtcaggtcaaattatgaaacagaatcttacataagttttctcaatcatatctttccttgaaagaccatagttaatttcaaaatagacagtatatgaaaatagctgccttgagaaatatcagttaaactccagcattgtatgagaaccaatgaacaaacaacattctcatctctgccaaagttttcaaggagagtgcatgatttcatcctttagccatggtgattcattgttgatgactaatatcatggatgctcacatttatggaaagtactgtattgacacacattgtactacctgctttatacacatcgcctaatttaatcctcataaaaataccatggggtaattattatcaaatatattttaggttaagtaacctactcacttatcttgtaagcggcagagcaaatgcagttatacatttcattctatgcctgcatgattcagaaaaataaaacaaaaacatgtaagcctttggtgtacttatatatcaaaaaccaatttctttaatataagagtttaaaaagctgtacataatactactgtagatgaaacaaagtgtaatggaagacagattgaaaggaaatttgttactattaggatgcttgcaatcaaataatggggataaaacaagcacatacattcctcatctctgtatagacttaacattttacagagtcctttgagagactttaattttattgtatcaaatttttcatgtctaagttatctattcctttcagtctattctgtatgtaactcaattgcctttttgcctttgctaacacagaaatccattaaaatttttaaattaatggacattttaattacatcttcttccttagtactaataaaaatttatatactatgtatatgaatatgcatctagatgactatttcaatatcaatatatgaggagataaaatgaattttccacaaactatgattctgtgtcatctaaacattagcttgcacaggccttttaaagaaagcagagtgaggactccctggccagtgttctctaccatctcttctgcctaccttcttttctctcatggaagtaagaaaagaatccatttcatcaaaggttgaacattccacttcatccctgaattctctcttgctttgagttcttaggtacatctatattagatatcactttctcctctgcatccccaatgcccttttccctcctcagcatacctgatcctctgtccttgctgacctttgtatgtgtgtgttttctcccttgatgacatatccctcttcagctattgctctatttatattcagaatcccaggcaagcaacataaatagatgtctccaaggagtaagtgatttaattagcttgaagtattatatatattttcacacacacagacataaacatatatatgtatgtatgcatataaaacaaataagataaataactggaaaatatatgcaatgaagtcagtgaattagcagatgagataaacatcccagattggtatggtattgtacggtacggtgtggtatggtatggtttggtaccacaaggtctagtgtttagagctggctctgccagtcactatccctttgatactgatcaaatcatacaaaatcagtttcttcatccataataaagccttcccttgttactcagagttgctgttccagtcaaaaataaaatgttaatttatgatacagaccttgataagctgtatgaaccttacatgatactaatgtagtaagatgcaccacggttcattcagataagtgtcccagtgagtcctcagttttcacaaagtcatttcctatccccagttttgtttatttgtgcacctctgcatttacctagaacaagaattgttatattctaagtaattgccaagaagtatggtaacaaattcactactacttgattcttcagtggagaaaattatatacatatatatatatatatagatgcttgcctaaatgatatgccattcttccatacttttaaatactgtaacttgtgttattgaattaagccagccagtcaaaagcttgaaattaaacatagtattttcctatgaaatatattttttaacattataaaataaaatttggaataaaagcattatgtatatatatatatatatatatacatatatatatatactcataactcttcattcatttttgtgaatcagtctcattcgtagttttattgtacttccaaatcttcatttttctttggatcattttcctttgccagcattacgtgtgtgtatgtgtgtgtatgtgtgttttaaaagggccataagaggaaaacagcaagaagtctgtctcctaactttgaaacctaaattttagttttctttcacacaggaagtcatcttgtggatctaataatattatgaagttattctctttttgatggacatttaggaatgttttgatgtttcgtacaataattcaagttgcaagaaataagcacacacattttgcaagtacatctatgggatatgttctaaaaaattaaagtgcattctttgtcccttaacctatgatacgggcattctttattttgatagatgctgcagaattgtcttctaataagtcataggaatttacgttttcagttaaaatgtataacagttcttgttatataaaatgtataacagaaaggacttttgatttctatccatctgaatgatgaaaaatagtaagttatttattaaattattatttaccttcacatatgtatagtggaacactgagcatatgtttaaaagctacttgagtttttaaaatctgtaatctgtgctttactcattttctttattggctgttggttattttttactgatttttgatgcccctatcttgttaagaaaataatatttttataatatatcacatttatcacaagttactgtttatctttgagttttcttattgaattttgacatacacaaatggctcatatttactctttttatcagcagtgtctttgttagttcctggatttgggatatgcttagaaaagtttatcctaaacaaagacttgtgtacttttaatttattgtcatgtttaaatcgttgctaaatctggaatttattctggagtaagaagtgaagtagagttctaactttactttgattttgttttgttcttattgttgtttttcttccagatttgttatctagttgtataaaaaccaatgattaaaaaaaaaaagttttttcttgctgggcaaggtggcttacgactgtaatcccagcactttttgggaggccggggcaggtggatcacttgaggtcaggagttcaagacaagcctggccaataggtgaaaccccatctctactttaaaaaaaaaaaaaaaaaaaaaaaaaaaaattagccggcgtgacagcatgtgcctgtaatcccagctacttgggaggctgatgcaagagattcgtttgtacccagcatgcggaggttgcagtgagccgaaattatgccgctgcactccagcctgggggacagagcgagactccttttcaaaaaagagaaaaaggaaaaaaaaaacatttttccttaatgattttcactgtcaaaattattatttattaattaaatatgtgtgcattttacaagatgtcgagactttgtatcatttgtttgtctattcagacaccagcaccaaactgtgaattaatatagccttaacatatgctgaagcatttggtagaactagtcgccactcattaatctttttttcttttgaatactaaatttttatgtaaattttaatatcagcgtgccttgttccaaaggaaaccacaaaataataaagacaaagacaaatgaaagaactccccattatttgtatggcaaatgtgtgtacttatagaataatttggtgatttatatttgttatgtttataatatggatccttatccaaaacgtgcaaaagcccatttttatatgtaccttaataaagttttaagatttctttgtgatctatcaaatttattgttaatttaaaagcttgatagagctatactataaattgtatttccttaattatgttgcaatagtaaatgttgtttgtatatgatagctaagaatttttaaaattttaattttatattaagcatctaagatgaattattctagaagatgtaataatgatttttttctcctcttcaattttctatatagctaatcataccataattatcattataattttataattctgctccatccattttctggtgtgcatctgctatttcatcttttttgcctatggactacccttgcaaaatgttaaataatggtgataggagcctcaataatgaggcttttgctactttaacaacatacagtgttaaaatataactctcttgttccatgtgtatatttacatatctatccttttaaacttatgtaagttattttgcaatataatatatgccagtattagtttttttttttttttttttttgagatggagtctcgctctgttgcccaggctggagtgcagtggcatgatctccgctcactgcaagctccgcctcccgggttcatgccattctcctgcctcagcctcccgagtagctgggactacaggtacccgccaccgcgccagctaatttttttattttttttgtatttttagtagaaacggggtttcaccatggtctcgatctcctgaccttgtgatccgcccacctcggcctcccaaaggccagtattagttcttttgtgtcatttaaaaatattttgccagctgggcgtggtggctcatggctgtaatcgcagcactgtggtaggccgaggtgggcggattaccctctgaggtcaggagtttgagaccagcctggccaacatggtgaaaccccgtctctactttaaaaaaatgcaaaaattagctgtgcatagtggcacatgcctgtaatccaagctactcgtgaggctgaggcgggagaattgcttgaacctgggatggggaggttgcagtaagccaagatcgcgccactgcactccagcctgggcgacagagtgaaactccatctcaaaaaaaaaaaaagaaaaaattgcatatataaatttttaaaaatatgttatcgttttaattagaggagtcagagagaaataaaggtaattgtaaagaagaccctatatttacaaaataggacaatgaagaggatattagttggggacagaatgagtggaaagaacagatgttaaaatctatcttaattaagaagcacacttaaaggtccatttataacgctctcagtactcatttttaccctggccatatctttatcttgagtaactaatgaagtagaatacgacctatgcagttatgctaaagaagtttcgcgaattcctaatttcttttcagccaatgccatagaatggcttatatgtattataaatggttttcagagtagcagattttctaacacttaaatggacacaaaaagataacaaaccaaaaagagatagacagataaaacacttgaaccatttcatacaaaatttctctgagatttgtctactttttaatttatttgattacctatattaccattcctccatttacatgaacaaataaaagtttattgaaaagttcaccacatgttttaaaagcaactgaaaccaattttaatttctaagaagtaatgttattttcatgttcccaaatgatcacttcaaagaggcgagtaagaggcgagtaagaaggaatataagctctattgttaataaacctagacgtaccctaaatgaagaccaggagtgagtgaaggttggtaatttacttagtagagttgaggaacatctactctaggattctccacaggagttcagctcaaatgatcatttgaaaaatgctaaggatgcgaagagagagaaggcaccaaaaagaaggcaattggaaagcaatggaggtacagaaaaactcttttccctcatgtttgtataagagacaatagaactttgggttctcaccacaaaccttgttcattcagatgactacccatcttccagctgtctatgagacagatcacatattacctgaaaaaatcgtgtgaggagctctggagaaaggcatgtgataataagaagggtgaaactagtagagaaaattaaaacattaagggaaagtcagcatgctgaatggtaagattatccacttcgctgtacttcagaaacatggcagacattgaaaaatccttctcagggcaaatagatccaccttggagaaaagacatttaactgcagacatttggggatcttccacaaacatctaagtaactaactaacgtttacaaccatgaaaccgtgaagtggacacgattctcttcagtatcacagagtctctatttagctatttggtgcctcgccttaagccagaaacaagacttctaagtatctccaggcatttgaggaaaccttcagacatataaggagagacagtaactatacacagaaaaataaaaggaacttaacacatacacacacacacacacacacacacacacttaggcatgaggtcaaagcatcaaaggaagcaaagtgagagaagatttgatgtctttatgaaagcagaattttcttttttaacaaatattagaaatatgttgaaaaaaatggaggcaatctcccataaaatacaccagaaagataaaaggatggagtatatgaagcagtataaactcaaagcgtccaaaatcctagaattaagattcctggaagaataaaggaaaaaataaaatgatggtaaaaaattgccataaatataacagagaaaatattcccaagactgacagacatcagtctccagacataaaacataattgagaaattttatagaattggggtacatacggaagatccacaatggcttccagaaataaaaggtcatatacacgttatctggaattgtatcagaaacaccattctgaaaattcgaagtaactggatgaaatctttcaaaaagttgaagaaaaatagtttttaatcacattcctaaacaggtttgagaatgttttaaaactttcaatcatgtagtttttcaaaatgtgtgtgtatgtactttttctggtccaaggatatatttcatttaaacaggggtgtcaaccaagaaagaggaaggtatatgaaatagttgaagttgttgcctttgggaagcaaaatagacaaaaaagataatggttacagaactagggttggctttgtttttttgtttacgtttttaatcaaatttggcttttaaagttgtatatgtgattatgaaaaaaaaagtggctttaaatgttctaattcaaaagtaagttaattaaaaatatctaaaatcacaaatgataaagagcttccaaatttaaagcatttatgaagtgcacagattttaccagaaattcactcacaaatcttagcaatctcgatagtcatagaaatatttaatgtcttctcactaaatgtgttgtatatccttgctgttaaaagatcagttatccttatacttacataaatatgctacaaaagctaagaaaaacgggatgactagaaagatattcacaagaggccacattatcattaaaaattcactttagctgtgaggaaggatttaaggaaagagcctgttcttagtaggaggcctttgatgtagctgaataagtgtgtaactgatgtgagtggaacctttttaattgacactgacaatgaaagcaaatcttctgggctgctcatcagagtcagaggggatatgggaaattaaatattgtgttctagctttttctaaagcctataaagataatcaaacaagaggcatcttttaaaatctatttgtgagttgatgccattcatacggattaaaataaatagtacttgaatatatgtggttttggtttattttaagcgtcttttcaacaattttatgattttgtaaatggaatttacaactaagtaagtgaatgtgcaactacagaatttgtttaaaatctgatgaagtattatcagatatttacgctgatatgctagtttaaaaattctcatatgctagtttatatatttccctgaagaaaatatattaaagtgtgattcagatattatttcaactgctgatagaaccacaaagaaacacattacatattgcctttgaaagatacactggaaaatttatttttaaaacttcacttgtgttcacaaaaacaaaacttcttaaagcaatgtcatttccctcatttcactgtttcaataaacaatacatttactaactagttcattgcttctctgttaccagactatctctcaacaattatttcaaccattgcttttactttcctggttgaaaagaaatgcttttgctctttctctgcactactgtcaccagtcatattgcaggagtatggactccagccagaataaacctctgtgacatctgcagagacatgcggagaccagagcagactcacccaaacaatcacagataatcttcttccagctaaaaccacacactgagcttcagcaccagtcctgtcagagaagggattagtgggtgccttttgctgtttgcggtgtgaattacattcatctaatatgaggctggattgaatcctagccttatggtcctatgatgaaagaataataaaagattggtggcataaagaatctaacagttcctattctccgaattataattagttattactacagtttatagtttcttatggcaaattttgtgagatttgaggcatgtttaatgaataactctgattgcttttaaaaaggcaaccaaacaatgaaataaatatttttcccatttaagtcagttatttaaacatacttgattttgtagatgtagattcgatttcatcgtgtgacccagtgtacaacactgaatgatattaagcaaggtctcctgatgagaaattcttataatctcctataacttactcttatgtaaattcccttaaactatcccttcatcactgtatgccagatacgtgggaaaatctcccataggttaaaccttcaccttctctttgccttcaccctaacagaaaaaaagtttgctgaagaaagtcacacaaccaggttgactggttttactttaaaatcatgagcgtataactgccaccaaattgacactcagcattgtagggtatcttgctacctctccccagtaagatagggttcccactcttttagttggctgcttgccttatgtttcagtaaaaacaaaactataagagcgagccaccataatctctccacaacctaatttagaagtttgctagtacacatatctatagtctttgctttttacctctggatacaatggggaaaaaaattgtagcttctttttttaagtttaattgcacttcttgtgctccgaattccttactctcttagagtcttacagatttaatctattcgttacctttgttctttttcttcactgctcatctctcttctaaataatcattctcttcagaatatacagaatacaacatgctataatatttctcatcgaaagcaaacacataaataaaaaaagaaatgttaaaaaaaactttacaccataagggttttcagtttccctcattttttggctttctacctatcaaaacttcttgtaagagttttctatattggctatttttattttctgttatttcatctgcatgtattgttattgttttttccagtttatattttaatcaagaaataattcccagactttggtatatttctcatgccccatgacttatctgaacacattgttacggtataaatgcatgtgtctcatccaaatctctattgttgtaaccaaagacccaatttgataatattaagaggtagggactttagggagtgattatgtcatgaaggctccatctgccctcatgaatagtattaaaatcctaattttagggctcaagagaactagctaagcccttttgcccttctgccttttccaccatgtcaggatatagcattagtcccctctggaggccactgcattcaaagcatcatcttagaaccagagactgggttctccccagacattaaacctgcaggttccttgatcttggccttctcagcctccagaaatgtgagaaaataaatttccattcttatataaaatatacagcctccggtattttgttttagcagcacaaatggtctcatacacacattggcaatgtaatgaaactcagaaaaactctaggctctccactgagtctaagttccatttcattttggcttcctcacttcagctgcttttattgatgtcaccagttgccaaattcaacacagagcaatgtgctctcttttgtactttgaattatacaatactgtggaggattttcgcctataaaagtttttccatcttagcccaagtgttccacatgcttctcgttttctcccattcttgcttacttgttctcctcaaggtccttttctgttttctgccgtctacctgctgagtgtctaggtttaggctcctttcaatttctatttgctctcttactttaagtaccacctatatactgatgactattaagaatatatctctgaccctgatggctcccttaatcttttgggtcatatatccaactgcatgcttggcagttctactggattgtctaatgagaatctgaaacatactatgtccaaggagtaactctagacccctcccagtcactaccggccactctctacagccacttgatcaactttttatcttgccaacttctctgtctcagtaaacattatctctgtctacccagttgctcaaattaaaagcctggaataagagtctttatctttaatgatatatactaatatatttagagtaaacttatatgatgtctaagatttgccttgtaataattagggcaggggctataaaagaaacattcatcatgagttattaattgttgaagttggattatgagtaatataacatgcaaattctgattcaataggcccaacgtggggcctgagatgctgcacttcaaacaagctttgtgctttcagtacctcctacctcatccacaattcttatgttactatgctacttattttcttaatgggaatttcataatacttatctgcacttacttatctgttatccttgttaattttctgcctttctccctataagggcatgcattgtatatgtcttacttatcgccacatcagaccagctcagtgcttggagagtaggtgctttataaatatttataacaatgttatggagggcaatacaggaaataataacaggtgaacaataggtgtagatgttagtgcagtgccatgaaactgaattttgtaatcttggttgtgagattacaaatgatatttgagtttcactctcaaaattctggattaattggcttgaaatgttgccttttgcagagcttcccaggttaattctaatgtgccagcaaagttaagaaccactgccttagatcatgacgatgatgatgatgatggtgatgatgatgatgatgatgacaatgacgacaacaaacctaccatccactttgctctttgcttggagctatttcaagtactttatgtgcattaccttatattattcttataagaatcctatgaagtagatactgctatggttatgttagaactgaggaaattgagatgtagaaatggtatataatttccttaagatcaaccaatttatacatcatgaagccagcatttaaccactatttaaaccaaggcaatccgagtccatacccttagccattgacttaagatgatggcatacatgttacaagcactgggaaacaaaattgtgtgtatttttatttctaacatatcactcatctaaacaatgtgaaacacaatactcaaatatggcaaatgaaggagtaaactttcttgttttccctaaaatgacgactttgggactacttatacatttgctgaagcaaagtaatcattttaggtcccaaagctatcattttagagaaatcaagaaagcagagagacagagataaaaatacaaggaccatcatgaattatcaataactcaagaattactgtgcttggtttgaacaactagagcaacagacatgagccctgctcttcgcagagattgttctggtcttctctggctctcctttgcctgcatcccacaaggcacagtgtgtgtggggcctaggagacttgcctatcttgagcctgtgcctctacacacctcttttaaaccaatgctcttagtacccagaaccttgggattttctgcagaatgggtgcctctttcctgggtatgttttctcagtgaagagtaaaggtaattgtttgagaggagggtgaaattgtaatttggaccaattaactggggactaatttgtgtgtgtgtttcagaggcttatttggcatatgtatttgagggatgttatcagggaggaaattggggtacagactttggacatctacttgcattctcaccctaaaggtgcatctgcggtcaaattccaattccagagataaggtcaaggagttaatcttaagaaagtaaagggtaaatcttgaactgaagatgagactctagaaatactctgttatcttaggtatttgaccaatggcaacttcttccctattccattctcagactccttgaggaatttggcaataggtaacgctactcatgttaagttgctataagatagaaatggggcttccattgttcactcttcctgtgttaggagaaccaatattgcagtttgtcatcttgtggacattacattctcaccaaagaagcctcctttgcctcctccaactctgtttgacctagagattgacaaaggaatctgcttaggatcacttgggattcttctttctataggcatgtgggacgataatttgggtcacgtcctgagattttaaataaatttcaaaagtgcaatgaggagtcagctttgtaaaagaaaaaaaaagacacttccataacagaatttttttgtagctttcaaatttagctaagcatttgtttcctactgaataatcaacacttacagagcctgaagttataaatgtaagctgttttaaaattatgtacagactttctgcaattattttttctagaacaagaaagtgtattctctttccttttcaggtaacttaaaaagagctgaatatgttgaacttaatgtgctttatgagaatgctgacttcttaaatgaaaataaaaaatattaattttctgcttaggaaatgttgagaacaatcagtctcataatgattttgcattttaactgagcatatccctgtatactgcaaaaaatacactcaaattgcccatagctaccatgaaaggtaatgatgcagtacacttaattactgtttagcagtgcttttttatttgagtattttgaaatattagtaaaagcgttatatctcatatttttatgaaggacttcaataaaaatgtggtaatggagatcggttaaataagaatttcaaaactagaagtgattttttttctctaaaagtaactgatgtcgtctttttagaaaagagaagaacaaaattaccatggaaagcatttctggttttgtctcttcattattcttggcacaattaccaaagatgttttgaagatcttggccatcatagtaactgatcttatctttaaccatcataaaaaatttctggtgtattaaatgtaccaaaatattttaaaatattttttcagttatttgttttgcatttcccattactctacctatgtataccatgttgagaaacagggacaaattattctttgtttgtatcatttcttactgtatttacacataagtacatatgttactaacttcaaagaaaaaaaatatttcttgcttcttatgcacgttctttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctgcacgttcttatatactcacctcccacaatgactctgggcttgaccatgtttctttggcccatgagatatcagcgaacatgtcacaagcagagactcaatgcactttggcacattgggacatgcttttttaatcattgacctgagattgctacataggaaatatcaaatctattaggcttttgttcacaaatttgagaacaaatctataaggatcttattgaagaattgccatagtagagttacaatattaatcaaaaatatattaacttcttttttaaattggatgagaccatgtatcctagagaaagactactaactttagaattctgtctcctctttccagatatgagaccttggggaggtcatttaaactctttgtgcctgcttcttcatttgtaaaatggtgataataacagtacctaccttgtaaggtttttatggggaactaaatgagttaatattttacagtgcttaaaatattatagggggtacataaatataatagttgtcaaataaacagagaaggattagacatcggggttttatgaggacaagctctttgtaaaagttcaaagacctatatcagttacatagagagtaaagtaccagaaagaagagctaaagataagggcttataagattcattttattttgggaagaaatctcagggacagaagtaaaggactagagagacaaagaaggagggaaacacaaatacaatcgtatttttttactgctggtccgctgggcttgatcttgcctagggctctgtagactgcgacttagaaccatttgtcccagggaaaatcagaaggcagcgtttatccatgagctctcatccttccctgattaaggtttgcccccatatgataataacttctttggaacttgaatgttgttaataaaggagttgtggttgagtttcttcaggttgctgttttggtagcattaaagaaagcctattgaaaatatcaagatatttttctggaaagcttgagcaaggtattgtcaggttaaacctgttggaaacttatgacaaagtaatgcatgaaataaagggtagactgaaagaatatgaggcaagaactaagaagatgcaatgggggaacaagtagatgtcacctagacttccagacgtttgcatcttaacattgcagaagcaggtgcaatcgaacagaaaaacaagaaagaatagtgcatagaaaaaggaagatggtaacctacttgaagagatgaaaggaataaaataattttcatgataggcaggaagaagagtaattggggaaagcattgatttgctgaatgttttcctgtgctatttcatttttatctaatttttgatagagaagtttgcttgaaaacaaggtaatttctgaggttttctgaaaactatgtcaatgttcattaggctacaccaaacttactattaataaaattgcataattactttataaagtacatataattacttttcaggtagctccatctagcaatttaacaaataaaatagataagtaacatttaaaaattttgacaccaacctgaccatggagatgcatagaattctgtaaataggataattcacttaataagccagaggtgataatccaatctccatatcaggatctgcttaaacaaataaagttagcagtcctcattagtgctgtgaactgtacttagatgcttttagaacggtgctgccatgagttatgactaaccgagaaaaatgtattctatagccaaatgaaatcagaaaaattatttttaaaaaatatcaaaccatagatgaagaatttgaaacgactacataaaacctttgaaaattaactcccaatgtaacctatgagattatttttagttaaaaaatatgattttccccttcactgataattttctccaaaaatctctttcaaccttttgaaataccattatagctgtaaagccttctggcatagctggcattttcattgaactcattgattaatttagtatcatggaaacaatgtgaatctgtgtgaaatagctacagattgtgagagaagttggtgtactttattctgaaatgtaaaaataatatgctgcacaagcatgctgattttaaggaagccatcagtatcatagactgattaattctgtgttgctttgactgctaaaatgtgctcttccaatcaatttcaatccaattaataaaaattataaactggatttgaatatctatttaacattaggtcttccatgcagtttcacatactgtatatcacttcacaagcagtatggcatactggaaaggtcctcaaaatgggagtcaggtagctggtttttaacggcatttctgatgaaaatgatctggtggaaaatttgggatacctttctgcatttacgtattatttatttcataaaaaattcagctacatgattttaaataccccatacattctaaattgtaggatataatttaatatagattcactttttggtgtgacctaggtgaatctgatctttcaaattactagtttcaaactttacacttacacatttcccactgctaattggtaggaaattaacttggtatatttcttatttcttctgttttattagttttgtttttataattttgatttcctttgataaattctgaccatagacattttgagtaaaggcacaatatatcatttggacaatagtcttgttttcatttggatgttaactatcactatgaaagtggagatgccttttttggaagagttatcatatctagagtcagtatctctggcttttttatgtgttagcctcagcaaggtttttgatagcataataagtatcaatgaattaggttaattttttcatagagaatggaaaaatcttaccctcaacctgtttgttagctgtaatgtaaaagagtgtcactgattcgatattgagctttggctcatgctcagatggcttagacagatgggccatacaagactctgggcatccaaagtctcctgcggagaaaggaacaaaaaagaaatttctgaaattcactgagcatcttagaaaatacccaaagaaatatatcagaaagtaaaagtaaaataatgcaaaatgtggtacataaagtgaattgtgtgctcctcttcccagaaaaattagcaaagttaatgccattctaaacccaatcatattgttagaactttcgttgtacagaaattatttctgcttattgacatatgaagatcagtggagcacaagactcctagcttgaaacatttgatcaagcagtgaagatatccagcatatcataaaatgagaatcataaaaccatgctgaaggagtttgtgagtttagccttttctgagtcatcaaagacaaatacttattaatagaattgtatgttataatttattatatgaaatttcagattttattttgagctaccatatcctctgtaagtattaaatttattagtagttaaatatttgaaaataaaccaaaaggtatttgttctccatgtctttttgaatcaagtatcattgtgtaatcttatgtagagaaagagtactttgtaattgatcagtttattaataagcacaatgtttcttacaagagacagccaagactaatggttaaaaaaaaatgtacatacacacatactcctcagtgaagaaacagaattgggtttaaagttgggactatgccttttgtcttctgaaaggccttttgactccttgactgtgttagtcttttttcgatgtaattattacttcccctaccataatgtcatcacacttcagtagtttatttgcctgattgagcataataataattgagggcggtaaatgggatgatctggttcactattttatcatcagtgtttggagcaagccagaaacatagttggtcttcagtatatttggtgaatgaataagtccttatttgtatagtcactagactatacattgtcaatcaaagtggcgcagcatatacatgttaagctgaactcaacttttcactgatccaatttgtgctgcacccttccattgtatgaaatcaccatattccatttttttttctaccactaggtttccttccagctctaacatttcttaattctactgatataaattattcataactcctattgcttgtaatcttgttgctcttccagggctagaaaagtcctaaagggcttgcctagggattaaagttaattccctacagtattcccacctgtacagagccatggcatgggtagtgctgccccaggggaataatcttgggtttatcttggttttaaaactggtaactgaaaaaacaaaacaaaacaaaatgcaaagaatacccacacatcccaatcaagtgacatatatgaatgtttgtttataattcagctaagaatagttaattcacgtcatgcctcatgattaagtgcaaaccatttcaaaatatgaaacaaaacaaaagataatttaaagtccagccaagtaatctctcttgtacttgaatttggatgagatttatttgatcttctcacctaaattccatttataattagggatactcttgcttttctgctgtctcctcactggagaaccaaatggctggagattgactgattactgatcccttggggtttcagagaagctgctttctcataatatcagagttgaaatagttttcattccgttgcaaagatatatgttttaaaatgcttacagtaatgggttgttaactctatccttccctggatgaggtttctatagtaagctgtcattgtattacaactgttttaaaggatagataaagtaaaccaccttctaggtagtaaatggcaaacaatgtgtttccattattgaatttttattttcataagcatatcacatacaagtagtttaaaatcagatagtactaaaacaggcttataatgaaaaatagcagattactggcctcattccctgctggccttatccccaacaggacaacttgctgtcctgctccctgggtcaatagctttcactttcttagctgtttcttctggtgtttactcttatattcataaataaaatatatttactagtatttctgaataagtatattttatacatgtatttattttctatcctccaacacccaaactcccatgctcatccctcctcccctccatttgtcccattatagaatatatcaaaagtttgaattaaagcaatgttcaatgctcacattattttgggtacatagctactgtttaaaattaaatcacttggaatactgtaacttcacattatgttttatgttttatttgtatttgtattaatttatttttttgaaacagagtctagctctgtcgcccaggctggaggacagtggcatgatcttggctcactgaaacctctgcctcctgggctcaagtgattctcctacctcagcctcccgagtagctgggattacaggcgcctgccaccatgcctggctaattttggtgtttcagtagagacggggtttcaccatgttggagactggtcttgaactcctgatctcacgttatccacccaccttggcctcccaaagtgttgggattacaggcgtgagccaccgtgcctggtccacattctgtttcatataacttgttattgtctttattgtaaataattgcctcattttcatattggctatattttctctgtatcattagttcttttccaaaaattttagcagtatcatataatgcttcagagaatgatataattcatgaaatctgtaatctagcatgttatttcctctttgaaatagtgtgcccctcaaataccttgacattttcctttaaggttgtggtttgagatagagggaagactggactcaagttcttgtttgctttcaagaactcaccaagtgaagggagaatgcccctaaaatagagaagccaaagacactctcacccaaaacaaaccccaaatcacagtccccacccctaccctataaaaagcactcccaagtcaagcctcgtttaggaaaacagaatttgaggaaaacatctttgaagctgtaatttaccagcccttgatctttgaggaagatgagaagtgaataatgcccatgtgtttttcttactttccaagtgaggtctggggcttttgggctttaacttttctggatttaacttccagagcacctgcactggaggtcatagttagagcagaaactattcaacccaaaaccaccagagagaacaagagcagacattcaagatccttgtcagctgcctcctgccccaggtgactcacagaaacaagcttagaacagcctactccccttcagccctagaggtgtctcagtttatgtattcattattccctttcatttgtttcttctctacttcttccggatgggtagaccttggaagaggatgccagtcttcctagtactttctcattttggtaggacaaatggtcagtttcatgaagtaatatgtttactcttgctttcttatttcataaagagatgattccttgagacttagctcatgtgttcaaaaatagactggttgtgcccaaaccctactgcatagtagatgggacttaatatttccatcaggctgtgcaccttcttttccaccttgttctttggcatctatgtttctggctgttttattcctcattttggtggagaaatgaggcctcaacctcctgggctgaggcaggagcctccaccagcttcctaagaaagggtgcacccaggagacaaaattctgagacttgtatgtcaaagaattcctttagtttacctttcctctcgataaatctagacatttagggaaaaataatttttcttcaggatgctaaaggtatttattttacagttttctgtcatcttatttttaagatgacctattctgagttctgatttttttatatcatgtgtgtgcatgagtgtgtgtgtgtgtgtgtgtattctttatttgaattttctaaaagcttttggtatcttctcttgatatgttttagtttctttttattttttttttaatttttaacatttattttatattttttcttctcgggaatgcttttggccgggcatgaggtctcacgttggtaatcctcgcactttgagacgctgaggcaggaggatcccttgagcccaggagtttgagaccagcctgggcaacatggcaaaaccctgtttctacaaaaagaaatgcaaaaaattagctaggcatggtggtgcatgcctgtagttccagctacaagggagtatgaggtgggaggatcacctgagcccgggaggttgaggctgcagcgagccatgactgtgccactgtactccagcctgggtgacagagtgagattctatctttaaaaaaataatatttgtgggtatatagtaggtgtatatatttatggggtacatgagatattttgatgcaggggtacatgagatattttgatgcaggcatgcaatgtggataagcacatcatggggaatgggggatccatcccctcaggcatttatcctttgagttacaaacaacccaatcacactctgtaagttatttaaaaatgtacatttaggctattattgagtatagtcaccctattgtgctatcaaatagtaggtcttattcattcttcctattatttttttgtacctgttaaccatctctaactcctcaccagccccccactacccttttcagcatctggtaaccttccttctactctctatgtccatgggttcaattgttttgatttttagatctcacaaataagcaagaatgtgtgatgtttgtctttctgtgcctggcttgattgtagatcttgctgtggctcctttcaatctgttgtcagaagaagatgcagagacaagcatctagagaggaaagaaaagtcacatagcatacaggggatcctgacttcagaagaactggctttccaaacaaattaatagcacaagtgttgaaaggccaaaacaaaacaaaaaaactataaaatttctaagtttactcatcctatctgtggtgaaataacagtgtctttgtcacgtgattattatattcgcaaaaggcttgacttattttcagacatcaatatagcaaaaatcaggcacaacattatttttattatggagcaaattgtaggaaatagtcacacacacacacacacacacacacacacacaattttattccctatataaacctaaagaggactgtcctaaagaggacatctgtgttttagttttgcttcaaaactgaaaactgatgttcttaagttctggaaaattttattaatttttcttcttcttatctctaccattgtcttaattctttttgtaattcctagaattactttttcctactatcttttctatccttttttctgtctttgtctttttgttattctttctggaaattttcctcaaattttgtccaattcatatcaacttttatttttaattttaaattgtatagcttttattttaaaataagagctttttcttgtttgttttctttccctcctttttctatagcagctgttctatttttatacatgtaacatttttatcatccctgcattgtcttttctctgagccatatttctttttttcttttttcttttcttttttctttttttttttttttgagacagagtcttactctgtcactcaggctggagtgcagtggcaagatctcagctcactgcaagctctgccttccgggttctagcagttcttcctgcctcagtttgccgagtagctgggattacaggtccccactaccacgcccagctaaatttgtatttttagtagagacaggattccaccatgttggccaggctgatctcaaactcctgacctcaggtgatcctcccaccttggcctcccaaagtgctacgattacagatgtgagccatagagcccagccccgtatttctttagttttggtctctgcctttcatattgtattctggtctcaccctaaacttgcctaataatttttagtaattaaaaagtaatattttacttttagtaaatattccaaaagtaattgtgcaatattactttgttaatatttttaaatttacttctagtaattaaaaaagtaaatattttgctcttcgtaaatatgtaaatacaaaagtaaatattactttgtaaatatttgtaaatttacttttagtaattaaaaaagtaaatattttacttttagtaaatacacaaatagtacaaggcattagaaactaggtgccacattaactgggtgatcaaacttagtatcaccactaatggaacatatggacatgatggactgtaggatgagacccattgacgactgcaaagtgtcacaacataaaccgaatctaatcaggaggaaaaaatcagacaagttcagattgtggccaattctacaaagcaacctgcttaaactcttcaagtatgtcactcatgaaattaaaatatatgtatatatatacacactatatatatatattctttcatgtaataaaatacatatattttcatgaaataaaaatatatatttttttcatgaaataaaaatatatatattttttcatgaaataaatatatatataagtctagattgtggcaaattctacaaagcgactcacttaaactcttcaagtgtgctattcatgaaataaactaatatatattattatattattatacatattataatacgtattttagctgggtgtggtggctcgcgcctgtaatcccagcactttgggaggccgaggtgggcggatcaaggggtcaagagattgagaccatcctggccaacatggtgaaaccccatctctactaaaaatacaaaaattagccggacacggtggcacgtgcctgtagtcccagctactcaggaggctgaggcaggagaattgcttgaacctggcaggcagagattacagtgagccgagatcgcgccactgcactccagcctggcaacatagtgagactctgtctaaaaaatatatatattattatatatcgtaaatatatattatattatatatttagtatatatatttattatatattttatatatataaaataggctggggatgttttatagttaaaaggacatgacaagtaaatgtgatgcctgcttcttgattgatcctgggacgaagtggctgagaagcatgatctggggtgagtaaccaataaacaaagcagcctactgtgattctgttggaagaaagccttgctttttgtgctggagcatcgtcagcacttagatgatgtgagcttttctacaacccaaccatctgctttttatctttcaaaacatctctcctcatatcttacatactatagcctcccctgtgtgttttttgtgggtttatattattcttattatagttttatgagattgccagagggagaaataatttatgttcagtatgtcttattaaatggaagtcaaatatatttttaaggatgtaacttcttttctacagccccaactttgatcttatacattaagcataaatctaagctaattctaatttctagtcaaaggttcaaatgactatcaattcacttcaacaaaatacatacctgtggtatttggttttctgttcccgcattagtttgctacagatcatggcttccagctccatctatttccctgcaaagaacacggtttttgttgttgttgttgttgttgttgttggctaaatgattagaacccatggacacatacaggagaacaacacacactgggactttttggaggatagagggtagaaggaagagaggatcagaaaaaataatgaacgtgtactaggcttaatacctgggtaatgaaacaagctgtacaacaaaaccccatgaaacaagtttacataacaaacctgcacttgtacccccgaacttaaaataaaagttaaagaaaaaagaaattcataccaatttaattgcttttaataaattttggtgagtagtattaagaaatcatatgtatttacatgataatggttaaatgcttgtgtgcaggtatgttagaataacctagaatttagtactttggttaaggtccaccttggagattggtgtatgccttaagcttcaatttcccaacttttaaatgtcattaataataattataaatatttcatggtatttttgagaaataatacatgccaatgacttatgacattaataaattttatgatttctgtaatattatcttcataatgatcaatgatgtaatatcattgagaagtatcagaaagtagagatgtttcacaaacaaataaaaaatcaaacaaaacccaaaattggaatgtgcattataatgatgtaaaggataaagaaggatgaatcaaaattaattacaaataatcctctaaacgtttgaccaaatcagaattcatatttctccttcagataaaatttctctttttcggttgaaagcacagagaaagaaagtggaaatttcagatgttggagaaaatattcggaatttatgtgacactggataatactaaatgctcattctggtaactgcaaccttctttcaatattcctctttcctagtaaaaccctaagcatcacacaagaatatattttttcttctgcttttctccctgattttggaacagtttcttaacattcccacaaaaacatggtttgaggtaacgacactatcgactgaagaaggaatgagtttgggaagcgttgagatgtgggaaagactaattgtgccttcatataaagactcttagaaaatgacctcaggctagtatttccaatcatcttcaaatcttccgttgaaagaaagtgactgctgagtaatcatttgcactcagagttttgcaaaatatttgagatttagttaaagaaaaggggaaagaagaatccagtgctactgacaactgtggtacccagaccaatgacagcaaatgagtctgtgggatcatcttcacagcctccgaatgacagagcatcaatgaaatgaagaaaatagtgctttttgcgcttctattatcttctaactgataacgtgcatacattgttagtatttttccacagaatggtttatgtcaaatacttaggctaacagcatctgtactgagaagactctactcaggtgcttagaaatttttctactgaagtgtttttccagtgacaaagttctttcatattcttcccacctggaaacataatggcatattcacagttttcaccctgaaagtgtattaggtatgacataatagatgcctcattccagctaagagttgctaaataaataaatccacctggcagtgacatttatactagtttcgggaaatttttctttggcagtagagaccttgataatgcaacttaatgtggccatgatggtgtcttgcattgtgaggttaataggaccaatcagtggggatgaattatggttcacctttacaccattttatccctgctttgctgatatagacctgaaacagcctatctaattcctttgggaattctctaatggagcctccctaactcaagttactataggatgggtagatcctccactggagctgaaagcctcctgttgggtcctcatttgtttagtttgttatctctcgatacttgcttaattctctggaatgtcttcatagatgtggctggcaggcaatgccatttaatcattttttttttcctggttagccttatagaaaatgtttctttttttctggatggtgaatacataaaaatttattaaatataatcatttaaagatagggtaatttaaaagaggcataagcttaagcatatctgcatgtagcctccatattttgttcaaagatgtgtgtacattcagtgtaacataaatttaatatttgttgactaagaagcaaaaatatattgttaacaggtattctatgacacagttggccagtcagcaactagttttcttcagatcttttcaaaggctgcttgttgtcgctttatccaaaggagttgatagatgtgtatgaagcattctggctgacccatggcaatttgtgtttggaagaatgagatttagagccagggttagtacaccatgtggattgccatgggcattatttaggtgtagataagcttatctgaaattgcatctggattacctgactaatccaaaaaaggaaagaaaagtagagacctgctatggaaatagtcatgaaacaaaggagcgctaggggagaggtgggtaactaaatgctagtttttaaataatgttatatcagacttaaaagatacatggaagataagacaggcctaagagtttgctagcagctggatcagattgcaaggaagaatctcagtctatcctttattactcaagccagagcacaagactagtttccacattttataaatatagagtcttttttggagactgtgaaatttggatagaatgttttatttctcattactgtttacagattcgttatgaccttggcctgtatacactttcatgacaggttaagtgaacagaggttaaaggaggcaaactgagagtatttaaataaagtttacttgctatatttgtcttatctccccatgaataataaaaatatcatttattatatgtattacaaaatgttctaagtgctttatacacctaatattagtatggttatttcacacaaattttatgatgtctgatttctttttctttttatagatttggaggtacaagtacagttttgtttcatgcatatattgcataatggtgaagtgtgggcttttagtataaccattcccagaacagcgtacattgtacccactgggtaatttctcatctctcaccccctcccacctgtttgcatctccagtgtctatttttccactctcgatgatcatgtgtacacattattttgctaccactcataagtgagagcatgtggtatttgactttatatttttgagctagttcacctcaataatgatctccagttccatctgtgttgccacaaaagacattatttctttctttcttatggccgagtaatatttcatgatctatatacatatataccacattttctttatcgcatcatccactgatggacacataggtggattccatatctttgccattgtgaatagtgctgcggtaaacatatgagtgcaggtatcttttatagaaacttttatcacctctatttaacagctaaggaatctgaggctcagagctagtaagtggtgggtgtgggattcaaacccagggagtccaatgccagagtcttaactacttcaccagaagcagagggaaggggagccattttattattcttgatttcaaataagcggtagtttacagttagtactgcgtacacattacatgctcaacacataatagtgctaaatagttttttttgttgcatccctattcaggatgggggtaggtgagccctcctctcccagtattcctcatccttagaaataggcactaaatagttccagatcacagtttaaaactattgctatgggaaatgaattgaacaaatcatgtgcttaccttcagcactaatattctaaatcaccttagattaatgccagtaaataccaagacagttaaaaagtgcattcgatgtaaataactacaatgacaagttcacaaatagcaacacaactaggaattccacgtaggagcagaatataaagtaaaatgaaatgatgatctagatagacagatgatagatagatagatagatagatagatagatagatagatagatagaggagagagagagagagagagagagagagagattagatggacaggtatgtagtttcacctataagcaaaggcaaaaatgagtatctcagaaaggcagatttagggaccactaagattttaagttgcatcattctgtaaattggagattatcacttactgtactgtcacaaatttcagataagttaacattcccgaatgttcttggcacagcataaatgctcaatatcttcaattatcatactttttccccttcatccctgccctgacacatgatagatcatttcttaaaatatactacagcatgtattaaataatatttctactgctcagttttctggggaaaatagtgtttagttaatttctaggttttgttaagaatttacaaaatatatttcataaatgtgttcttttcctttcagaaataaatgtataattttactcacaacatttcaacaactttcctaacttgcatacttcatttttctagtgtttcataaaagttctaaatttaatcatatgatattttaaaataagatattaagcaagaaaacacagcatctattgtatttttaaacgaatcttatggtttttattttattatttcaattactgttactaaattattaattctaggttagaattataaagcattatcaaagatacagtagattgcaattagagtttacttgatttggcaattattaaaaaatgaacatttttttctgtgtcaacaatgaagtcagttaaaatgttttgtggaactaatatgctgatagcaatgctgcagaattaaaagtcgcattattattacacaaacattttgctaaagtttggaaattattcctttattggggttctgttagttttggagaatatttatatacatatatatatgtgtatatatatgtatataaatatcctgcaaaatgtagacctttcctcttagatcagtactagcatgctaaatattttattttttaaatatatattaggtaactgaaacaaagaaaaaaggtttttatttgcttagagagataacaataatacttaacttgtaaaatattcctttgatacattcataaataagaagataaattttctaattcttatctgagaagcatagcaatttactttttagaagcttatacattatggcatcctttgattaatgcagtacattttttctcacaatttataatggacttccaataatcttgcctttaaactgtatttgacctcccttattttactttccaactagaatgaagagatgggctactagttgtagttcactgtagaggctttatgctatctgaaaattttagacccagtggctttaataacattgtaaactgattctgggtccattttctcttgattgacatgtctacttccacatataatggtaaatgccttgacttttctgctccttgtgagtagattggtttgcagatttacataaatacatttcccggagaccacatttaccacatttgctcatgacagcaatgatccttggtcatttcacatgctgtagttacatgccattcaggaggctattgttgattgcctgtcatttctcctgcctagatgtcattcaaagggttatttgttattttaatttataggaatttgtacattaagttcaattaacctaacagggccacacaatgagtcaggttcaaatgaaagctgcagatattacttgtgaaagttaccatggaagatgatgaggaaggagtttttatgactgacctgtggagttagacttatttgtttttccaatgatctctactccttatgtttccaatagtttaagtgattttgaaatgaagtttttcataatatctggaaatacccacccctccaaatttatacccataccagtttacaatactttagacatgacagtatataagtaggaataatccattgttatacaagccccaaaagagaaagaacaaaatttgagggcagattggaatagttaagatattttatgtagaactatgtcaatattaattttgtataccaaaatttgacaggcttttatttatttatttatttttgacatggtcttgctctgttgtacaggctggagtgcagtggtgtgatcttgcttcactgcagcctcaaattcttgggctcaagcgattctcccacctcagcctccccggtagctgggacttcaggcacacgccaccacacctgactaatttttgcattttttgtggagagcgtttcaccatgttgcccaggatggtcttgaactcctgggctcaagtgatccgcctgccttagccttccaaagtgcagagtgcagggactataggtgtgagcacctatacccggccccaaacttttttttttttttttttttttagcatatcagtgtattagttcgttctcccactgctaatttgtaaaggaaagaagtttaattgactcacacttccacagggctaggaaggaatcagggaacttataatcatggtggaaagggaaacaagcatgtccttcttcacgtggtggcaagaagaagaatgagagcagagcgaagggggaagccccttataaaaccatcagatctcatgagaacttactatcatgcgaatagcgtggaggaaatccctgattacctcccactgggtccctcccacaacatgtggagattatgggtactacaattcaatatgagattcgggtggggacatagccaaacaacatcaaccggaatcttgtattgcaagtttttattgaattttaaatcatgaagctaaacacttctttgataaacatctagaaggtgagaagtagctcaactctggagtaaggctaaactgggtctgaatatgttttatattctctggactttgaaatatgtctcttgataataaactagttaggtctctctgtgaaaagtcaaccctgcttactctaaaaatatatatatatttatttggcctgtaaaagtttaaggcccaccagggcagggagaggctggaaatcaatatttttcttatgaatttaaaattttagaaaacctatttcttttttaaaatacttaatatttaataaaaaatatatggatttttattttcaatcctgtcataataacctatgtaggtagaattgccttgaactttctctttcctctgttaaatataaatgtttttactcatttgtttgctgagttattttttataacagaatacattttctttttcctttctttaagaacgttttgacaaataaacatatatatttgtggtatacaacattgtgttttaatatgtttacattgtagaatggataaataaagctaattgtcatatgcattacctcacataatttttggggggtaatgagaacactttcttagcaattttcaaatacacattttattaactataattaccatgatatacaatcaatctcttgaacttattcccattgtctaactgaaattttgtatctgttgagtaacatctcccccaaaccttgtcccttccctccagtctctggtatgcagcattctactttctaattctgttagtttgacacttttatgactccatttatacatgagatcatgctgtatttgtctttctgtgccggacttatttcacctaacatgatgatctccagcttcatcgatgtatttgcagatgacataatttacttctttttaagtctgaagattattccactgtgtatatataccacattttctccatctgtttatttgttgatggacacttaggttaattctaaaagttgcctgttttaaatatgctgatgaacatgggggtgcagatatagcttcaacatactgatgtcagtttctttgactatatacccagaagtgtgattgctgtaccatatggtagttctatttttaattttttatgactccatattgtttactgtaaaggctgtagtaatttatattcctattaacagtgtacagggctccccaccgcccttgccacattcttgcaactcttgttttcctcttaattttattatttctacttcagtttccttaactaagaagagaaataaatttgcttgttgcttattttgggatgatcccacaattattatactaattctgttagtataataattataacacttatggtgtctttctgggaaaactgaactaggtggttaactgcagttctgggaaagtctagaagaaaaagtccagttttggtaagagaaccctcttgcctttttaccttccctgggctaggtatggttcctgaggcaaacctccctccctccctccatccctgcctcctaccatagcgaaccaacaatttcctcagtctgaactgttccatcatgctatgagtgactcttaactattcatggaaacttctagaagtaaaatcccgaatttgtgcaatgagttaactggagaaagctattctagtaaaaaaaaaaaatatgaaaaaaaggaggctgggagacagcaaaacttctttgaattaccattttcttccctggtaggtattgttctcgactttgtttctgctatagtaaaatatatccaggtggagtaactagacaggcatgaggacttgatggaaaagaaagcatggatagtcatcacattcaagttgttttagttatctcttataagcaaaataattgagaagtaaggctgtcacataactagacagtgaaagttagtgagagaaggaacaggctgtgatctttggaaaggagatttctatttttgcagaactgctgagaatagtgagtaaaagtctgcataagacatactgagtgaaagtttggggttgttttctttaggcccatgacataactagctttgaatgataagttaacaatgtgaacatcatgtgtgcatagaatcagctttttaactattagttgttgattgtgctctgggaaaccttagtgggacactgaaaaatgagttaatgttaaataaggagttgcagaggctgacagccttggaacctttgggcacaggcatctgaataactttgcaggaatgacctgataattcttggattaataaggaaattctccctttacagaagatgacgtgcagattattaaaaactgagaatcttttttggaacctgtggcaaacccaaactcacccaatctatgtcataattttagtgacttggtattgtttgattgtaatgactaacaagcaaaccagaaagtcttccagaacacatttaagaagttacgaaaagggctatagatgaagaacaaaacagcactatttaaatttcattgcacacctaggactacaaaaaatactactttgtagttttcttgagtctatataactttcctaatgttttctatacattctccctgccgctcagctaacagctagaaatcactttgtagaataaaagggctgaggattgtatttatttccaagacagtagggcctacagaggctaaaaatcagcatctcatttttcagtcgatatggccagagactaggcaagtaacggagctggtggcagagaaaaaaataaaaaataaaaaataagtagattagggagaaatggaaaagaacaaaggcagctagggcaggtcaatgaacttgacagagaggaggcttctatgttccctcattttttccccggcataatattttgtgatttgacatttatttgataccccatcaatctgttccttggaacacttgtactgtagttgattttgtagagtagcacatgcttatttttcacatatataaattgtgtgttcaaagagtatctttatggtttactttctgattaataggctctgaggatattttgcttatcctggtgaataatttacatctgcctcgtgtgttttgcattttcctttggcttcattttcattccatgaaattttgcaagatgcgttctctcctttaagtggatgtgaatttctactcagtgaaaagcaatctagacaaaacagtgtaatttattagctatttttcttacaaatctcctacaacaaaactttattttatcactgccaagtaacatctccagtctgttttatgcaaaagaaatttcatatcctgattggtcacagtgtaaagttggtatttaagaaatatatttctcatatttatagctataatgtaaaaagcataaaatgtaaaatttgaaaatgtgttttattttcaactaagggcatgaaataaatataacttttataagtattatatgtagagatgaattttcctcagaagttgaaggtcttccataagtatgttcatatataatgatcttttatacaatttacattgcgcaactgtaccacttatattcttaatagatgagtgtgcgttcatttcatgctgttaatatctgcaataaaccttcaaattaccaactattttattgatactgtgttttgtagagcaccatcaacgtgtgaattcttaacctgtgcttcagctgttttctatgtatttgagctaaagtactatctacactttgcatgtcaatttttaagtctatatttttctcaatacaaaagagatcagagacaatctctcctgcttggttcagggaccagaaacacagtaggttctatccagagtcatcaatagccattgttctttttattgttctaaaataaaatgtaaaaccataaggatagcttaatcatgctacagacgaacttatgttacaaaagaaattatttacagtaacactctaattatatctacctgccaaaaaggaagtaagcaaataattataacacaaagtgataagtctttaagtacagtatactgtgagatattggaattgtttttgcagaatttgaaaaagttccttagatataactaggtttctatttattagcctatataaacacaaaaataagagaaataaatgtaagtggtaaaataattagacttggtgactacatcaaaaagttttacttaaaactttggcagatttaataataaatttcagtgaagtttttatagatatgaatcttccggttgaatttttgactttgaataacttaatcaaatgcggctctggattgcataattatagtttacacttgcataattgcatttttatacttttgccttatttgaagtattaaagtaattatttattatttgttacactatacattgaaattaatgacctagtcacacactcacttatatatatttgtatgtcttatggaagttattcatacaaaatgttgagattttaatgaattctaattgatactcaaacttgtcatattcactctatatgcatttcataatttttggtaagggtgtggctatagaggttagccaattcacatcaatttttaattatatactttttcaaaaactataatcttctcagtgttactaattatgaaattcataaaataatatccatgaaatgacttgggtgataatccagtaattatcaatagtcacttgctatcatattcggatgacataattataacttagactaacaaagtttgggtcatttgatgaatgggtggcttccttttattttattacaattatgagacttgttaataatgtatagaatttgtataatattaggtttaaatttcttttctgctgcgattttgttcgtttgtaataaaactatgaaacacactatttgagataatgtgaattcgccatttttatttttgatcagtttctaattaatacatttacttttggggggaaaagttgatcaataatgagctgaaatattgcctttagccctaataaagtatattttggaaaacaaatgttaccttaaaatgacaataacaacaacagcaacacaaaccttcacataataagagcccaaatgagatagtttaaatctagcttaagctctacttaataaacaacaataatgtataacactattggacaaaacaaaatattaaaaacctctccaaacataggtctagaacagagactagcactgtcttcactgggatagtcatgaatttccagtttcggtgtactgagattcagtcagaacttggacttaaaaaacaaagacactttgggaggccgaggcgggcggatcacgaggtcaggagatcgagaccatcccggctaaaacggcgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaacaaagaacttggcctcttggttttagtgacttggaaataagaagatgaaaagatgaatattcactgaagaactctttctttctcactcttttctgcatcagtgttttacaagtagttgtggagtgagttatgctgaagcagatggggacgcagagaagccagtagcagatgggcacatccaggttaccctgcatggttgggccgcaaaccatggcctggggtggaatggagaaatctgtacacatccttttcacttgtgcgttttagcaggtgcagcatccgcagcaacatccttaatgctttctccccagttcaagcttagtttctcccttagactactgtaataacttcctaactgatttctccatctcatttttttcctcctccaatccaatttcaaattatcagtcagggtgatcattttgaagtgcaaatcaacttgccacaataagttatccattggtctgagaataaaaaccattctggagtaactacaaaggcctgcaggatctggaacctgaacgcctgtggagcctcatctttactgctcagccatcccttccttgcccctcccttctcctttgcatcactccagcccacttgccatgcttcttccctcctcgtccttctgctggagttggccttgggcttcaaagcctcccaaacttctctacttagctaatttttattcatccttcacatgtcaactcaaacttcatttcctttgagcagtcttcccctccgttccacattagttccggtcttctactgtagcgttcaggatgccctgtacattatcatatttgtaatgacatatttatcaatgattaggtgatatgtctttctaagtacagagttactggcctctgagcacagggcttggcacatgatcaaattttagccagcagagacttccctcaagatatttggaattggaagtaaaaaggaaatatatttcccatctggtgcacgaagctgacaaggataaatgcaaagttggagataagagaagtggagatgctctaatgagccttgttgttgtccctgaagctacctgcagccctgtcctgatggtaatttgggttgtaagtcaataagcatcctactttcatttttaagtttgttgacttgggtctctctcactggcaaggataacaaccctgactgaaagaatccttacattatgaaactgtaagttccataagggctagaatcttgcctgctttgctcagcaacgttgatacctaacaaaagtttgttaaatgaatgcatgttatgcaataataaattcattttaagttttctggtagatatagcctgtcatcacactttcatttgatgtgatctgaaaataaatttttctgagatatataagggccattgaatttaaagataactaatattacacgtaggtattatttctctctgaatttctagaattatacgtacagagagaacatgattaagaaaacaaatacgtaacaggtaagacaaattaaactggctagtgaattttttgatactcggaaaaatcagatttttagtttgtgtttgaagcaaatattcagaattatcaggacaggtttctacaaggattttaatctgattccttcaccaaaatcattttaacatttagctataagatatacaaatcatatttacacctactgtgttaaaaaaaagtttaacctttttaggacagaatggggccagtacaatcagacttatgtaagaaatcctcaaataaccttcttttgtcacgatgacaactgggagcaaataatatttaaagcatgagtgagtagttggaggagtatttgacagtttctgtgaggaaccattgactgaaaacagtgatcaacccactagatattttaaagtaaatttaaatgagcaaatcacaattcctgtcactgagaatgacagcactaattgtcaaagtgaggaccagaggttcagagctaagtggatgtttagttatatgctaatagaaaaatgcttcctaattaagatatgcttgaaagttctctctctgtctttcatctctatagcctatatttaaatctcctgactcttcataaatatgcagtggtgaccttaggacagggcactgtttagcaaatatcttttaaaatcagaatccacaaattctattttttaacaaaatgttgtattgcatcgtcctccttaggttttaaaaacatacatgcacatttaatgataaaccaatgattttaaaaggcatgtgaactgcttctcttcagacatggttgaggatttttgaacatgatgcaatatatttctttctaggacagttacagaactggacttttctttcttcctggtgtggtttattaaaacaataaatcaaagcacgtagaataaggagctgagatcttgagaggctgacatgcagaaaagctgagatattggcaaggcttaatcgttgaagcacccagtcaaagactcagtcagaagaggaggtggaggagaacagccaggaggacaaaggggtttcaggcttgggctgaacctggcatcacacagaggggactacacctcctcctctggggactaccttgagtcaacctcgcagaaccttttgtatcagagtaaggtatctgaaaaaccagagcagctgctctaatggttcagggctatcatccttagatctgaagggtcatggctacacatgcatagaatatggaaagcagccaggtgaaggcatcttccacaggctctcatcattctagtgtgtgtttttcaatgcatcatttatgtcagaagtgtttgaaaaaagctgttacaaagttagtccttattttcatagatcactttctaagtaaacatggtctaaattataggatgagagttttgatcaatagcatgcctgtattgggtgctaaaatagtgccttgggtacttgacggcagaggacatcagtaatgtgaagaaggctatagaaagaagcaacagtagacacagaataaaactgtgcttttctaattttgtctaaggttttcgttacaaagagtcaggacaacatgaataactttattatttccaggaataccaaaataattggtatttatacttaatttctagttgttttgtgtcttgtggaaaaagcatgatcagttaaatatggtgaagtaattaaaaatatggagataagtatagtgagaatcatcattacataatttggtaggtggtgtcatgctgttactactgtggttccatattgagcaaacattcaagtctcatgaaatgtacgattttaccaactcaaaatataaatatcttaagactggacacattaaattcactgttatagtgtattactgtttataatgtgagttacaatcttgtgcaatcattttggtgtgccacggctacgcaagctttgattgaggagagaactgtagagaaaaccaacatagacaacctcttccaggaaacttctgggatagtcatcaacgcagaaacttcatttgcctcctaatcatctactgccatttccccagaagctcagaaatgtgtgacttcacatggtcaatgaacattgaatatacagttgactcttgaacaacctggctatgaactgcacggttcactgtaatgtggatcttcttctacgtctgccaccactgagacagcaagaccaagccctcctctttccactcctgcccagtctacttaatgtgaagatgacaaggatgaagacctttatgatgatccactttcacttaatgaatataaaatatttttttcttattttcttaataatattttctttgttttagcttatgttattgtaataatgcagtacctcatacttataaaataaaaaaatgttaacagactattatcaacaaggcttctgaccaacagtaggctattagtagttaagttttgggagagtcaaaagttacattcagattttcaactgtatggggagtcagaaccacaatccccattttgttcaaaggtcaaccgtatctggaaaaaagtcacacaaatcttctaaaatagatgaataaaaagttgaaccatattaattgcttcaagcaaaattaaccattaaaaataagcaattcattgcactttatagagactattaacagaatactttaataaaaataggactttttttccttgagttaaggatgatttagtaaaataaactggttgcaaaaaatgtacacaacaagcagcacttatacattctttagcacagaagggactgcctcagagacctctttaaattcttaaggcaaatttaaaatcttggcaatttcctcgaaggtgaacaactaatagtcctttgtagggacatggatgaagctggaaaccatcattctcagcaaactgtcgccaaggacaaaaaaccaaacactgcatgttctcactcataggtggcaattgaacaatgagaacacttggatacaggaaggggaacatcacacaccagggcctgtcatggggtggggggaggggggagggatagcattaggagatatacctaatgtaaatgacgagttaatgggtgcagcacaccaacatggcacatgaatacatatgtaacaaacctgcacgttgtgcacatgtaccctagaacttcaagtataataaaaaataaatattaggtaaaaactacttaataagcatggaagcatctatgtagatatttgaaataatacacagatattaaaaaaaaaagaatcaagaaaagagagggtccttgcactcatgtgggcctggaatcaaatccacaccgaattcacatgccttcattggtcactttagcttcagaacccagccttctcatctggagaatagacacaatgatgactatatatataataatctcatctaatccttgcaacgatcctacaacttagaatatggtaggtgtttaatttatttttgtattttactctatattttcttacccatgataaataaattatgttgtgcatcacaactctacttggggaatgtaaataaattccatgaagtcattcaagacgtcattttaattttgagtcagtgtttcttctccagaaaaatcaatacagtattaaatatctaaaggtataagtcattttgcgaggctaataagatgacaccttttataatttatgatttaaaaaccattgcttaaaacaaatcacttgaaatcacctaaaaactagccaatcgcttaaaaagaaaacaaattttaaatagagttttagtagcaattaagtaattttttagttttaaagatacattagaaatgtttattagttggaaatgtttatccatatagcacaggatgaataagtgattacataattcaagaagtaaagcagaaaacattcaaccaattagaatttttgaacatcttgtcctttaaatatcagatatgtcaatatgataaataaatgatatctaaaacatctatcacaaaaactgggtcatgatgagaatatttatatgttaaatttgttagcttttctaattttctcaccttcccaagggtaaaatcatgcttatattcaagattaatcactgcatcctcctccccaaaggctttctacccttccactaagattttttattcctaatacaaagccaaaaacctttacaaaaaccactcttcgaaaaccacctgggtcagggtgatagagaagaaatagtaatgcaccagaaattacagttccaaattctttacatccttgacatttaccacttcaaggtctcagtagtatgaaagcagggcagtggggtggatgcaatgactttcaaggtccttctgacttggtctttctgtgtgtcgcctgtgctctgtaatgattacttagaacaccccttaagtgagaaagttggggctggacagaacctaacaatcaaggacctggtatatttgcagtaaagtatctattccaactcctctcactgttctctcttgtctctactctggactttcccgtatttattttgatgctaatattcggagtgatgttgatgtctcatcacgaatgccattccctagagcaagcttgggcaaatgactgcctgtgagctaaattctttcaaccttttatttttgtaaataaagttttattggaacccagccatacccaattgtgtacccttgtctctggctgctttcatgctacatgggaaaaactgagtagttatgacagaacctctatggccacaaagtttaaaatatttactatcttgctatttacagaaaatatttgctgacttctgccctacagaaacataagcaaacagcagtaatcactaatatcaattaaatggatattattggaactcttaaggggcactttatctatagatatcatttttttgacttttattttaaattcagggggagacgtgcaggcttgttatataggtaaacttgtgtcatgggagtttgttgtacagactatttcatcacctaggtattaagcctggtaacagttatttttcctgatcctgtctttccttctaccctctaccctctgatagacttgagtgtgtgttggacccttctatgtgcccatgtattctcataagatactaatttttatctttgtgaaattttgtttccttgaccaacatctccccaatccctccactccccagctccaaaaaaccaccattctagcctctgcttctctgagttcaactttttccgattccatagataagtgagatagtgtggtgtttgtctttctgtgcctggcttacttcacacaacataatgtccttcaggtttatccacgtgtttgcaaatgacaggatttccttcttttaaggctgaagactattccatggtataaataccaaattctctttctccattcatctgctgaaagacacttagggtgattctatatctaggctattgtgaaaaatgcaatgaacctggaaataagttcaagacatttattatacatcacagtgactatagttaataacaatatactatatacttgaaaactgtgaatagagtagatttttttttttttttttgagatggagtcttgctccgttgcccaggctgcagtgcagaggcacgatcttggctcactacaacttctgcctcccgggttcaagcgattctcctgcttcagcctcctgagtagctgggattacaggcatgcagccaccactcctgactaatttttgtgtttttagtagagacggggtttcaccatgttggtcaggttggtctcgaactcctgaccttgtgatctgccagcctcggcctcccaaagagctgggattacaggtgagagcccctgtgcccggctaatagagtagattttaaatgttctcaccacaagaaaatatggtaagaaggtgaggtaatgttaattaacatttgttaattaacttgatgtagccattccacagtctacacatatatcaaaacatcatattgtacgccataaatatgtataattttatcaggcatttaaaaattattaatttttattaaaacggttataatagttccaaccgtgttgtgtgtagattcacaaccattagaagttacaaattgccacatataaagggtggtataatataaagtcagttttaaagagattggcatggcattttgtactgtatttgaaacatgatcaacattgttatttttattttattttattttatttatttacttatttatttatttatttattttatttgagatagagtctctctctgttgcccaggatggagtgcaatggcatgatctcagctcactacaacatccgcctccctggttcaagtgattctcctgcctcaacctcccgagtagctgggattagaggcatgcattaccacaccctgctactctattttgagtagggatgaggtttcaccatgttgatcaggctggtcttgatctcttgacctccagtgatccactcaccttggcctcccaaagtgctgggattacaggagtgagccaccgcgcccggccaacattgttattttgaaatgtttgtatgagaatagaacaaagcagccaccttccccctggagccctgcaggtcggctcctgttaaccaggagccagggacgtggccaaacaagtaacaaagtcactacacgcttcacagccgcaatgctcttatctgtaaatcagacaaaatgcttgtgtataaatgtctgcaaagatgtttccaataaaagaaagatttggtttgtggatgtgctttgttattcttcttattaatttggggctagagacaagagaagagtctcagggaaagaaattccttgtttgaattaatttagtcaaatcaggtcagagaatccagaacaagacttagctgatgtttcttcagggcacatatgtgactgcctttccactgtgaataatatctactcaggccatgtattcattctaccacttgtgagatttatgtagcattcttgcctccatagtgctaaagatgcctggtagggaagtttaaagttactgcagcaatttcttttcggtgcatattaaagttgtggtgccttatctatgaggcggagctgtaagtcgctgtgatatcttgcttcgaattaattcactagttacattcaacggacatagaagtagagtttggcagtttagaaagctggcaaattttctgtggctcctcaaacattactgtaaaatttgaaagctttaatatgaagggtttcagtttagtcacagagtaaacctaaaatcctgggatgactgcttcccttttatctgtgcctcatgaaaatggatacatttttttatacctcatcagatagacttttaaattccaatcgtatgaaaatgaagacccccctcagttagagtagaccacaaaatgtggctgattgtcggtgaatcaggctattacagttacacaaactgcgttgcagagcaaaaaacaaaacaattgttactgtaagtaatgaaaaagcagcaaaatgcagccacataatggtaaagacatgagacttctctagtattttaaatgaaaaagcacttgactagctgagcttggtgcttaacacatgagaaagatgcaggaaagaaaatgatcaaaaggcatggtccagcctcatgagagaagagggtctgcatgtcgtgagggccactttctcaatcctgtttggatcttatttcacggcttcaggttggaccttccacttgcaacttgctgtggaggtgctcttctgcaagtcccaagatcccaaaaaggaaatacaggagtttcggtgtttttgagcaaaacaaagtaaaaagctgagtaaggaaacactatacatagctggaaataggttattttctatttgcagacaaagaacaatataaacaaagctcgagatcatctgggcaggttgaaaatagcttcagtctcaaaacagttacacatctgatctgatttcatcacattttaatttttcttcctctgcctcatcttcctcgttctccttttcttccttttacttgttcttcttcttccttatctctctcttcctgtttctctctttctcctgctcctccttctcatacttttctgcatttgtactgcatgtgagatttcaactactcaaatgaattacactcataattttcccgagtggggcagagagaagggggactttcaaaataagcctttaaaaggaaagcactttttacctatatttttcttttcttttttttcttttttaaaagttgagcttataagatcatgcctggtgaagctgtgttcatccactcctctcagcattagtggaagaattagagtattaacgaccttatagaccaggtattttgtagcctcctttacagtttgtcaagttgttaaaaattgatacaagaaaacttaattatttcttcagagaaaagctggacatgtgaactatgttaaccataaaacttgcctgtcttatgtttctataaacagccaggtttgaagcacaagggcaaacctatgcatctatgtgtatatacacacgtttctattttatatgcatatatttacatgcatgtatagtttttgtaaatttattcgtgattcttagtggttatcaactaaatatgaagcagtgttctagctgcttaaagagttggaagaaaagggtggtgtcaactctgcgattttgctgatcaaatcgagattacagatacatgttttgcttagcccacataggattgttttaaattacattttgctgtgtttctgcttttagaagttgagaagtgccccatgagtatccagagcttgtagcttctcttgagaaatctgaaggtcttgcaagactagacctgctgccttccccagcagcagccgtcatctggaaggtgatagttgctaataccctgagtcaggggagactatttctccatagtcctggcagctgcctactgtgttatccctgagcttcactcatttgttttctggcctgatcctattgttatttcgagttcctactcctatagatctataaggggtgactgaaggggtttggaaaaagactaggttgggggtcagttgtggggtattgtggcaaaaatgctgggtttggaagtaggtggtctctctgatgagcttgcttatgcctggtatgcacccatgatgttttccacaacaaaaactagaaaacacttgccaagtatctgggagtggaataacaggcttgagagaaaggtccccttttggcatagaggcgtgcatttaaaagcctttattctgctgctaaatactatttgaaagagaataaaataagtacagtctcttttggggggaatagggtggaaaaaaaggagtgttatttgcaaatatttcaaagtattctataatgactaatacttgtaaaaagtaacttaggaagccttggcagcgaagggcagaatgccatcggttaatattccaagttttgtgtgcctagtgaagcaagttagcttgtaacagtgcttcaactggaaaaatcacaattgacagcttcaattcataaggagcaaagcaccacagtccatgaagaaagtaactgccatggtgagcactctgcatcagggagaaacacacacacacataccacaccacacacacatacacacacacatacacacaatgatcaccttcctggaggaagaagagtagtgaattttaaaatgaatactttttatttgtgtttttctgttattgccaactttaaaatgtactcgttttgattaagctaggttgtgttacaatattaggaattaatttcaaacacattgtgtttttacttcaaaataatttacttcaaaaaaatctttatgtgtatttacaaaaatagtacagctagtaaaatgacactgtattggcttttattgccaaaagaaaaattaagtgtaatgcttaatgaactctttgaaaattttaactgttagcataatgcaactcattctgatttccattagatgtatctattatatttgacccacatagtttaagaaacctgtaattaagacactccacttttgaatcataggaaaatctctacatcttatcttccttataagtttaaaaaaatttaaaaaaaatttgcaaccaatcaaagtcatgctattccttattttaatgccagttttcctggtattttcgataaatttaaaaaattacaagtgatatttatatatgtaaaatgagggaaaattctacaactataaaatcaaattgttttcatttcttaggaagtcaatataaatggtctttcagttgataacaatgtctgttcattcacatcaataaataatttcataattccaaggctctctttatccaattgtattttaaagagtacacattttgtgatagtttataaattaaaggatatatattcaaagtcacataaaaaatatttgagttaattacaaagtaatcatggaagaatattccttacatttctatttattattgcatgaaaatggataatttcataactttttatatataagattccaactggcctttatttcattacatataaaatgaaaaaagatgagttgatctgacagcacagcccaagttttcaaaatttgttaatgttattgtattgtcaacactaaatgttaaatatatatacacacatatatatacatatatacctatatatatacctatatatataatataaaatgctaagaatataaatgttaaggacgtacatccacattttgacctgctccatttccgacctgggtcagtttgcctctcgtttgcaaccacattacacacagctcctgagaggtcaccacattgatgccaaatagtgcagacatgtgatcagcatggcacattataaccaggagctcccaggcccaagcaatccttctctcagcctcctgagtagctgcaactagaggggcttgccaccacacctggcacatgcacattttatttctaatttaattttttaaaaatatgcagcttattatctaaagaaagacctttctaacccttccatttaaagccataaaatcatacagaggcaaaaggacttcttggagctctgtggttttcctctggtggctaattgtggttaactctgcttatcagagttcttttatctggaaatgactatctttctagtgcatttcaagtatcatctactttaagttctgatcacatttcatttaccacttatatttggtgtgaatgcaaagatgaatcaattacccaatttcgccatctttttaaaatgcatagcatctatgcactaaaaatacaatacaataatgtgcaactcaaaaaattccccaagcaagaagactgatgatttcttaaatattatgtgaccttctatcgcctgattttagaaattctaagtgaggacaacttggattgtatcctaaaatattatgctgtggactcactctccatgtatacaataggtttgacatttgatagaaattaggggacagcagaagagaaagaattcttaactatgtctgtacatagttaactaccctaaggcactttaattcttgtccatcctttattctagtaaaactgtcactgaaccaaaagatatatctgtataaagagctctgtactgtcaaaagtaaagctacttggcaaagcttatgagactttatgtcagttttctacttgaattatagttatttcactaactagttatctttttcacatctattgtgactagagaatgagatgtagcagcaatctttgttgcatgccatttgtaaactaaatttatgtcatagatttgcatgctaagtacctctctggtaagaagagctctcaaaggcagcatgtttatgccactatttgtgattaaattggaattctaaagcagacccaagttaaacatgaagacaactttagatcttggtctgaagtcaaatatagactgtttacttaccattggagttatcttcttcttcttctttttttgtggctattagcaagataatctgtgatagtttttaatcatctctcttttactaacttcatagttttaaaattttctgtgtttttggtgttggcataaaaggtatgtgttcaaaattcatgattggctaaaataataagatctggagtttgaaagtagtttcaacaggtgatttagtatataaaattatatatacttacatatactatgtagttattaattaggtaccaggctattgtcatcacataaatcataaacatcttcaccagaaagttttcacttattcattcatttaacatatatatgttgagtgtgtatgaggcaccaaatgccacactaggctgtcaggtgccatggtttaccagatacactgttcttgaagtgcttaccttccagttgggggatataaaaaaggcacaaacaagagaatgagttagagaaacagaccatgtgaaatcacacaaacacatggacagctggattgaccatttggtcccatttttcactgtcatttaacttcttagtcttcctcatctgtgaaagagaagaagaagatgtgacttacctgttttaaatggtgatgaaactcatcacagttttcagctaggggccaaagccctgagttctgtgtgcgtgaatggtctcagcctggagttctctctagttgctctgacttgcataactctgtttcactcggccacaaattaagtgtcagggcacatcccagcacctacttgacctcccttaaataaccccagtgaggatctctaagataatttttaaattatgaaattaaatgattaatatttttaaatagaaaaggtagaaaaatgaataaaagatgaaatctctctgtacttcttttgcaaagtttccccagagggaattactatcaactgttggctttacctttttctatatattttctaaatagtttttaaaagagaaaatacaaagttctgcaactttttggctggttaattttcttaaattggtacataatgcgtatttattttctcattattaactactcaaatactctaaaatatatacagggaaatccttctttggtacattctttctctcacctgtaaccccaggaaaccaatgttatataaaatactatcatatcctctgcaaaatattgttatgatttgaattgtgtcctcctgaaagaagttgaagtacaaagtctttacaaatgatcaatttgagatgaggtcattagggttaatcctaatgacacagaggctgacatgcacagaaggaagacgaagtgaagacagggacaagatggccatctacaagccaagcaaggcctataactaccagacattagaagagaggcatagaaatattctccttcactgtagtcaaaggaaccagccttgttgacgccttaattttgcacttctagccttttgtatttgtccattttcacactgctgataaagtcatacctgagattggggtatgcctttatttttctataaagaaaatgatttttttataaagaaaaagaggttcggtggactcagggttccacatggctaggaaggcctcacaatcatggtagaaggtgaaagtcacatcttacatgccagcaaacaagagctaatgaaagctaaacaaaaggagaaacctcttataaatccatcagatcttctaagacttattaactaccatgagaacagtatgggggaaactgccctcatcattcaattatctcccaccaggtccctcccacaacacttgggaattatgggagctacaatttcaagatgagatttgggtggggacacagccaaaccatatcacctttggaatgtaggacaataaatttttcttgtgtaagccacccagtttgtggtacttctttatggaagcctgagggaactaacaaagatttcatacctatgtggattggccattttaattccaattattatcagagaacaataaaagtgaccagaaatatcttctttttatattctttaattaaaaaaattcaatagtaaatgggcaagagttgaatagacatttttcaaaagaagacctacaaatggcaaagatatgaaaaggtgcttaacaacattcttcatcagaaaaatgcaaatcaaaattaaaaacaggtatcatctcacccctgttaatacggcttctatccaaaagacacaaatattgcagtgtttacattcctgccaccaggttgcccacagttattttgaacactgaacttctttgaaagatgactgaagtctacatattttatgcccctaactactatggtatctctggaaatctgaatgtaaacattgtcatggtattgtcaaaacattagatggatttaagaaaataatatagagaactttttataccctgtatacagataaggcctgcaaaagtctttccatataaaaaaaggaaatactttattgacagaactgttttccctttgggccaccctctaggaagagaagaaacggagctctgttgaataactttttcagagattcctgtagcccagaggcatctgagaaatatttgtagacatggagaaaaggaaaatgaagcagttgtcagtactttactccatgtgctgattttaacttacacaggtaactttgaattggttaaaaaacccaggcaatttgactagagctcatctattggaatctcaccttcaagcttgagagtcttgaataaacttattctttgacttaaaatgacctgatttctttttgcaagggtttctgttaatgaacaaagtctctgtctcccccgtcactgcctgatctaaaatatcttattccttgagtcttgcccatatttaccagatcattggagacaggtgcaatagtgaattcgcatttttaacatttttcaatctaagttttaagattctattattgagatgaaaatatttctaataagttttctggcaatattaatgtgtgggcaataaactaggtatggcagtacacctgcaagaagacagttagatatggtctttgttgtccactgtctcaccccaaactaaagtcttctctacaacagtccttgtaggtgggtgtctatttttccattaaatgtttgtattgatagagagatgctaaagctgtctgattcattttactgaggcttgaaaagtatgtaatgtattcatgatattacaataattccattgagttatataagacacatcattaatgtaggaattgtaacattttcattgtttcattattgatcaagtgatgttagtagcaatttgtaggcactcagatctatctttggggattaatgaatgaagaaagaaacaaaagttatgcaagctttcacattggactgttcagaatgccctgatagtcacattttagctgtttatgataacatatccactttactatgcaaagattttcggcatttatatgagggatttattaggaaaaatgaactttgaagtgaaaggacaatcacaggtatagagtgaaaaaaggtatgatgtcaagaagagtacaactgagctaaaaatttgtgagtttatagaaatactgtaagatttgtcatctgttacatctcctcttaaaatgatgaaaccatataatggaatttattttgaaattgaccatatttctctcttaacaagtatgtataccatggtattgacatagaattagattgaactattactatagcatcaagttggctatcaattgttttatttaaatgcatacagaaataatgaagcataatgctagttgtgaaaaacataaacaaatgtccctggctcttgcttaactaacttctaatctattactagttataatgattagttagaataatattaatgtgtatatacacagaaggttttatggaaaatgtgattgatttcaaattaaaattgagttttacaacaggtagaaaatgcaggtgcaaatgtaattcagaaaataatcttttaaatgtttaaatagtcattgaactattagacatctacatattttttcatttaaagttaatgatctaaatatttataattatcaattaataagcagttttcagaatattgccaatatctagatgtattaaaagtcaaatccacatttattacaatatagatgaaagtgaatatgctagaaccatagaagatatcatagacatatataagataacatatactgagtcttctttctactccagggacttaggctctttcacagaagtaactaaatcattaattacctttgtatcttacaaatttcccaattatatactcatatacatgaatttatatataaacaaatatagacagattttttttacacattggacttttctatatattatagatgcttgtttcactgaagagtacaactttaagatctttttatattagcacacagaagtctactgcattctattcaacaaaagtgataccagtgcatcatttccatatgggtaatttttttttagtattttcacatcaactgtattatttattattttttaaaattaattcttatctcaatagcttttgggatacaaatgtttttttttacatgcatgaattatatggttgtgaattctgagattttagtgcacctgtcacctgagtagtgtacattgtacctatggaggttactttatatgatgtttattacagaaaacattgcaataaatattcttatacatgtatcttcttattcttatgtaagaatacatatataagaatatatacataagaatatatatacatatatgtatgtgtatatatatgtatatatatatatgttagccatttaagtcataattctgtgtgtggtctttattttctaccttcaaataagttacttatgctattttgtcatttccatagctgaaaaaaattccatgtgttatctggaagaccactttttttttcccacttgacatttttcatctctatttgaaaaactctctatcaaatgctcaaagcatgacaatttgtaagagtaaattgccttatagcacacaacacaaaatatccactaataccaatgctgttttatttttatatttttaaattaactaatttattgattttggtagagacaaggtctttctacattgcccaggctggttttgaactcctggggctcaagcaatctgcctgccttggaatcctaaagtgctggaattgctgacctgaaccatcacaaggctcacaaatgcttaatttttaaagtagtgatagtctgcccattcaaaagagaagctagtttacttatactttagcaaaaaattaattaaaatatgccttattggagatatatgtagtgcatcataagataaaagggatgaaatataaatcaaagtcaagattaagacattttctgtcttcagctctctgtattttctgtgaagaaaatactgttacagcactactaaaattattttctggcctcttgcaaaatgtacctaatgctagttatttaattattgtagttagccaccttttcatatggattctctattctcattttattttacattcctttctttccagtctttttacctcttgtgcaacttttcttattatggttccaattttcatttctttatttgttctctcttgggaaggaagaatagtcatatgtaaaataacatattgaactttctgtcttttaagtatttagtgtgtattataattacagtagcgatcaattctatgagtagatttttttgtttccttagctgttttgttcatatttatttttctgaaaatgaatattacagttcttcccctcaagaattttatgattgatggatataacattatcattaattggagaaaaaagtgcagataaaagccatggaagaaaatgtcagaagttttagaagtgtgtatgcaaggaaaaaagggttagagagatgaatgattgattcctactcttccatcttgagtacctcatggataaagacaggatatttgtgctccaatttttagcagccacctgcttttctgctccccaaaggggaaaactagtgacagtaacatatgagaggaatgtccagaagccttgtccaaatgctctgcgtcatgcagattggcctctttgtgtctccaagtgagtcttctaggcatggtattcctttacacttagcatttattttgctcagcagcacttaaattcataaaaacagttatagcaaacatttctagaatatatcagaaggtagatcttttcttttttaattttcaggaaaaattatacaatataagaagataggctttagtcagataaatcttaaattcagataataaggctatgaaatgtatcacgttactcaatttctgtgatgtctctgagctttttgtcataggcgtgctggagagatgaagtgaccctcctcagttaattcttttgagtattaaatgagataatatgtctgaatcactcaaaatatttagtaactgttagtttttttcataatatcctcaaggagaacttgggggaaatttcataatgctcccaatttatggtggtaaaatgaagacattcaatgtgaaaattaatctaaaatgatggaacagctgtactcagtgggattcatctgcctcgaattctcaataaagttgaattgaactatgcttttgagatcttcaaactccccctggcccattttctgtaattcactaaaactcacaggattcggcacatagccaaactaacggctatgattgattacagcaaaaggatacaaagcaagatcagcaaagggaaaagccacatccagagaaaactcagtgcaaccttccaagaagcttcttctactggagtcagacgggacacacttaattcctccagcaatgagttgtgacaacgtgtacgaaatgtctactaggaaatcttgcccaagattagaagtttaggatttttatcatggttcagcaaacgccttctgtcaaatatatgccacatttctagtctttcagtaggaaagccaggtattcagtataaattatttagtttttacaaacagtttaagcacaatggactcctattatcatttagagaaagttttatatccgtgtagggaactatttacccttcaagttactgaatgccagtcaagcgctaactttgcaagccgtccattctaagaataacagtctcaagcttactatgttaatttgtttttgcatagatttcatctaaaaacagcagaaaagagattaagggaagggctcagagagagtagagccaacatgaacagcaaatctgttatttaagtactagttctaccctatgtagtcattaaaacactgtcaataaacaagtgttgcaaacctctctgacatattgaaaaaaaaatttacaaatgaagccttataattatcagtggtccacaatctaatacgttttcaatttacttacattttattattaatcactaggtataaaaacaaatccagcaggggaaatgtgatagatccaccatgacatccgtaaacacaacactagatttaaaaacaaactaacaaacaagaaacagaacaaataataattaaaaagctcttttctccaaaatgatgtttttaatttacctttgtattcatttgggttttgattattagaatatcctcacccttttctaaccctttcctgatacttgattttttggatagtttactattatgtcatttgtgttttttgatgagtataaaacccattttgttaggagaagaaaagtccccattacctgaactgttgccataaagctcctaggaaagtagaaaatgcccaaagttattttcctttttcttctcttaaaaacccctttccaataaaaacaaagaattggcaagcagccattttgagagcaatcagtattggtaaagctgataaaaagagaaacatctttgaggctgtggtcccttctctaccatccatgtattttagtacatcaataattattttttgcagagtgagaaattcaggaaactgggcactttgctttcctaagctaaggagatagggcgcagaatgtattttcttatatctgaagacccttgtggatgatgaaggaattgaaatgccacagtaacaaaaactacaagtataattattgattaacattcttgagggataagatgtgccagactgtgttctaagcgctttacctatgtaacctcatgtcattctctaagtgaaccctatgtggtaggtttttattattatgattattgtcttccaccttttgaggagaagaaactacaaacaaacaataaaaaactaaataaattttaattaaaattaaaagttaaaaaaacaaaaaaaggctgggcctggtggctcatgcctataatcccagcactttgggaggccgaggtgtgtggatcacctgaggtcaggaatttgagaccagcctgcccaacatggtaaaaccccatctctactaaaaatacaaaaattagctggccgtggcggcgcaagcctgtaatatgagctacgcgggaggctgaggaaggagaatcttttgaactcgggaggcggaggctgcagcgagccaagatcgcgccactgcactccagcctgggctacagagtgagacttcgcctcaaaaaaaaaaaaaaaaaaaaaaaaattaaaacttaaggaactgagacaaggtgtcattatacaagtacccactgcaggagcagagcagacattcaagcactagcaccatggtaccagagctcatgtgttgctgttttaggctcacgtttgcctcagtgtctttctggggtgtttctgtgtgcacgtatgaaaacaaaatgtatatatatatatatatatatatacacacacacacatatacacacacatttatacacacatatacataaatgtgtgtgtatatatataaacacacacacatatacacatatatatctacttgtacacgtgtgtatattataaaacattttaaaaaatttaaaaatatttaagagcattaatcagttaaatcagttttaagccaaaagtattacagtgactcatttcaataacacctttaaaaaaaaaaaaaaagcaaaacacagtgaaacttacaaaaagaaagagtaaaatgctagttgccagaggctggggaggtggagatattggagacgtgttgttcaaacgacacaaaatatcagttagacaagaggaataagttcaagagatcttttatacatcacggggactacagttaatatattgtgtacttgaaaattgataaaagagtagattgtaagtgttcttactgcacacacacacacaaaacaaacaataataagtatgtgaggtactatatatgttaaaaagtttgagttagccgttccacaatgtatacaaatatcaaaacgtcatgctgtacaccataaatatatacaattttacttgtcaatgaaaaaaactgcttattttccactattcatctaaagtaaaaagaaaacaaaaactattatagttaagtgcttccacatattaaatatctgaaaagataacgttatttttcagaaaaaaagcaaacctcccctccgtgatcattaaaaagattatttatatatgcatctttaaatagatcgcttttaagtttcacctccaaggtcatatttacttaatgacttggaaataagtgataagatagtctttactggaaatgatttaattctctgccatctagctaagggacaaatatttttgggaaagagccagatagcagatattttaagtttcaggggtcaatctctgtcgcaactcaataccgccattgtagacatacataatatgtaaatgaataactgtggctgtgtttcaataaagctttattatgaatgctaaaatttgaatttcacttaattctttcatgtgacaaaactttattcttcttttgatttttctttttaccattaagaaacataaaaagcattctgagcttaaggacactagaaatctagccattgaacaggattttgcccaagagccatactgtgttgatcctggatctggataacaagaaactgctaggattatctgtgattgctttgccttgctaaagtctttcttttgcctatagttacatacgttattttgtctatagctatatatgctcattattttatcatctaatgtatcttttttaaaaaactgttttcaacttttaagttcagggggacatgtacaggttattcagttttgttacataggtaaacatatgctatggtggtttcctgcacagatcattccatcaccaagtattaagcccagcatccatcagctattcttcctgatgctctccatccccctgtacctccaacaggcactagtgtgtgttgttccctgccatgtgtccatatgttgtcatcattcagctcccacgtatgcgtgagaacatgtggtatttggttttctgttgctgcatgagtttgctaaggataatggcccccagctccatccgtgtccctgcaaaggacatagtctcgttccttgttataactttatagtattccatggcatatatacaccacattttctttatctattctatctttgatgggcatttaggttgatttcatgtctttgttactattgtgaatagtgctgcaatgaacatacacatgtatgtgtctttataatagaatgatttatattcctttgcatatataccccatattgggactgctgggtcaaatggtatttctgcctctaggtatttgaagaaacaccacgttgtcttccacaacggttgaactaatttacattcccatcaacagtgtaaaagcattcctttttttatccaaaaccttgccagaatctgttgttttttgactttttaatagtaaccattctgactgctgtgagatggtgtctcattgtggttttgatttacgtttttttaatgatcagtgatgctaagctttttttcatatgtttgttggcatatgtatgtcttctctggagaagtatctgtttatgttcattgcccactttttaatggggttgtttgtttttttttcttttaattttttttaagttccttgtagcctctgtatattagacctttgtcagatggatagattgcaaaaatcttctcccattttgtagtttgtctgttcactctgatgatagtttcttttgctgtgcagaagctctttagcttaattagattccacttgtcaatttttgctttcattgcaattgtttttggcgttttcatcatgaaatccttgcctgttgactatgtcctgaatggtattgcctagattttcttctatgactgttatagtttggggtcttatattttagtatttaatctctcttgggttaatttttctatctggtataaggaaggggtcaattttcaattttctgcatatggctagcagggaatctttcctccattgcttgtttttgtcaggtttgttgaatatcagatggttgtaggtgtgcagtcacatttctgagttctctattatgttccattggtctatgtgtctgtgtctgttctcataccagtaccatgctgttttggttatggtagccttgtagtatagtttgaagccaggtattgtgatgcctccatcattgttctttttgcttgtgattgtcttggctatttgggctctttcttggcaccatatgaattttaaaatatttttttttctaattctgtgaagaatttccaatggtagtttaatgggaatagcattgaatctataaattactttgggcagtatggacattttcatattgattcttcctattcatgagcatgaagtgtttttccacttgtttgtgttctaatttttttgagcagtggtttatagttctccttgaagaggtcctttacttcccttgttagttgtattcctaggtattttactatttttgtggcagttgtgaacgggagttcattcataattctgctctctagtttcctgttgttggtgcatagcaatgctagaaacgttttcacattgattttgtatcctgagactttgctgaagttgtttatcagcttatggagcttttgggctgagatgatggggttttctagatacagtgtcatgtcatctgcaaacaaaaataatttgatttcttctcttcctatgtgaatatgctttatttctttaccttgcctgactgttctggacagaacttccaatgctatgttgaataggagtggtgagagagggcatccttgttctggcttacaagggaaatgcttccagcttttgcccattctatatgatataggatgtgggtttgttatagatggctcttattattgtgaagtatgttccttcaacatctagtttattgagagtttttaacatgaatgaagattgaattttatcaaaggccttttgtgcatctattgagataatcacatagtttttatatttagttatgtttatgtgatgaatgacatttattaattgcatatattgaaccaaccttgcatcctagggatgaagccaacttgattgtgttggataagatttgatgtgctgctagattcagtttgccagtattttattgagaatattcgcatcgatgttcatcaaggatatttgcctgaagtttttttttttttgttttatttttttaatctctgccaggatgtaacccatgtcttagtgcattaagaaacaccagtgcatggaggaagtctactaataatgcacatgtccaaataatcacagaaagtatatctatttatttatttaaaaatctgtaactttgttcaaaatatttttctggaactggagtatcttacagcagtaaaaatatttcctaaggtaaaaccaattttagagtatataccacttgtaatataatctacctttcacttgatagtctttatcgaatctttcacagaagtagacaggatatgaatgaatgaatagataagcaaatgcagacattctcttcattttatggaggcagtaactgctattaagtggtgttatataatgtactcaggatctcagaacaattaatcagcatggcctggctgcacctcaattcttctaactacaagatacttttacacctaaagcagctagcatttaattgactgttttaatagaaatacagggtgattaccaatctacttgatcctttttcaattctaattatttttctaccaaataattgcacgttttgagagtttctaaatactcaactgtgtgtataaatcaatgattaatttttccttgattttaataatgaaaatagagcttcatatgatcaagaacctgaaataatacagttcaattaacataattccattaaaaacaaaggaatggaacagttaatctattcgtcgtcactgtgagacatagcagatgttctgttaggctgtttgaaatattagaagtatttcataaggctcctatatctgtttttctagactacatattgagaactgctgtaattacagtatcatcctcagtgttagatgtaaaatgttaagaaaaatctgtccatctggcaagaggaggtaaaagtttgttagagtgggcagaagttaggtctgatagcacctaggtctagagaaacacaaactccaggtaatacatatattctagtaaggtttgctccatttaaaaaatacaaacttatagaaacagaaaggcatttattatgctcatttagtagcaataaatgccttctaatatctttgaaaatttatcatgcattctcttcttaaatgtcttcaatgtgtacagagcccatagttaataacaattctaattattaaagaatatttccattgatttcatttaagtctctggtcctgcaacctccatttgttgatttttggcttggccctttggaataactgctcagaacaatcttatcttgtacataaaattgctttagttattcttcataagatatgatttctatgtttatgactgcaatatttatagccaacctgtgaagagcgtactatttgccaggcatatttctatatgctttatgtgaatcaataatttaatttttataatagatcaatgagttaagttgtattaccatttccattttcataatgagaagactgcgttatcataaggatcaatagacaaaagtcacaccaaagtcacacagctggttagtaagtaagaaaaagttttgatggttggaacaaagtctcacagctagttaaacagggagccagaattcaaactcagacagcctggctctagactaacacgtttattttgtgctttattaaatacccagttattggattatccttctggctccaggttcttttttaaaaatagctttcgtatgatctgagaaatattcttacatcaaatacatttgtttgctctctctttgagatttcacacacagaaaaaacataaatgctcaatcattaaaggtggtgaagatagctctttctcatcttgtggtcctactgaaaagtcattaagaacaagaaatcctgtccaatgccctgttataaaaagtaatgacagtaaagaaattattctgagcaaaaccaactaatttcaacagtcacagcaaaaagtcaaactcagatgattcaatttactcattgatgtagaaacaggagaaaaaaacatatttgaatcagatgatcaatgatcaaggaatgatgtgtttcctgttaaataattcttaattaaagaggaatgtttttatagtttttcaatagaacatcttgctatgtattattatcttgagtcatgctcactgtttttacatactataaagtttaagacatgttttactttcttgtcttaggaaattcagtaaaataaataaattgaattatatattttttgatcattcagaggtctagcattttttattttcttctaaatataaattctcattatgaaactctgtaaatgtagaaactatggaacaaacaatatatagaatgctctttggagatcaaaagaaaattaatctttttcaagtgattttgaaaatgtccattctagtggaaggaatgctagccaggtagaaaatgagggttctaaaaaaactctgccactaattcacgtctttcctcatttgctaaaataaaggaatagggttaagtggccacaaattccatttagttctttagttgcattattagaaaagtgatgtttgttccttatttttaaagtgtgaagagcaaaaccaaaactgcaggtatttgaaattagctgtactctctttaatatagtttattgtgttgatgcattggtctcataagaatcaaagcctgcattctccgtgccggttgactttggagcactaatgagttgtaagtgcatttattaaaccagtatcactccacggcctaggcctttctctacagagaaaagagctaatgaaaggaactaatgaaagagactcgagctaatgaaaacaaaaatcaactcaacccccaaacaatggtgtctggagtagctgaattatccttcctcctaaactaagaagtgtctcgcatttccaaaccgtcagtactctattgtaattgcttttgtttggactacaaagtgtttgggggctccagaacgtagggtgattagtgatcccaatatccatgttctctctgctaaattgaatttagcatatttgttacaggtgatccctggggcctttgtacacacagaaagaaatcaaattaataattcaaaacgtaaaagctatctgttggtctctcttaacttaatttgtttggggtcaggtccacaccttctaattcagaacgcgatttcagtgactcttgagctgtgatgctcagtgaatggagagtagaaaagctcgaggagacaaatctccttaaacacaataaaaccgacagtgggagaatttccaaaatggggttgtgattgaaaatacacattgacaaaggcttctctttacttctgcttttcataatataaactcaaatatgtgtgtacatatatatatttaaagtttcagactgctgtaaaaattagtctgtctatggatccagagagttcatctatatcatagtggaggaatgtggaagatgagtgagaaagcaagcatgaagtcatgagttcagaaaagattgcaaaatgcttctctatacagatggtccctcatcacgctgtgttgtggagtgtcgtacagacaactgtgaaaacatggagagcagagtcttgtgtcttaagccatgcattgcctggtgcaaatgagaactccgtcatgatatgttgatttgaataaatgtatgtacacaaatgtaatcattttagaagaagcccagtcttacaggcataagcagcaaacctaaccacagcttccacctttcaaaagtccttcttacggtgctgaaggaatttattttgcattggtttgctggaaagaaaataatggtcttgactattacagttctttactttcttccagaaaagcgaccatggcctgggtatggttttcagactgcatttttacagagtatttaagggcaaaggggcatttatttttgccaaacagactgaatttcacaaatgatacatgaggattagtgaatggtgttcactgtagcattaaactgctttttttatggccagataccattccaatctaaatctgcagaagctattcatgagagaattacactgtgaggttacatttgggttggttctactcaataaagtgacataaaaagaagagccaatgtagtcaacagaatttctaagaggcaatcttattagttttcttatttataagcgtggctaaagcattaatggtgctttcacagattttacgccattgtgaatgcatgttgtcaggggactctctggatccacaggctaattttcacagcagtctgaaactttcaagcatggattaaaattatgcttaccctttacttactattagttcataaccctcaacatttatgtgaataatctaagtttctttataaaacatagaacagagtttgcaggcatgatacgcttcagaagaggtgggagcacaattttaggcaggtggtgaagaaattttgaaacaaattctgaatcaaaatttgtttagattacaaaaatagaagatgatattgttaataataacggcacaattatgtagtttctgcttaactgtttcagcaatggattaaaacaatattagagaaggttaaaacaatagaaattataatagcatatttctttgtagtaaattagaaatttaatatatattgttttatacttaattcctggggaaaaaaaagaaacttgtggcagttcagagtggattgcaataggatttattgaatcccctatgtgtgccaggcactcattcagggccgctctgcagggctttgtgatacacaaatcaaaagtgtgcaattcacagaaacttcaatgcaaacttttctctctctctctttgttgtgcaactcaggagccatggaagtttcttatttgatatagaaaatcaaaaggtatagaagatgaagtttctgcttttgagaaatttctactatgaggggaataggtgttacttttcaggatagtctcatggtcagagggttaattaacttgcttttggccaacatagctagtgggatgagtatataaaatctgaaattcagatggtctaatttaaaatttagtgttattaacattatattgcattaatttcttttaacctaaaactttgcaccaataataaacttttttaacttataattcttgtaaatttaactcctctctccaccactgcaaaaagtgcttggcaatgtgagtaccagctgcttttagaccctgctaaaaaactgtgcccaatattttgagtttccatttcagttctgcgtcttgtgacttctagttaaaagaattgtgtgcctttgtaagcgtagagtttgtacgaacaaatgatatgaaatcagttagacttgacatctaattttacatccgttagttatttatcagctgtaaacatctctagtagaattttaaaatctcagttccttgtacataaagggtcattgaagagaccagtgtttcggagatgtttgggagtataaatcaggcagtatattatataggcacttagtacatctgagagaattgataaaaacgtgtgtatgtcatgtatgctaatcacttcttagtaaacatatatttcaaccccctttatttaatgcttttatttggacatatgttgtaggagtcgttcctctcctcacaacaagatatgatcatgctatcatatattttaaagagttaagttaggaaatggagtcaattctcaacaggagcttatctgcagtagattgctttggtcaaatccaagatatacatacagctagtaaataacatacttggtaaatgatatgccaagatttggctgaatccaaagcctaaacttgtatatttaccagtatatactttctttttgcaaacaatccagttattgatcacatttccctataatgccgatgagttattcagcaaaaatatgacagtttagggaatgtctacattattcttaatttataatatagaaaatactgttaattacctataactagcaccatgtatctctcctagcaatactcttagaataaaccatagggctaagtccgcataatactttggagattttatgttttttgtgatgggtaagtgggtaaaaaaatcttcattccccatacaaatagatgatttttgacttagattaataatcagtgtctacaaaagaggtatgctcttatgttcttgctattagcaggcatgttgatgtggctatatatgttgcagtggtgataataaaaatgtggattcataatttttcacatgtatattagaaaacaacatgtgacaatgtctgtgttgacatattttccaaatttaatataaaacaaaactatttcagttttaaaaataagcacctaagtaatcacaataaggggagataataggaaaatttaaaataattcacatacttataaaatacaataggtaacataaagcaaaatgataaatacagaaaagctaaaaacaataaaacacagtttagaagaaacaaaaacacagagattatttgtatcctggaaacagaaacctctaaaacttgataaatatttttaagaacctaactttaattttgaaggatgcagtatgaaaacaatttatgaaatttcttaaacaggacaatagcaagtgcttggtgtataaactctatggaacattaactataaacatgttattccgttatattaaagaatggagaatataaaactgagaagaggctaagtagactgccctgttgacaagcaatatctaaagctgtattgttaacatttgttgacattgtagaaatattagaaagacaagaatctctataaattataattctaaaccatgggtccccaactgccgggccacagactgatgctggtgtatggcctgttaggaaccgggccgcacggcaggaggtgagcggtggcaagtgagcattactgtctgagctcacctccctttagatagcgttggcgttaggttctcataggagcgtgaaccttactgtgaacgtgcatgagagggatttaggttgcgcgctccttatgagaatcaagctaatgcctgatgatcttgggtggaacactttcatcctgaaaccatctaccccaacctcaccctcctgtccgtggaaaaattgtcttccatgaaatcagtccctggtgccaaaaatgttggggacgactgttctaaacgacaaaactactatttcaaagatataagcatagctcatgtatgtatgtgtgggttatacactattataacacagaataaaataataaatgccatattgaatcaaaactatatttcatattatctagtgaaatgcgtaccatgtttaaggtgactagagataattttggcatctatttaccattctccctcgcattcatacaaaaatattatggttgaattgtaagtgcattgctcaaaaatccttctcatgaaacgtaagcttatttaaaccagtatttctcaatttgtgcttcattgacacttaatcctataaaatggcaaactaaaaaaataattgtacatcaaaataagtttggtaaataatgaactttaaaatttctccttagatgctgggataaatatattaatgcctgctaaacattccatttgtttccttatattttctagcctgtttgggcactcaaatttgtgaggagttatggccaaaaaatgtgatcaaaagtgaagtggattttggactaagacactggaaaactcatgtgcaattccccaatctcgtttttttttttgtttgtttttgtcccctttcttaccggagtaagggaggaagccccatgttgcagatggtacaaccacaaaataacagtacctgtattagccaggggttgttatggaacagaacatcattgctatcccatgatggggacatagggttaacaatatacacatctttattgttaagcccctaggagttcagggtttgctatcgagacgtaatctagcttacattggtcatatgctatacattatacatatgtatatcttactagcaagcccggaatgcctagtatacatatgtgcaattcgtatcatataataaaaaactcttagtcttcatgcagtaaagggaattctcaaactgtttctgtcacatatcctacagttatttatccatagaagctttttttttttttaaagagtctattcatatccccttgatccagggttccatggaacacagcttgtgaaacactgattttagatggtttttcatcttatttatttcattatcctttttagcaacaagggatcaaacactgtgaaggtttactctctactggataagagagtaagtctatctttgcccaaatattaccttcagaagtttgggctacatatttataatgagctgaaaacttgtgttcatatttatatttcttttattagtttgcattttaattatatctaatttttcacattttcagacatggtaggttattttcatgaaaatagcaataatactactaagagtttctttttaaatagttttccaagtctttaatttagttgttctttcctggattttctagaattcttttactcataattgaacaccaaaaactatttttacaatggttgtacaatataatttctaaaagattaagataggttttttattgagctttggttgatatctcaaaacatttagagtggacaccagggaatactggaaaaatagggattcattttgctatctagttctttctctcgggcacacacttgttgaacatggtctgtcatcctgagcatagattttaatgcctctaaaatcatttctattcttcaggctattttcataccttaagaagttttcttttctaatttattcatgttagctttacattgcattttcaaaaacagaaaacagtgtaggatttcattatatcactttttggattatttattactaaaaaaaagtaccgccacaggtggatggagtatcttaacattaatacatctgttctcttttttaaaactggagagcacatttctccccagagaaggggactatgtatcccttccttatatttccagtgtttaagatattcattttttaaaaaacactctcttcaatttcaaagacatacaccaaagttatgttttctctcatatagtatgcttgtcaaagtgtttagcagcttatctattgatgtagatgccactaacttctttgacatgaaaacatttcttattctttatttctcatactgcttttagagccagtagctggccttcttttttcccttaagtatgaatattcatcaaggaacttgttggacatttttttgtttgtcttctcttctttcctcctggtattatatatgtttatttagccttaatcattacttcaaagtagatgatttgaaaattgtatgttctgtccaaatctcatctaaaaactcaccccatatttccagaagcccccaaacaaaatgccatctgcatctacttcttcatatttgaagtttaatttctacaactttccacaaaacagaattttttccttattttcatatatatatgggagcagaatgactcttgtcgtagtcacaaaggttccaacttgattaagcactttagagaggtacttaaaaaaacacctttccttacattgtatgcaaaattagcatatttttctggatttatgaaacaatcccactttcaaataatctctctcggataggcgtggtggctcacacctgtaatctcagcactttgggaggcctacgccagtggatcacctgaggtcaggagttcgagaccagcctggccaacattgtgaaaccctgtctctactaaaaatacaaaaattaatcgagtgtggtggtggaaacctgtagtctcagcaactctggaagctgtggcaggagaatcgcttgaacccgggaggcagaggttgcagtgagctgaggttgtgccactgcactgccctgtgggcaacagagagcgactccatctcaaaacaaaacaaaacaaaacaaaaaatctgtcctatattaacataagtatattaaaatttgacagaccagttgctgtactttttggattggtttttgaaaacatagactttagtagtaagaaacttagtggagtaaaagtaaatgaagatgagtacttttaaaatttaaagtgtggtcagttaaaacttatttaacctaacactcaattaagtgtatgaaaagtgctgagatttatccattaatttttctcataagaaactagatcacgtatttcttttaccaaaattctatttgacattcaacttaaaatccaaagagtgtaatgaaagcccttaagataatgactgtgaaatagcaatatagcctgacgtttaatgaagtggatgggtatgtctcttacctaaagagaagatgtgaaaatttaaagtcacactggttatgctgtctgtgtgtatatcttcatttttaaaaaaatcagactcttgagaatttcattacctagccctccaccaaaacaatgcatctgcgtaaatatttcacaattttccattgttttaaagttggctgatgagaggttacttagtactgtttggtatttttcccaaatcttttataccacaacccggaagtacccatgcctcacttgtggtaacataaatacatagattcatatttctgattaagttataattattattttacataaatatcttgtctagttatctgaaaaacctaatattagaatttaagatagggagatgttagttcagtgaagcagtatcttcattaccaaatacgtaatgtgattgttgattgtacatttggaatgtcacacagttcattcttgttcccactggacataaatcaagatgttacattgacaacttgtcctacaagtctaaaataagagtcagttttgtcagaattgtaggcgtatttcacttactcataagttgaagattttggagagatgaacgaggtgatcagaggatacattcaataatgtttttgacctttatttaaaccctgtcagtatgaaaacttcagaataaaactataaacatatgtaatgagtgtgactgtcaggtcaaaaattcaaccgtgaaaaaaattttctctggaagacaacttaatatctttcttaagccctattcttctgggttggcaaaataaaattttttggggggtttgtgactaagtttcagaggactttcatattgcaagacaattcatatgcaagttgtcctcaagtcatctctctatgcggtatctcctgaaagaactgtctccctatttggtcttcgattacagatacacatcaactctcttccctgcccacctgttcctttcatttaaagtggccctctctgctgctgattacatgcatggccatggagatcattctctggtttccatccatggatgtcagtgtctacaagatgagttcattggcctaaacctggcatgcatttcctcttgctgatgctctggagtctactgaggaaggtcctctttgctcttgaatctcgcattcctctctgggtttttgccagttcccaaaatctctacctgagaagaaggcatggagctcctctcagcatcgcctctcatctcttctgctgtgtctctcttttcttcgctcctgggtctccagctggagacaaggacacagagatgatcagatatttactagtttctgcattattgtctctttcccaagaagtctcatggaagaaacaaacaaacaaaagagggtaaaattggaaaagataaaacatgtaaagatattaattttttgtatcttccttgtaagcttgacatcattctctttcaaaacacaaaggtactgtcatgtatttgcacatccctcatgtcttctgtcattatttactcttctgaaattatttcttctcttggaggagtactttctctgtgtaattttcaaatgttgtttgtgtatatttctgtgtgtggcaaaacttttgaagtcttctattccaaagagtatatatatttcaacctcactttcaagtgatgaaatatctatatataaaactgtaagccacaagttatttttcttttacactttagaagggttcatccttatcttcttgcatcgagggtttcttatgcccatctaatttttgttccttgtttcgggaagtcttttgaatgtttgcactttctttacttaaaatatactatgatacatctaagtgtaggtttttaattctaaatgttatgtgtgttagtggtgagataggtacaaatgcaatagaggaaactaggaaaaattctcaatccatttggggtgtgtgtgtgtgtgcgtgcgcatgtgtgtgtgtatgtgtgagtgtgtgtgaaacaccttcctccaaatcttaatcttacaggtctttttacctcatcaaaaaaactcagtaggtcaaaaactctgtgttgaattggtacctcttgaaagagcctgatgccccactaacatctgtggtccatcttgaatggggacagcttatcacaatagaaggagctattgatcgtgacttatccttgagtcccctcctgctcacttgacatttttgtggtatcgtactagccctgcacagcacacctagccctgttccgtggatttagccttcaggattccaacattagtacttgaggcttgaggactgaggaggtgagtgtaagcactaagcattcttcttgtcttgggtgcagatttcacagtatttccaaagattcgttcatactccatggcttgtgcttttgaagtttcgttttcattaaaaataaaaacatgggccgggcgcggtggctgacgcctgcaatcccagcactttgggaggccgaggcgggcagatcaccaggtcaggaaatcgagacaatcctggctagcacagtgaaaccccgtttctactaaaaaaaaaatacaaaaaaaaattagctgggcgtggtggcgggcgactgtagtcccagctactagggaggctgaggcagggaaatggcgtgaactcgggaggcggaggttgcagtgagtcgagatcacgccactgcactccagccttggtgacagagcgagactccgtctctaaataaataaataaataataaataaataaataaataaataaatagataaataaaagcatggtcaggttttgagaatgctgacatgactaaaaataattatactttacgaccatcttttccctgtaaagttaaatggtaattgcataatcgtatttagaataaaagagagtttcagagtgtgcctctgctctttccacccctttcattcataccactatgctcaggcctccctgtttagaaatttggggactactcctgagatacagagtgagaagaaggaaaaattaggacaaagccgtaataactcttactgctcccagtatttgcattaattttttgtgttaaataatttaatccatctaacaaccagtttataacattagtgaccacagtgtcgtcattttgtaacaaaggctatttggaaaattaccaaaacccaaaactgagtaagtagcagagctatattttatattcaggttttgtctgcctgtcaaccactttttttataaagaagacatctagattaagaggcaaaagacagagctgctatcctagcgctgtcaatagtgtgatcttccataagccatataatttctttgtgccccaattttatcttttgttaattaatagcataaagccctattctagctggtttgagcattaagcagaattacataagtatagcctgtgaatatggctagtattatcacagtgttctgtatacattagctgaatttcagtttgtgaaaaattaatccatatcccattttctcagtagaataaactgtctaattagttggtatttatcatgttatttatttatttattaaatttttttgacagaatcttgctctgttgcccaggttgtagtgcagtggcacaacctcggctccctgcaacctccgcctcctgggttcaagcaattcttctgtctcagcctcctggaactacaggcactcgccaccatgcctgacaaattttcatatttttagtataaacggggtttcaccacgttggccaggctggtctcaaacgcctgacctcaagtgatccacccacctcagcctcccaaagtgctggaactacaggcatgaaccaccgcacccagcctatcacattttttaacacagtaaaaatgaactgacttacatgaatcagaaatttgtatagtgtaaagatttactaataatttaaaggatacaggtaatacatagatacaggtggaacatggcctgaaggacccaggattcttcctaggtggatagatacatcctggactggatacatctgctggaccaaagtaatggatgagccattgcaatgaaggtcgctgttcacctcatgtagccagaagtatcatgaactgttgccactttactgatcattcagggattacatgacattttccaagagcacatgcttcataaatccatagatcctctctctcttttttttttttttgagacagcattttactctgttgcctaggctagggtgcagtggcatgatctcggctcactgcaacttctgccccccaggttcaagcgattctcctccctcagcctcccgtgtagctgggattacaggtgcctgccaccatgcctggctaatttttgtgtttttagtggagacagctttcaccatgttggccaggctggtctcgaactcctggcctcaagtaatccacccgcctcggcctcccaaaatgctgggattacaggcatgagccacccaccgagacacataagccaccacgcccagcccatggattctaagtgtgttcacctaagtggttccacaccagggacattctgctcaaatcatttcataaacaaaaaaacttccttctaataagtattagtacagtttccaggaagggtcagattttataccagagtcaccaaaatttttatccagggagagaaataaaaccaggctatgttcaacccaatcctctccatgtggccaaagtataatgagattgttgtaataaatactgcagtaaatattatgattttattttttatgcctgacgttgttgtaactgtaaatggggcaaaatcaaatcaagtatcatagattgagtagctgttgtgtacatggtagctttgaaaaaagagaaatttacttgtgatcaaaattcctttcaatgtctagaaatgcttgcctcttcttatgacatgataccattcttatctttgaaacagaataccttatataatagaaacctagagcaagcaatttcacatgaggtaacaaaagagttcccagagtttttccagatcagtggaagacttaagtacaggatggagggaaattttaaaattgttcaaaacaagaaagcatttccccattagagaatcaaataactgaagagagggtgtgtgtgtatctctttacagtttcttttctttttgctgtttatgtgcttgcattatcaagacattttcccaatatcctacttttattttagtagcattttcaaaatctgtatcaaataaagatagcaagtagtagagcaagatgaatgagggagggagaaagaatggattggtagtggaaacaacatttcccacaagcctatttattgtagcattgacagtaggaattcttataaatgctaggttaacttgaaattctaccaaatgtctgttactgtttgttttaaatagaattctagtatctcgggtaggaaatttattacaggcaaccctaagaagatatattccctaaactctccttcaggtgatgggattaatcttggtaaagtgactaagttgcttcttgatggttggtacattttgaaaaagaagaatcacattaactccagagcagaaaagaaccgtagatcattcttactaagttcattggtcttacatgtaaattgagaaagattgctgaaggcaagattgccccaaggaatttaacttgaaatcaagaggctacataaatgtaaagtgctactgcttaaataaaaaatattatgttttaataataatcatgataatatgacacagtatgaagcaaatatagtgaaaactagaaaacagtcttggaaacagttgctacattgttattaaggactaaaccaatttagaggatcgtggctgtgaacattttaatatcccactcagctccaaattatctagagaaatcttctacacattctacaatatggaatgcccaaggctgagggtgttgcagaaaataagataaaaaaaagaaattatatttgcaaccagactagcactttcttcagaacactgtgatgtcagtttcacatcagtgaacatttattcttaaaaacaaatccctattattctttgcctcagtggtcactgagctaagaaaaagaccagttggttctaggggaaaaaacaaaacaaaacatgtgagacattgaaacagtaagtgagaagttggtgaaggtagctcccaggtggattctgtcacatgctgatttattttcaactctgaatatttagcattgcacagaacacttgagcaactcttgaagatccttatttagatggctggagagaaatctacttgaaatatacagtatactcacctatgagtcctgccctacctcaacaaaatattccatcgcttttattgttctatattctataaaggcccaaaagactgactatggaagtggactgcttacaacatttatcttagtccagctctgtatacagcatattaattttagactttttaggtattcaaaaagtagcaatttatactaactatggcttcaatacctagcaatatttttattttattgttaattttgctttaaagatatctattataaagagaaaaattcaaaacagtatcttaggaaggcactggtcagcttgcctaagaatacaggtcatattatgctattcaagttacatttcagattaatatacttctgctagatttatgctgcatctaacatttgggggaacaaatggatgtattaatatgattttaaatgctgctctgtgcttaacttttattgctcaatggagagtgtacgccacagcacagttatgccaagaatatggtttcagtaaaagaaaggagctaatttattgtctcaataactagctcttttcttatttgatgttaaagaaagaaatgtgcatgtctgaagttgaggttcagcaatgcattagtatttgccaaattatgagtgacccttctaaaggctataatattttagtttcacctattatgttatatttattttagaaccaatttacaattttcaaattgtttcctacatttttattagttttatgatgtaacatagaatatatactgacaaagacaatattattttctttgacattacataaaccaaaaaatatgcattgttataaaatatgagaatcttgcaactgcaaatcagaattgagaagctttcatgcttcattaacacctgtgctataaattcaggtttaacaatttgatgaaggaatatttcagattgcaataatcacagaagtatttattttaatagtttcaaaggccaagcagaaatctgttacagttaataaacatcctaaaatggttcgtgtatgataaaagaatatcaatggtgtttactcattactctggggattgaaattaaatcatataaaaaaactgtgtttaagttccatatgcatttgttccttaattgtcagtgttttgaatttacgtcatacgcacatttgaaaaaatggggataacaatttgtgaccttttattaataatattggcttccaaaattggatgataataagagagtctctaagagcttatcttttttcaacaggaagcttcctcttattcttaatttaattcacaagattcccatgaagtatgtaacttgaaatagcatttactgagtaaagaaaaatggttaatgctaccaacaccaatacatatttaatgattgagaaatggctgttaactatgacaaaactatcaaatcacaaattaagaggtgcctcagaaatcgattgtcatccttttatccacatttagggaaaccaaaacacagaaaagtaatgacaattttctaagacaaaacagcttgtcattccataaagtggctactacaattgggtctcctgccttccagctcaaaatatttcccctatactctgtaatttcagaagggggataaagaatataggattttttttttaactttttaaagttatttttatttccgtctcttttattaaattctttgtttatagaagattgcacttaccgttgctctgttctcatattttataagcactttgtttttgttttttttttattatactttaagttttagggtacatgtgaatataggatttttacagtaatcgtttgttaaaacattttatttaaaactaattaagatgcatggaaatttgcaaagttagtgcagagattccatgcattttaaactactttcctctaatggttgtatcttaccaaactagcataataaatggatattggtatgatgtttgtgtaatgtcgatcacacataatcactgcaattggaatatagaactattctgttaacacaaaacttttcttcacactacacctttatagttaaaaacgtcacccatcagccctatacataacaacttatatccgtctgctggatgtagaaaccttgactccctgtaagtccttttcagctttgattatcccagctccatcctctttcatctctttttctgttactctgatgacatgaatgctaaatctgttattacagtgccacagctccctaaggctctgttcattcttattttcagtctttcttttctgtgttgccgaggcaaggccattgataccattctttcttctaatttactgattctttcctctgccctatacattctactgttgagtagatcctattgagttttttattttgcttattatattttcagttctaagattttcatttggttcttctttatatcttctatttctttgttgagactttctttcattggtttcaggaatgtttattatttcttgttaaaacatttttatgatggctgctttaaaatccttgtcagataatcccatcttctgtgtcatcatagtgttggtatttttctattatattatgtaatttgtggcccttttttcctcttgtgcatgttggtatttctgggttattggcttctctctataagaaaatatatgaagcaaaaagaaaatccaaggaattcactgccatgtatcctcaggtccctatgtccccaatgaacctatcttttctctgcttttcagaatcttcttaatggatgtttcatctacagtatcaatgacttggggctgcagttcacagaaagaatagagaaattatgtgtactccatcttggagttgaactggtagccctagctagccctttgatatcacaaacacatatgtgataatgggtattattgaaagaaaggaaatatacttaaaacgacatttaagatggcaccttagacagaattttgcatatttcatgaatgcccctaatattaaactggttgatatgccttttagtatgatgacaagctttagttgacagtcgtacaaaacctgtgattttacagatttcaatcagtgatgattgagagacggcactatcctgtcagcacagaaccatgttccttgtattcaggtgaatgaagattatttttattagtgatgtacaatccagttgatttctgtggagcactgacatccaatctgcctagttatcagtccactatttctatacagaacacaattttaatgtcattcccgtgttcctcagtatatccttacattattaaatacggacattatgcaagttatttaccaacactgtttctacgttgtaccttttctaaaaagcttttcttttccaaggagataaaacaacaacaacaacaaaggtaatagtcataatacattttaataattaataacatgaactttgagctatcttaaagccaatattgcattttaaagaaaatatgacatttagctgtattaatactttgtgttttatatcttatagcagtttcagttatctattgctgcatagcataccaccccaaatctgacagattttaaatgacagtaatttatttcttataaatttgtaagtatggaattctgtcagggccaagctggttagttctattccacaagggtgggcaggatttactcattttctgcattaagctggtagctgggatgaaatttccaagaaaacttgattaacttatatgggacctaacttcctcgtgtggcttctctactgcgttagttttgttttccttaagattcgaaacagacttctaagagcatacaaaaatggaaacctacaaatcctcttaaacgaagccacatgttgtctattctgtcatattttactggtgaaaacaaatcaccaagccagcctaggtttaagagaaaagggatagactccacctcttgatgaaaggaaagacccaattttattgtaaaaggcatgtggaataaaagatattgttttatgatcttatcttcaatttttttcctcttggaaaattaacatttttgaacctcagggatttttacaaataatttgtaaattaagtaagcaattttcggtcttttaaaataacacatcacgtagattgaatgggatttcttatttcataatttgtaaatagagatgctgttattttcatagtaaaaatatttatttatttatttatttatttatttgagacggagtcttgccctgtcgtccaggctggagtgcagtggcgtggtcttggctcactgcaagctctgacccccgggttcacgccattctcctgcctcagcctcccgagtagctgggactacaggcaccgaccacatcacccagctaattttttgtatttttagtacagacggggtttcaccgtgttagccatgacggtctggatcccctgacctcgtgatctgcccaccttggcctcccaaagtgctgggattacaggcgtgagccaccgtgcccagccataaaactgtttatttctaaataattgtaattggtcagtgcagttgagcctttataatgtttagagaatctatgcccaataacagagattttaagagtattcagtcgatttcccttttctctggcattaactcaatcaaaccatctcactccttcatgtgttgtatagattttccaggcttatctctgacctttccaccactccacagcctacactcttgacataaacaaggccagctccatggggatgcgacctatgcattccacagggtgctgaactcaaataggctgcacattaggtatagtgctctgctgtcactgtcttgaaattcttaatcattttttaacaacgggccctacgtttttattttgcactgcgttgcacagattataagccagtcttgtttttatgtctagaatgagctttctatacctcacaatattctactggacaagttttcaaacagtcttcaagactcagcttaaatatcattttgattttcaaaattattctaattccctaaccctagctatagaaggaataagaagaaataaggtctcttctatatatatatatacgtatatatatacatatatatatacacgtattctatatatatatatacgtatatatacacatatacatatatttatttatttattatttatttatttattttttgagatggagtctcactctgtcacccaggctggagtgcagtggcgcgatctcgactcactgcaacctctgcctctcaggttcaagtgattctcctgcctcagcttctcaagtggctgggactacaggcacgtgccaccatactcagataatttttatatttttagtagagacggggtttcaccatattagccaggatggtcttgatatcttgacctcatgatccacccacctcggcctcccaaagtgctaggattacaggagtgagccactgcgcccggcctcttctatatattttgtcttcataccacttaccataaacttctattataataattgttttattattatttgtgtattcattttcatcctccattagttgggtttaaaaagcatgatactcattattacccacttagtaatttcccagtacataatctatgacatgtatagtaaatattcaataaatatttgattgaatcaaagaacaagtgaatagattaatgcaatgtagttatgtatccttctttaaaacactgtacattgaggtacggtataaatttgttcgataacagtgtttgccttatatctctagtgaaacttctcagttatatttttgtctaattctctttgatcctcactggaaatataagacatcttttgttatcagatattcaatcgcctttatacagttattacttgaacttaaattctttctttaaacttaacttctcagagataataaaagccatgcatgtggtttaacatttacttttacttaacatttgccattctgtatgttttattaatttatatttggaaactcatctaccactagattctaagtccttgtagaagcttttacttccagccaaggtggagtagcagggaccaaatttgctctcccctctgaagaaaacatcaacttagagaaaagagaatatgaaatagtgattttgcaagactctgaacatgagtccataaagctgtaaatgaataaagtagcatgatctttgacaggttggaaacaaatttgaagagacctacaacagccccagctactgtgtggaaagaatgattccaggatgtcatgcaggtccaggaggttgtctgttgtctctctgggttgaggcagagcagtcttgaaaggccaagctggccatagtccttagagaagactggtggagaggagagcactgcacagaaacgatgttccagagatctaagaagaaaccctccggaatgttcagtggagaactgattcgggagtgtttgaggaaactatctgaggcaggtaaataactactgaaatgattaaaaggaacaattcctgaagctcgcatagagctcaaactatctgctgcttattcccacaatccagagagaaaagtctcataattcatggggcatgggatagagtttgcatcagtagtaaagcaaaattaaccctacactaaatgctgctctgatctcaactaacaactttcaagcaagacccaaaatgtttccaagtaacttaacttgtcataaatgaagcttggaatatttctaggaaacacaaatgtccagatccaatgaggtaaaattcacaaggtctgtcatccaatcaaatgttgccaagtatgaactaagcaggaaaatataacctagaatgaggagaaaaaaatccaaaacaatcaatcaatactgaccaagaaataatactgatgatcaaagtagtaaacaagaacatttttgttttactattgtatcccatatattcaagaagtgagaatgatgagcgagcatgaaaattagaggtacagaagatataaaagagactctgatttaacttctagagattataaaatgcataggctgtgactgttggcagcttagagattgtaaagatgagtgaagttgaagacagcaacagaaaccattcaaaaggaaacacaaagagaaaaaaatgactgacaaaaaattaacagagcatcagtgagctatggggcaacttggggtcctaaaagggtggagaagcaggagaaatgtttgaagaaatgaggagtgaaaaatttccaaattcgatgaaaactatcaattaaaagatagaaaattttcaaaaaaaatagaagttcaaaaaaatggaaaaagctaaagtacatcattatcaaattggttaaaactaaagataaagataaaattttaaagttatgctataaacttcttgagtaggattgaatgtagttcaacatagtgacatacacaaaatggctgcttattctatactagtagattcattttatcaaataaaatcatttcttgttatagatattttttaaaccttagatctgtcggccatttcttagtattccttagtatgaagtatttcttaccccctttacgtatttctaagaaggtaggtgacatataacaaataactttgaaataaaagttttagtttgagtttgtttacgcagaagcaagagattttgcaaaaggaacacttgttttcaataatgtaatggtctagctgatggtcaactgactcaccttttaaaatttttactgtgtagtaagaaagttgggaaggtagtgtgaatccatttacttaatcctgggacacgttaaaaagaggactttatgaaagtcctctttagtgtataaataaataatactttatgaagtattgtataaattagtatatacataatagtatatataaaaataggtatacatgaatactgtatgaagtattattttcataaggcagctatattgattgcattgctgaactgtaaaaatgattgcaaaccaaaataagagagatagatagatagattagatagatagataagatagattagatcatagatagataatagataaaaattaattgttttggaaaaatttggaaataaagtgaatataataaatacatatatatgttagcttagaactggcatctgttaatggaaaaattgtattatacttttccctcaaagttccttactttctctgaaaccagcctgtatataacaatagccagtccgtatatggctacgcagtttatcctgatgtagttgcacaccttcctttgtgccctgaatgtgggctctttgagatccactgctgttaccaccatctggagactgctcgggctcctctctcagtctgtggttttatgtcaaatccttttatcctttaatttccacatctgtacatcctccttagcactaaggcatcttttgataatgattataggcatgcaacattgccctagatgtaaatcaatcatggcaaatacccttgcagagaacagtatctctctataaggacatacaaaagaaaactgtattatgcttgaaaagaaatatttctgagatcactttattcttgatctctgaaagtcattttaatcctgcatttttattcactgatgtatccttgtatctgccatctctttctacactacatccttttatttttcccagggctaagtacccgtatgcttttcctttcaatttcaaaatgtggaccagatgttgggacataagtactagtttggaacaaacatctgtgcccttttcaggcaagaagaaatgagaatgaggtcaggcatctggttaaggacacaggaggcatccctgtctcgtttcttaattagttcttctaagaccttctctcattctatacataatgtttataatttaaaattcatagggtcttatgttgaaagggagaaaccactgtgtggaatataaaataaaaactcattttacagtggaaaaataatttaatctatccagcttattatttttcctgggcataaagaaaatacaataattaggtagctgcatattttaatagcttttaacgctgattgtaaactcaatactgaagaaattagtggtcagttggtctttctatttttattaacgaaaactgccaatgagaggaaagctaatttaaaaatcgtacaagagtaaccttaaaagtgacttaaaacatgaaatatataaaacacatgagccacttatgctgttataatttctaaagttataccatattggctataaaccatgaattgatatgaaatctgagcacatgcatacatatcactcatccttatacaagtggagagttttttcttaaaaaaaagggggaaatgtttatgtttcaatatacttgttccattcctaataaatgaaattcattgctgatctccataatgggaattcttggctggtgtcagattaaatgtgaatttttggaagtttgtgaatgccagaaaataaaaggtggttgatttccaaaatcaaaagtaagatactttaggtatgtatgtatatatgtattttaatgttttcagcaaagccaactaggaacacaaaaagcaacagcagactagcaaatcacaacaagatttccgggtcagtctgctggtcaaatgaaagttcttatctacctatgatttaggtgtaactaggaaagcaagttgcttgacagaactgaaaatagaacaaaaagttccagattcatccaaatctgaaagtttagatatggaaaacttcctctgcttgggctttatataaattttctgaagtctcacagatcctttcaaagggtttgctgttactgagaatagaaataaaatctccagattcctcaaaatctgagattctaggcctggtttacttgttcttttggagttttaatttttaattaatcttctcccaaacttcccaagttctccttaaggcctcacatcagtttttccagctgtgatgctgtgaagcaatgccttgtcagcatcaggcctaaaagaggtcagtatccctttaaaataaatcttagggtttcactaaaaaaataaatatgtctataagcattcagctgaatgtggatgatttatgcttctatacatgcaacagcccatttgcaattttgctttaatgggatagagaacagatctaattagtataaagaaattggtaggaaagacagtcttagaaatcatctaatccacaaagtataaatgacaactttctattctttgtccatataaaaatttttatgtaatttaattaatatttaaatgtatttttttcaaactgcattgcataacaccttgatctttattctactggcctcattcagattaaagttttgcagattttgatgtggaaagcactatggaatcaagcctgagaggatcagaatcatcatttgtcatttgctaaatgcaatgtcaagtggtaattcaagataaatgccttaaagataattctgcagtcacagacgtatttttagaagtgttgaattagatttcatattctcaacacttctgtgatctttatagaaagtgatggacatatgaggtacataaactatagatagttatgattgttttagaagctgaggtaaagtgtaatgtcatcaagggactgcatgtgatgaataaaactaatgactagaaagttaatcagtgtgaatattcaaaaaatgattatatattcatttttgaagctataaatgaatcaaattataatttgattcatttatagcttcaaaaatgaatatatatatatatatatatatatatatatatatatatatatatatatatatatagtcacccaggctggagtggtgcagtggcacgatcttggctcactgcaacctctgcctcccaggttgaagagattctcctgcctcagcctcctgaggagctgggactacaggtacgtgccaccatgcccggttaattttttttatttttagtagagactgggtttcaccgtgttagcaaggatggtctcgatctcctgacctcatgatccacccacctgggtctcccaaagtgctgggattacaggtgtgaacaactgcgcctggcccaaataatgtatttttatgtttaatttgcaaaaattattatttttatttatttctcaaggcacatgagaaaatatcaaaaattatttttaaaaagcattaatatataatatgatcatcactcaacaatgagttactgtcatacacttgtttgaaggctacttaaactatccataaaaggaaccaaatcatatcctttgcagggacgtgaatggagctgggggtcattatcctcagcaaactgatgcaggaacagaaagccaaacacctcatgttctcatttacaagtgggagttaacgctgagaacacatggaggggaacaacacacactggggcctgtcaggggtatgtggggagggagagcatcaggaagaatagctaatggatgctgggcttaatacctaggtgataggttgatctgtgcagcaaactaccatctcacatgtttacttctataacaaacctgcacatcctacacatgtaccctggaacttaaaataaaagttgatgacaaagaaaaaaagactgtgagatgcatgttagattattgatatctaattaatttcatttaataaatgtctattaagaaaaaaatcccatctaatacgaaaaccacgcaggaatgtacaataacaaaatcaaagattcagtcaccctcacatgcatctcttttctggaattttggtttgtagcacatgctacaacattagacagtagggtttatgtggtacaatttttgtggaacattagattttacatatgtcctatacacatacatatacatacatacaaatatctatgtaaaacctgattcattttgtgtgccaacttgactgggctatggggtacccagatatttggttaggtattattctgggtgtttctgtgagtggtatttgggaggagactgatacttaaattggtgggctttgagtaaagtagattgccctccataatgtctgtgggtctcctcccatcagttgaaagcctgaatcaagcaaaaagattggcttctcatgagcaagaaagaattctccttcacaatgctcactgcagatttaggacttgccaccctcgatgattggctgagctaattccttataatatgtgtatttctctctatatatacacatcctattggttttgcttctctggagaactctaatacaatacccacataaaatatgtcacttcttgttggttatgaaaatactcttgcatatcaaaaactctcagcactacttaacaatcagaaggcaacaagattatatttctttcaaatgtaactcacagattcccctcttaattcctaccatgtaatggagaaatcaggcctgcttcatttacaccatctttgcatgacttctactcaccgatgaaattgattttctcaaaatagcatcaacattaaaatttgtcccatggatgctgactccttccatggttttccaagaaggagaaaatatatagatggttatgtgtaggtccatgcgtgtgcattttaagaatacgaatttccacatgctgttagcaccagtcatgtgatattagctcagcaggtattaccacctcactccctcaggtagctccaattgcaagagtgatatagccaaaacttacaattggaacctggttataatatcaacatcacagcacaaattgcatgtagctcaggtcactctctttacttgcctccttgcttcaaaggaactaccttctccttgcaaatttacccaagcctataaagtgcatggagtgtcagagaataaaatacttcctgaacatgacatttgggtaaagtttgattgtctaattattatggaaagaggaaagggaaggacgcacaaaaagccacaaggaggttttaaaacacaaggaggggccactggacaagcgcggtgcctcacgcctgtaatcccagcactttgggaggcggaggcagatgaattgcttgaggtcaggagttcaagaccagcctggctaacatggtgaaaccccatctctacaaaaatacaaaaattagcctggcatgggggtacatgcctgtagtcccagctacttgggaggctgaggcatgagaattgcttgaacttgggaggtagaggttgcagtgagccaagttcaggccattgcactccaggctgggtgacagagcgagactccatctcaaacaaaaaacaaaacaaaacaaaacagaaaacaggggctactggatgcttgtgagaggcagaacagaggaagtttaacaacaaaatggcggccaagcttgggatttagaactattggaacaagagcagattcctaaactggccaaatctcaggagaatgttgacaacacctgtgataggttatatataaattaatatacaaattttgaaattgtcaggagaatgaagtctagcttcacagcaaaagcagttcaatacattacttgttttaataaaaaattataacaaggattattaattcttattaagtgttaacaagcatgtggagaaaagggaattcttgtatactgctggtgggaatgtaaatcagtacagccattataaaaaagacagtatgaaggtttcacaaaaaattaaaaatagaactactctatgatctagcaatcttacttctgggtatatagccaaaggaaatgaaattagtatgtcaaggagatatctgtactccatgtttattgaagcactgttcgcaatagccaagatatggaatcaacccaaatgtctattgactgataaatggataaataaattgtatgatatatatgtatatatactacaacatacacatatataatgaatatactacaatatgcaatgaaatactatgcaacctttaaaaagaaggaaatcctgtcctttgtgacaacatgaatgaactgggaggatattatgctaagtgaaataagccaggcacagaaagacaaacactgcatctcacttacatgcagaatcttaaaaagtgaacttacagaagtaaaatgtagaattgtggatgtcagtgtctggggtatagggcagggaatggggagatactggttaaagggtacaaaatttcagttacataagataagtcagttctacagatctattgtactgcatggtaactatactttaaaataatatgtaatcatgtattatgcttttgaaaatcgcatagatcccaaatgttctcagcacaaaaacaagtatgggaggtgatggatatgttacttgggtggacttaatcatttcacaatgtacacatagatcaaaacatcaccactgtacaccataaaaatatgtaatatttatttgttaataataccttaataaggctgggcgcggtggctcacacctgtaatcccagcattatgggaggccgaggtgggtggatcatgaggtcaggagatggaaaccatcctggtaacacggtgaaaccccgtctctactaaaaatacaaaaaaaaattagctgggcgtggtggcaggcacctgtagtcccagttactcaggaggctgaggcaggacaatggcgtgaacccgggaggtggagcttgcagtgagccaagagagcaccactgcagtctggcctgggcaaaagagcaagactccgtctcaaaaaaaaaaaatataataataataataataataccttaataaagctggaaaacagaaaaagaaatttagtaagaagatacagtaataacttttagtagcatttgtttattgctttgcaaaaatctttaaatttttaaaataaatgtgattctcacagaaaaattatctaagggagttagaaaactgtagtggaacgtgtctagacaagaataggtgaattgtctgaattcaaatctagtgaggagtagaatcagacgttggtcccttaccttttgactccgtacactgtatgtggtaaagaatatgtgaaaaataggattcagtacctgtctaaatttaagtgtatttgggatagacaacttaaatacccacactagacagcattaaaagtcacataatgctttcacataatcatttgtaggtcagtgttctggaaaaaaggaaaatcaacgtagactaggctatttttatgtcaatgtaaactgtcactgctaaaaatgaaccagaaatgtgaaagataaaatattttcttgtttcctaataagcttctctcatgctccatggttatttttattttttgaatacagtgcaaatattactttaaatattctaaattttttcttagagtttttcattgaagaaacttctatttggcgtagtgaaaagacatattctctgaggcttgaatgagttagaagacctccgaaaaataggtgatatgatccagagaatagtttggagccaaaaagaataataccacatgtcactacctggagtaattaatacttcttggtgtgtagcacactgttttatctctacttaaaccaaagcatagccttgttttgttgtataatttatcagttctcttttcttctttgtttctcctttacaatttttcttctctttcttcaagaagagatctgaatgagaattagtatgtttactagctctgactcatatgcagaaccctgataaagaaaacagatgatcctctatttccctacacagccacattctcccccttctaacttcacacataaagggaagttgattattatccagacactgtcttcccttctgaccttggtgttttcctttccgagcatctcaggatactaatcactagttgatctctttattaaagtaacactgctcttgatattggtgtgagatgcactccattagtacgttttgttttcagaatatctcttatcaaagccagatataatatagcacacaaaatagtatgtgttctgcaatatcaagaaaggagattttttagtcaaaatatatcattattactggataaatacacatgaggcccacgcagagttcttgacattggaaaaacttatttactccttgtagcggggaatagtatgttgacttagtagcattgtggatcacatgattgatcccttgcaacagtttgggcgtctctctcatcatctctttctgaatagtccagaaattagtagtagttctaaaaattacttaaattacccaacatcaggctatttcctcaagtcttctttagagggaaataaccagattgatggaggaggaaacaatgcatcagacattaaccttcccccttgcaggtgaggtaggcctacactccagttcgtcatgggagcaagggaagggcagaaagaggaagttgaatagactagaaagtattagaggataaatgggaagaaatagagggaggaaaataaaactggaaataaaaacttaagacagaaataaaaacaaaaaggagagtgatgaatacaagaagagaactgttatcttgctcaattcttcctgtctctgataatctattctatgtttcctcaagggctttgttatattaaatgagttttgccagaattatgtgtactgttgccatgatttccatgtattcacctttctttttgaattcttctgtctcttcctccttcccttctttttgtctcctgctacccccattagttccaaattctaagcaaaggtaatctactcttcagtataaatgaatgtttctgtccagtggaatcaatatgttaaattatcttgccaacctgttaaccacgtgtcaggaacattgttcttaaatgtgattgtgacaaagcaactagatatcacagtatacaagtaatatatatgatacacacacacatatacgtacatatatacatacgtgcacatgcatatatacacatgtatatacatatatgcacatgtatgaatacgagtaatatatacacatacatatgtgcatgtatgcatgtatattatatacatgtatacagatatatacatatgtgtatatgtgtgtatatatatagagtaacttaaaatattttgacaaaaataagttttcatcaatactagattctaatatagtgttaacaagtgctaaaatttaaaaaaatgatggcaggtttgtaaaaaacaataaaatacaatctattcacttatctgtttcccataaaaacagagaaaggttgacatcctttgtttggtgtggatcactattttaggtgagcctgggaggaatgatttgagaagcagtgctttagaatatctgaatttgagaccagatcaggaaacatggatatacaatgtgtttgatcctgctattattttaaattttctcctacttattttcttatattcaatttggtcacaatgcattttcaaaacaaagcgttcattttttgaccacaaaaaacagttcgttaatgaaccatctcaacagaatacttttattttgctcaatgtctttcctttgaaactgtttttttttttttttttttggctctctttcttttctctccaaacaacaaacaaatgaaaccgcaaaaaccctgtcaatagaagtaaagtttttaaggcagatttattgtctttcctcctccctatcagaatatttaataagggtgtggctttggaaggaaattgtctcagtgatggcagaagaaatctacgtaacagatcatattgaatatattgtcctaaaatgaattatttcagagaatagaagaaaacctcttatttgttaactcatctgccttgtggaaattggaaacataagctaattaacagtaatccataaaacccattagaggtgtagatgggaaagatactttttgaagtagtaagtctgtaaatacatagttgcaccttcttccctctttttctcttcctcctccttctcctcctccaattccacagctaatattttcactatttgcgaacttatcatcatttttaatactgaacacgttattctgaagtgatccatcttgcattctaatatcgagtgcttcataaatgagcagcctagcaccacgcttagcacactatgttggaaagtcttataaatgactttgatcacaaaatgttaagaaaaagttgtttccagattggctgggcaagcgggaatgaatttgagagttgtttcactgcatcattctggttgcaaatactctcttgaattttaatgatattgtagcctgcctcagtgcttggaccccatcaactttacttccattttctagctgccttttctgcagtctatgatcattccatttctgaacctagtctggtgtctgctttaattggcctgcttttgtgatttgttcagttagattggagcttttcagaaagatagtcagaagccctgcccatcaccgtatccccagctgaagcctctttgactagtctaaacatacacacacacaccacacacacacacacacagccctttatttgtgtttgtgttttctagtgcaagatgttgcagtcttgagtccaaatactcagaggctataaaggcaacagtagctagctaaatttttccccactaaaaagcaaagattatgaagtttgtttttttaaagggattaaaatgtggcagggtagcaaaaaggactcagattgtggaatggccttgagcaaagcattaaggtgcaagtctgcagcacagaacagtcagaaacctacccagctgtgggtcttgttcttcctccatctaagttccagagctattagcagttccagctctaactcttcaatgtgacttttagtgaggtgtgtagggtaaattgaagtcctaggtctcatttgtagaaaagtattaggtgggctgttccctagtctgtttgaatcatcaaatcatagaatttctgtgcattccatgtatgtgtggcagaatcacttccctttacacaagatggctaaatgtttaaccagcttctggagaggcatttaaaaatgggatcttctgagactttgcatgctgtcttcagacctatcttgtttcagagtactagagattgatacggcaggataggttattataggaaacatattttcgtagtccagaaaatgagaatttatttggtttatgttgttgtttttttatatgattctttggctaagacactaagaatgaaatctagttattgaaatcaattttatcaggaattatcacatatacggtgtatgaaaattattatctggaagttggaaattattttctttgctcttttgttgagtcgcttattgacttaagtggtgtttgctacttacctgagtagtgggcatttgaattccaggactttgattggacctctggtctggttttgactgtttacgctgggctacaccataaaagctcgttgggttctaaagactgagggaaatgatgatgtaaactagaatcaaaaagttgtttttacttccaactaaccagcaaagaagcgattcttgaataccaagtgaggggattaggttcccttcacttccctttctttttggtaaaagctgatacaaagtgaaggatgcaccgggtcagaggatctgagaggtgagaattctgactttcatgtgagtggctgggagtgggatcacatcagctttcaaataagtttttgcagcatcgctattaggaattctgtgctgtttcgtagaacttcatctttcctatacacaatttcgttacagcagggctgcatttgaactacaacaatgcttaccaaatgtgtttcaacaggctgttgttttcaacactggttaactgttaaattttacctaatacaaactgatagaaaggatcattactacagattagtgagtacatttaatctatcttttcacccttttcccaaattccctttcctttattcatttggacagctttccccaacaatatttattctagattccagtagaaaatgctgattttgaagtaatcaggaatttatagcataataaaagaataatagttttaagcgtaataaatgactgaaattgctcataattgtttgatgattttagtcattgaaaagcctgattaggcttcatcttctgatcagaccaattgttgaataattgacaagcaactaattaatcctaaaatgaaacagtctgatctaaaatatccctacttaatactttattgtgcttggcatactgctgttcctgtgaagacagctatagtgttttgatgattatgtgcatagctgtaaaaattaatatggtttacacatacctcttcagtaatatattttttatacattcaaatttatttcaatgtacttttatcttgtccctctttaaactcttctaagtacaaagtggtatcattgggggattaatggctatttaataatttaatgttaacaaatgacaatatatgaaagacttccatcattcaagtagcctaaactatttgcaaagaatttatgaactctatcatatttgaaaattagcgtgttaattttaatcagttttcaagtatattaccacttcttaactatattactaccatctggtcttctattccttaaaatgtagaatgttctggtaattattttgcctttaagaaaaactaatacaaaaaccaagtatttgtgatggagtcgttgacatgactgatttcagtatctctaagtaattagttaaaatatgcttgttgctttcattaaaagcaattttacacagactaatgcaaaagatgatggtagtaaataggttttcaggtcatttctgataaagttaaatgtggttgtcatttcaattgatcattctgcatcttttccagactgtccatccatctcttggaacagcctgttcaataaattctacaggaaataatttgggtgattttagagaaagtgcatccttagattaaatgcttttgggtacttttatttatttctatgatggataagaatatatttcagagtgttagtttcctgatttataattattgaatttccttgaaaaataactatttgaataaatcccaaatgaaatacaaattctgtgcatctcaaggaaaacaatgaattcaggtaaagttgatctagtactcacataactatatttacatatgctagataaaattattgattacttagcacaaagttataatgtcttcctgttattgaaatattgaataataccttggaatagtgtgagagcaatattgttcaatgtaatagtagttgattaaaaatacatgcatacatggcagacttgacaagcatcttatttattttgggaaaaacttgttcaagagttaaacagtttcataaagaaggtgcatttgtgttctctaatacaatcaggtaaaagaaaaaaggtaactagagataaaacagaaatcttgatagacagtatagaaagattttgggtgcaaaagaaagcataatattagacatctaaaattttttaaaaagtacatcaaaattatctcaatctggagaaagtcaacgaagaaaactaagaataataacacagtatgataaagaccgtgatcccccacttgtaggtaagaacatgcatcatggacataaagatggagacaataaagtgacgactactagagcagggaggagtagaggggcaagatttgaaaacctgttaagtactatgcttagtacctgggtgactggataattcataccccaaacctcagaatcatgcaatacacccaggtaacaaatctgcacatgtgccacctgaatctaaaatcaaagtcaggaagaaaaaaaaaaaaagaagacaatgatctgggtaacacaggaagtgcaaggagagtgtacaacccagtctaatgagtttcaaggaaatgtcaaaagactgtgagattgaactgactctgataattatcagtaggaatttgtcttgctgttgtgctgaagttcatgcaaaaatgctcaacacatagttttttttgtttgtttgtttgtttttaaagaatttcgacaaagaaataagctctctgctttggaaggtcggtaaaagtctaagttgcaacttaaaaaaagatggcaaagctgattcacctgttgcttctaccttcctcagtaagaataaatagttgggaatctggaaggagtttaaaaaactctgcaaaatgaaaattatagactgagataggtgaagcaaaaataagagaatgcacaaccaaattaaatgttagtctctagaacctgataatatgtctaaatactgaagaattagaaaagtgtttaaaaaaaactgtggaagaaaaagaggcacaggatactgtatagaacacttgttttctctgatgtcaagtaaaagaaatgatcagattctaaaggcaataaattgataagttaggacaatttttaaaacatttcctgaaatactgtgttgttgcaaagtaatatgcagcatccagctcctccttccaggaagatctgctgtcccagttgcaggaagtgctggaggtgagctgcctttacctgtcgccccctttggggttccctgagagtctggctgagggtcaagcccacatcacagcaacccttctccttctgaccaatccagctgccttcccctccctttcaccagtgtttgccccaaagcaaactccagtagccatcctgcacatcatctcggtcccagagactgctccccaaagaagataccctgagaaaatgttggaagcattaaaaaaaaaaaatagtgccactgcccagttaaagaaacagaatatgtataaccatttcttttgaagctcatacatgctctttctcttctcaaattgtttccacaaacttcagaggtaaccactgtcttaataattgacttttttttttttttttttttttaagatggaatcttgctctgtcacccaggctagagtgcagtgacgcaatcttggctcactgcaacctctgcttttttggttcaaatgattatcatgtcttagcctccctagtagctggaattacaggcacctgctaccaggcttggctaatcatttatttttatttttagtggagacaggttttctccatgttggctaggctggtcttgaactcctgatcgcaagagatccacacgcctaggcctcccaaagtgtgctgggattacaggcgtgagccaccaaccccagccttaattgacattttttttttttttttttgagacacagtcttactctgtcacccaggctggagtgcagtggagcaatctcggctcactgcaaactccgcctcacgggttcacgcggttctcctgcctcagcctcccgagtagctgggactacaggtgcccaccaccacgcccggctaattttttgtatttttagtagagacagggtttcaccgtgttagccaggatggtctcgatctcctgacctcgtgatctgcccgtctcggcctcccaaagtgctgggattacaggcgtgagccactgcgcgcggccttaattgacttttaaactaatcactcctctgtttttctttataaatttaatcacacatttgtatttgtaaacatcatgttttattttgcatatttttgaaatttatatacatggaatgagtctgttgatagtattctttattttgttttctttaccaaggcagctgaagatgcaagggaatagaagatgagttcacaaagaaaaaataaagagataataaataaacatcattaatgaagggcatatagagaaacaactcttacttgcaaaatgcctagcacatatgactcccactacctgatacgtccctttctcctttctctgcctggtggagacttgcccagatattgcctcttctttcctgaatgaatctttctaatttttcttggttgtgtttcttgctatccctaactgccatattttattttattttattttgtttcatttgttgagacggaatctcgctctgtcaccaggctggagtacagtggcacagtctcggctcactgcaacctccgcctcctgggatcaagcaatgctcctgcctcagcctcccgagtagctgggattacaggtacgcaccaccacatccagctaatatttgtatttttagtagatacagggtttcaccatgtcggccaggatggtcttgagctcctgacttcatgatccgcctgcctgggcctcccaaagtgctgagattacaggcatgaaccaccgtgccaagcccatattttatttttttttatctgaatcccatgtatctattttactaagtagcccagccagataagagtaagccttactaacaagaattctgtaaaaagtcttcctacctttgctttcagaaccatggacccaattaccaattttctgtttgtaacgatacttacatgggttaataaaaaatacaatattcacagaatgattgggagtggaataagaatcacatattattccccaaaaagagttagacaaatttaagttatattgaaaacaagcaataaacaatacaggtggatctgataaaaatcttaatccaggttcactagaaaatttgatgaaaacatgatctgggtgagaacttgctcttgttctccattgtttactggccttcctctgtctggccacatcctgcaacatagaagtcacttccttgaatcagagtttcagacaagtcttaagtcgaacctttgatagcttcaagttctccttattagcttgtatgagctgtatacatttttaagtcttaaaatattcttggttctctgcttttatgctataaggcatctcagctgtgaatcaacaatggagaaatagctgctgggtttaattggacccaatagtcttttctgatggcaaaaatgtaatgagttccatgatgtttgctgtgatagagcactcctttctgttccatttccatgtggccttgtgccagcataatgaatgcctcacacatagtagtttctcaatttgtgtgtgcagattcaataacaaatgaatgctcaaatgaaatctcaataagataaatggcgtgtttgaacttctcatgtaacacatatatagttaacacaaaattattttaatgataactattcagatagtgtaggcacattttgaattatccagaaaattgactttttaattcctataagtgagtgttggctattgcctaaatttgagaatttcaggaattctgtggatagcaaatgattagaaattaagatccataaatcactttttttgtgggaaatggggaccagttctggtagctgaataaagaaaattccaacagattctgtcagtttcccagatttcttaagaatctgaaatgaacttgcaagtttgaatgaaaatgtccccaaagtagtgaaaataaaagctctcatgggcatcctggtttggaaaaatattataaacattttatgtagctcaatttaactttcctacattatcgtcattctgcaaatgcaccgttacataggccactgttctgtatggtgtttcaggtagttctgtttcacagtgggtggatatgactacacagttccacattaatatatttagacctaatgtagggaatatggaggtctgcgctatatatggctcgtaaatcaataacaaatgagtccacatttatgcactatttacagtgaagttttgtatattctgcatccaaataattgcacttattatgttccatattttaaagaaaaatcacatcttttctgctgtagaaaatggctaagtagataacggatttctgaactaaacataatatgtagcctcaaagttaaagcaatacgcttgcattgcactcggataaccactaggacctcagagcatgagagttctaatcaattttgtttcatatgatttgttcatcattaatctaaaaatgtattactacccaacacttacataaccataccataaatatgaaaaagtaaaatcactacatctaacaattgatggaaatatatatgtgtatccaagctttaaatcaatatagattctctacaagcaaattcaaatattttcttttgcatctttctagtattaaaatacgttttacacaagatttgaatatattttcctttcttagccacgtagttggtattttgcaaggtcagtcagcctagctgagagtcgaattagtttgagcagatcatacttggacgatccaatgcacttgtaattctgctccttgagcttagagcctcttttaatattatcatttttatatattataattgtacatcttttcattttaaatgtaatggcattagcagtgggatactagatacgtgaagccaaatgataagtgtgcttaacatcatttgcagaatttgtagatgtttagagaggctagggaagaattatatttatattcagagaagtagatctatatttggcctgaattttcaacatttgagatttaaagaaatgttgagcctacaccttaatcatgagagttgtccgtgatctagcatctctgaaggaacgtctacaggctctgtggggaaaaatttctctggcagggtcagggaaagaaaaggcttcaactcctttcagttaatgcccaaggtgcccatagacaattctagaagcacaagagtggaaagaggtcactgggtaatgagtaaaactgttctaaggggcatgtctcattaggtgatgtctaggcagaatgtataaaaagataaaaagtccttgaattatctcatgcttttctggcttttttcttgcctcttttcccttcttcttttcctttcttcttttcctattttttcctttctactataaaaacttcaaaacagcccacttctatctttcctgtccctcaggaaaccaaataactcattggatgtttgagttgaatttgatctaaaccatctcttgatttccagggtgacaatattcttctttctttcttggatattgtggtttactgaagaaaattaatctcaataaacgcccctggatttaaactatttttatcacagtctacttctattcagtttatgttctttccacctgcaactaaaattatgcaaaccttaggcatttgtttttgtgatacaatttatctccgaatacctattttgtatgtttttccccccatttttctattcaattcagtaatccacaatgggatacagtctcctgggtcccacaggtttgtctcaagtattgttttgttcttccaaaaataacatctttaaaaatcatatttacattttgattacttctgtcttgtagaataaaagatttcaggattgtgtccaccgtacaaaaatcagaaatttatttttagtaagagccatctgtcagtcagaatctgacctagctaactgggtggatggccgaggtcattttaatgtagttggctagtaaaaccctctctactctctaaagaggcctaggttggaatggactctccatgattgggataaagattaaaatggagtgtttggagattctgagtgctaaatcaatatttctgcacaatgtatttcaatatatttcaggacttctgtgtagatattatttcagtttcaaagtgcatttatttttttttattttattaacctacttttccaaataaactatttgtttctgaatatttatatatatatttcatttatataatataaatataaatatatatttcattttccccaaaacatatacttaccactcatcttggaacaattttgagaacatttgccagaattttccagaatcccttcttattttatttatttatttgtattttttttttttaccatggtctacctccctccatatattcctttatgtgtcttgccaaacagggaaggagaatgctgttgttcttcacatgatttgagctttagcattggagggagttggcattctatgctgttatatttcctgtgttatatacaatactctgttattgcccaaagaatcattattgattttaaatgaactgtaaatcatcaatcgatctgaaaatagcacagacttagttacaatcatgaaaataacacatctttaaaaaaaactaagatcagttttatgttaattgtattttatttaagaattatagtgtattattaaataagcaaaggaaaaataaaagtagacctgactgtatctagattttgaagaaagatgttggcatttatatccaggtagaagtgtattgctcaatctgatgctgcttctcatctctacttatcactgtaaccagagggccaggtttaagacttaactgccaccagcttaggtgtgggtaactcacttgtgttctctggagcttagatccctaacctgtaaatttggcttgaaacatatgcctgagcacgagcgcgcacgcgcgcgcgcgcgcacacacacacacacacacacacacacgtacttacatataaacaaatatgtatatgctatatatttgtgtgaagatacatatataatttatttttctgcagactggatgtcaaaaaaagcacatatttgaaatattttgaacttttggataacaaatttacatgatgatgtgattctaatatattgggtatgttttctagctgttcttagcttgctgggttcaggtttctaacaggtcacctggcaatgcagtgattagaagaaacttcatggaagagatggggctagtgtcttaaagggagaagatatgaattggtagaacagaggaaattcagttcaaacatagaaaaaggaagccctgcattaaaatttgttacagtacatcttgaggatgagaagagacctatttcaatgaatgaagtggttttcatttggaaataggcagaaaaaaatatagagtgcagaggcctttaggatcagtctgtgttaactattagttttcgggaggcagagccagccattgagtggtttggacaggatggtataatgatgaaattgaagtttgggaatgattattctggcagtgaatggtatacagtcaagatctgggagaccaagattgacagactgaaaatcagtgggaaacagttgtagtgatctaaataggaagtgacaagagcctatatcacaatagtgacaagaaaaatgaaaaagaatgagtatatctgagatagatggcaaatgagtaactgacagtatttgatcatacttccagtcctcccaataccccaaaatatcacatatatttttggccagggagttggagctaatgatgttgtcacagtttgacagcagacatgaaaagtagaagtcacagagaagctgaagaatttagttttcaactaaatttatgattttttatgttgggaaattaaaaatatcctaaaggcactctaaattgaaaggtgacccacgtgaaatatcaggtgagttgatattgattaggaagctgtctctacacaggtggttgttgaaaccgaaaacggaatcagctctcactgaaatgtgtttcccattaggctatctactcctcaggataaacctagtcatttgtactggtttcagatacagtaaaatatcaacttcacctttatttttctctcttttgcctttaagtacaaatgtaaattttttcttctttagttacaagaacaaatttagagtaggttgtcaatgtctattgccaagtaattgcaatattcacccaaagaatcttgtaatattttatgctcattagcaattccatttgatatccaaaatttcaacaaaaggaaaattatacacttgtttatccaagctgaaggcttttgaagatactgcagaattcatagctgctatggaaaataaagcagcataactaactcctggtatttattttctcaaaaaagagatttgattttttttatttcttttttgtgtgactgtaattattatcattattttttacttttggagaggcaagcattttgtgctatgaattgaacgtagagttgtacacagaaaaatatttgttttcatgtttcctttccctaaaatgtctgctagagtacagatgaagattctacctagaatgaagataatcttttttgaaacaattggttaagattaaattgatttggtttaaataagactatatatggagaatctaataaacattgagacaagtagatacaacaatagtttaaagaagaaaaactgaatacatcctattcagtacaaccttagataaaatctcatgaatgaaattacttggcgagtagggctacaaaaaatagggaaatcataggcgcacatgctctagcaactatggctacgcatacactgccgcttcccaaaattttctatcaattttaaacaaaggtagagaataaaattatggatactatcttagcaagttttcttattttttttaaagtaagattgctagtgctgcatgaactatttgttttccccaaacacttgagttgcaaagaattttatttcatggaataatagaatccattaactatgatcctagagaaagagaaagttttcaattagttaatataattatatttgttacaagtcaatcagcaacaactcagtatttgaaaatccatgttttagtttcaactgaaccactacctagtcatgaaattgaggaaacgaatttatcactaaggacctcagttggcactgtaatattcattcagatagattattttaaaaacaaaatcaggtcatacatataaaatgactgtgaagactctaactgctttgtgaatgtgttgctaagatcattctagttttattatttgtctcatggaggattccattatacatattttacttttaagtgagtgataaaatgttaagcttcctaatgatttctgtggtctctagcatagagatttgttacaaaaagggatgccatattatctatgtaatcattttacataatacatggagttgtactggattaatctcaaccatttttaatttaactattactttgtagttgaacttgagcttcctctattcaaagattccagtaatcattcttcttcagcaaacacacacacacacacacacacacacacacacacacacacacacacacacatcttctggattgtatactaaaaatttatatattttggattgaaattaatttgtaaccaacaaagtttattatttagagactgtgattctgcccagattaagatttgtggcgttatgtttaaaaggaagacaataatacctaaattagatggtcagtgttaggattaaatgagataagggtcagaaagtgagtaatataatgcccaacttatagcaggtgttaaattattgtatgcattctaccgtcctccacaagcacacacggcccctcataacacaaaataagcactgaatataaaagcctcagaaagattaagtggtaggaaaagttacttttactctttggtaaccccagacagagagttggtttggggtttagttaggaaagcatcacaggtgagaaacacaagtttgaggcagttttatggcagagtgtggaggtttagtctgagtttgcggcttttctttcctcattcatatctcgtcaattaattttcccctttaaggaccctttcaagcctgagagaagagtacagaataaatcaaaagaaagagtggagagacaaaaatgaatgcagaaagagggatgcaggaaacaaaaacccagcaagtagaagggaatagtgagaataaagaaaacgagaaaaagaaaacaaacaaacatgcacacaaacaaaaaaccaccaagagagggtgatccatacctcacagtgctaattaagttctaagctggtttgacatttttgcctcctggacaccaacaccctccaagcggggcctctttgatttggtctcacatcagtagcgggctttgttatgagatctaggtattaaccccacatgtggaaagataggttaatttgactaaatatattttttaaattctccgcaccattgagtcatctaagtgtcacatctagtatctgccacctaatgttatgcttagcttctcctccttcaagtagagaaatccagataaccaacccctcccctcttcccctctacacacatgtacacacacatgcacacacacaggaaggcatgcatgcacagcacatattaaacacacaaatgaataaatagtagagtccgtggatgatttagagacatgtgaaaagtgaaagttttgggggctcaagtaatttaggagagttttctattaacatgtagtttaatgttgtctttccagttaatgtagttatataatatgtaaattaaagatggtgtctactgcctaagtaattattacaacaaataggaccgattattgaaggtgaactccttccttttctgttctctactcaaaacaatacttttaaaattgcttatttagtattgaagtaggaaaaaaataacgttgatacaataaaagaacttatttctgactggtaggtgatgataggatctgacaagggggtgtacttcagagagattgtcaggattctacacccttgtctgtgcctaggaaaacagcccaacctacctacctttagttttgaatggaggctgcaggatgttactcatcattgcttttagaacaaacacttccctttgaacgatgtcacatcactattaccatggcaacagacgccctataaagatgagttatctatgaattgtgcttctgttcaataaacacatctcttaaattcatcaggaaaaaggtttagtggaggcagttctatatattgacatttcttattctaaacctctgtctgataataaatattcatttcattaaagtgtttaattcaggtgtctttcatattagctatatcacataaatttataacagttttatgaatttaaaacagttgctttattataaaaatgatgtatttacataataaatgagattattcttatgctaaaaagcataaaaagaaaaaagaactctattctcagtgtctaaacatacagtgaacaattaatttataaaaaattaagtttatcaactttataaacaaataattttataaactttataagtatagagtcaagaattagcttaatggaccaaaaaaaacccaaaaaacttgtttcaagttaatgacttttagaggaatgcaattaagtgggtagaaattatagctccatatattttatttattttattttttatttttttgagacagagtcttgctctgtcccccgggctggagtgcagtggtgcgatctcagctcactgcaacctctgcctcccgtgttcaaacgattcttctgcctcatcctccagagtagctgggattacaggcgcccgccaacacgcccggctaattttcgtatttttagtagatacggggtttcaccaggttggccagactagtctcaaactcctgaccttgggtgattcacccacatcgacctcccaaaatgctgggattacaggcgtgagccactgagcctggtttttccaccaaagtagcaccctctgggaatgaggtaatgataacacaccgacagcaaattatttcgtagaatcatctcctcctgtctaaactgcaatctacaaaaatactttacataatagataaacctaagaggaaaatataaagtccaaaagggtaaatttctaaaacgaaattgtaaataaaagaatggaaatgattggatgccagaagaaaggcaatgagaataatttgtcagcaaggagaatgatttgattataggtaccagtgtcatggctttataaagatggttatgatttcaataggtcgcaaaaattacaatgtatatgattatatatcttaaaataatatgtaattttatgtaattatacaaaaaacgttcagcttctattctggacccttgaagaacataatattaatattttatggtgatctattcataaagaagttgatgcacctttgtagttattcttcgtcccaggttgcagaatgcaagctcccactgtcaattacacaaatactattggtttcacagtttgtgagtgtgtgtaatttttaagcaatttcttagaacctataaaatatatatatatttttttttttccttttttttttttttttttttagacagagtcttgctctgtcacccaggctggagtgcagtggtgcgatctcggctcacctccgcctcccgggttcacgccattctcctgcctcagcctcccgagtagctgggactacaggcgcccatcaccgcgcccggctaattttttgtattttcagtagagacagggtttcactgtgttagccagaatggtctcgatcctgacctcgtgatccgcccgcctcggcctcccaaagtgctggtaccacaggcatgagccaccgcgcccggcccccagaacctggtatattaatgaaaattttttttttcaaatctcagaggtaaagactagataagaaattgagtgaccaaaatcatatacttctcctaacctgaaactgccagccagtagtaaatggtttatcaactcattccagcaagtaaaatacatcagttaatactcttgcaacgtaaattggtatattgtagctcatttggtatatctcccaatattcctaattttcattttttagttcttgttaatcagtcctcaccagtcctaatcaacattttatttacattttacttattcgtaacattagaagaaatgtttgggtaatatctgtgcatacaggatatattttccaaggcaatgtagcatactggctctagaaacagatctggagtttaatgccatgtcaatcactatgtgaccttttgcaagttactcactgtcttttatcttcagtttcctgaatacaatgaaaccatctactgcgcagtgtttttgtgacaattgaactcaataatactgtaaagcacttagaacaatttttaggacataataattgttcagtaaatgtattccacctcctcatcatcatcattggaattattgcagttattttcaaccattattcagatcctattgaaaggttgaaggcttgtagaaatatatacggaatgattttcactgtcgctcggagtagcagatttatgaaattaattatccttagctccttgtgctaatactgtattatccctttagtcattttagcctggaattacactcttaaatataaccaagatccagtgggctacatcataaggaaaaagtagaagtggtgttgaggggcgtctcctgtagacaagaacaagtaagctaatttacttgaatttgactttgaatagaggtgaaaacttcaccaagaatttattgtaagtgtcccagtttaatagtgccctcagaagcctgtctaaagcaaacacaaatcttctctggaggaaagcaccttcaatctaaacttcaaagcatgcctatatataaagctcaacttactaggagtaaaacaatcaataataaaaaataatgataacttaaaaacataaagaaaagcaaaaaattgagttagtcaaagcaacagtcacaagactccaaccaagattcctagtgggtgcttcataaaaattgacaagctgaatctaagacctaaatggaagagccagaggctaagaattagaaaaaaaaaaaaaaaaaaaactccagtgaaacaaaaatttaaaaagtagaaaaagaaggagagttttctggatagtaaagtgtttgtgaagaaaaggtaaattaagggcatgtattcattttggatatagatgattttatgttttgtatgtgaatgcatatagagggatatatatgtatgtgtgtgtgtgtattatatatatatatatatatatctgtgcatgtgtatacacaaacatacactcatactcacattaggttggtcacagtggctcatgcctgtaatcccagcactttgggaggccgaggctggcggatcataaggttaagagattgagaccatcctggccaacatggtgaaaccccatctctactaaaaatacagaaattagctgggcgtggtggcacacacctgtaatcccagctactcgggaggttgaggcaggagaatcgcttgaacctgggaggcagaagttgcagtgagctgagatcacgccactgcactccagcccggtgacagagcaagactgtctcaaaaaaaaaaaattgtcataatttaaacatgaaatattttctcaacagcagatacaggagaataatagaccttgattgaataaatagatatcatggaatattatacatactcatggtcgagaaataaaaaaccttccaacagtgacattacttaatgtccataaacatttaaattattaaaagtgtttctcatttactatctcttcaatacaatatattttatttgcactggaaattttaaaaaaatatttttaaggccgggtgcggtggctcacgcctgtaatcccagcactttgggaggccgaggcaggcggatcatgaggtcaggagatggagaccatcctggctaacacggtgaaaccccgtctctactaaaaatacaaaaaattagccgggcatggtggcgggcgcctgtagtctcagctactcggggggctgaggcaggagaatggcatgaacctgggaggcggaacttgcagtgagccaagatcgcgccactgcactccagcctgggcaacagagcaagactccgtctaaaaaaaaatatatatatatatatatatatatatatatatatatatatatatatacatatatatatatttaagcacagagttgtgaatagcatgcattattgcatattgatacacattcattgttacataattttacagttaaataagtgagggtcagatattgccaaaggaagagttcaagagctggtttctaacacaggtcttatttttaaagcttgtttgtgtgtgtgtgtgcgtgtgtgtgtgtgtaatttttttggtttcctagtaatcgggagttttggaaaattatgatctcagtatgttcttaaaaatagtttatagataattccaagaataaaaaaagtttttaaatataataaggaatcttaaccaggtaaatgtatgtcttattttttacaaaaacagttaaaagttaaaaaagaaaaatagaaaaaaattataaaatagggatataaagaaaatatttttgtacagctgtacaacgtgtttgtgttttgagttagatttattacaagagagtctgaaagttaaagaatttaaaagttcataaagttaccgtaagctaaggttagttggatattgaagaaaaatgttttctacacaacgagtataatctaattgtatagtgtttataaagtctatagtagtgcagggtaatgtcctcagccttcacattcacccaccacccactcactgactcacccagagcaacttctagtcatgtaagctccgttcatagtaagtgcactatacaagtgtaccatttcttataatctttaatgccatatttttactgtactatttttatgtttatatatctttagatacacaaataccattgtgttacaatgaactatagtaacatgctgtacaagtttgttacctgggagcaataggctgtaccatatagtctaggtgcgtagtggtgtgtaccatttaggtttggttaagtatgctatatgatgttcacataatgaaattcacctaacaccacatttctcagaatattttcccactgttaagtgacacatgaccgcagtcatgcccaccaaaattcaggacataaaattgttattgccagttagaaaatattatattggaaaagtctgaatgctgtctaaaactaagaattacaaaataaatagcattcaggatctacctcctttaggtgtgagattttgttttaaacttttttgtttatattcatcagatttgcaggataacataaatactcaattatcctgagtcgtttatattcacaaaagagttggtgaatctttttcataaggatgaaaataggaatagacaaaaaagacattatactaaaacaaaaatctctgaaaccgtatcagaaagaaagaaaagaaagaaagaaagaaaaagaagaaatacatgtctgctttgaaagcacacttgttttgacttttggaaggtagaagctttgttaagaactgagttgtcttattgctacaccccatgattagagattaattgtggcatatttcttcttgaccccttgctaaagattcttcagtctgcaagttggagcattacgtctttcctccaacccttacatattcttatttttaaggtatagtttttaaaatatagttattttctgttttctttactcttggttcaaaaagcataatttagaaattgatcgtgctgataagaatacaatggcaaaagataaaaaagcttttattatagcattataataatgtgtgttatgtacgaaaaagagcaagactaggtttttttgttctttctgattttgccaggttaccttacaaatggtagtaattatcctcttttcttaactttaggcttttatgatcttgcaaagatatgacaaaaatgggaaagtaactgctaattgctattttttttttgcaatgttggaaagtacactgtgacaatgtttaaaaaaataaaacagagagtggaaaaaaatcaccatcatcaagcagcctttattaaccacttatttataaggtgatgccacggcagacaggcaggctgggagggaggatgtaagatgcattagtcacctgtgctatgtcctgtgtacttattctatcccaatgaatgtccacagcaattctaagaaatttgaataatgataccaattgagagatgaggaaagtcagctcagaggtatagcaaaatttcttatgtgatacacctaccagtggtaagtggtagaattggatttgacccagatgggtctgatttctgaacacatgctctttccttcatatttcctgtcatgatggaatgcttacttttttgaaagatgcaattcccagataacttttcagaatatagagaaaagataatcccatgaagcttttattttgagacagggtctcgctctgccatccaagctggagtgcagtggtgcgatcttggctcactgcagcctccacctcgacaggttcaggtgatcctcctacctcaccctcctgccatggagcttccttaaataataacagagtgatgaaataatctgtacaaaaaaaacccatgacacaaattacctattaacaaacctgcacacgtaccccaaacttaaaataaaagttaaaaaattaaaaattgatatagaatctgtctatacaatttaatctgtctatacaagttaaatagattttaatcttcataaaaatatgcctttcaaatgtaagattgcatgtttttctttgtatcagttagtagtacattcattacaaggaaaccaaaaatgtacccaacccacagcagtcttttttttttttttttttttttttttttttttttttgagacagagtttcgctgtgtcgcccaggctggagtgcagtggcacgatctcagctcactgcaaactccgcctcccaggttcactctattctcctgcctcagcctcccgagtagctgggactacaggcacccgccaccgcgcccggctaattttttgtatttttagtagagacggggtttcaccgtgttagccaggatggtctcgatctcctgacctcgtgatccgcctgcctcggcctcccaaagtgctgggattacaggcgtgagcaacagcgcccagccaccacagcagtcttaaacaagataaaaatctgctttgctctaagaaatgtagagataatcatgctagggttgttttaaagcaaaaaaataaaaagttatctgagacacaggtgccttccatctcttcttataggttctagagtctggaagaagggattagggtgggattggttctggctgctacagcattaacttcattaggagaaactctgggtggattgggtaagtcaccatcaggctattggccagtcatgaaataacagatatcatagaaaatcagagtgcccatggaagtctgttttcggaactttacgatgataaatgtgacagatctgggagcaagtttaattgccaggacaatctggagagctggaggcatattcttttgggagagccaagagaggtgcttgacagatggtactttgcctcaagcctgaaagaatcgaaaggttcctgtctcattttttcacatctgttcttggctccctaagtattactcttctatgtattcccctcacctagatgccaagtgttttctctaagaaaacattgcatcttttccagctgtactgtaacttcactctgtgacttgaatttaacacaattttattgcatatgaaaatgaagaggtctggagatttctctcttatgcatgaattgccaaaatgacatttctaaacctagaataatagttttctttagagaatgagattcgctaggacccacattctcttcaattaaatcttaatacgtataagtcatgatctcattgaaataagtcattgattcattttttccatattaaaagataacaaaaacggattatgatagactagaatgcaaattctaagttgtttcagtgccaaacaatgattggtacttaattttattaggaatgttatactaatgcccagttgattctgacaagcatgtctggatttatttgtaaataggttagttaatggagacatttaaaagattcctgaaggtacccaagaaataaaaacgctaagaaatgaaatcattgcaaacatatgtctcgtagttgacaaactcttcttttaaaatggcaaagtgcaatgtcctcctaaggaagctatgcttatctcttcctagactgatctacaacttaatgctaatatctttaatttctttaacaaacagtttaggtaagttacatttgagagtcaaaagtgagggcagaggagggacttggtgatcaattttccccacagcaaactgagaaaagaaaatgaacatgagatagttgacattcagaatgttctaaaaaattcagaatatatgattgccataaagtctggggaagagaggcttacgcagcatcctcaagtacagatactgtactaacacaggtaatgagtgaatggtgttcagatcatgggcacttggtacttaaagaagcgcagtgagacggaaataaggaaaagcaggcaagagcccagctccacgtgcttcatttacaatcttgcttagagtcagccctgtttaaaatggaggtgtggagagacagagagagacccaaaccgatctgtaagggacattaaaggttaatagaactgcgggtcaatgttcagagatttttcaacaagtctgagaagtgttaagaaaagaaaaaaagactaatggctaaaaccaaatatcatttctctagatttagcccactcttcagaggtcttgctttgtttcaaatttttgaatccgttaattttaaacatttggatcataccttgaattttttccgtcaaattgtatcaccacatctagtcagacacgcggcttgctcttttctttctttagtcttacgcacgtgaggaatttccactgctacaaaccctccatcccttcaggctttctttctttcctcccttcctcccctcccctcccctcccctcctccctccctccctccctccctcccttcctccctcccttccttccttccttcctcttgctttaatgtgtgtatttattattcaagagttataagtagatattaattatatcagatttatttagctatgtcataaatttcatttattgaaaaaaactgtgtgaaatcaggactctgtaggtatacctggaatgcatagtcattttaaaaccaaactctctattttgttaggactacgctaccacaaaagcttctcacctgctcctcctaccttccttctcttcattcaaccattcactgctgcctaatgaaacgctcttaaaacagaagttttgtttgtttctgttttttgttttgttttgtttgtttttgagacagggtctcactctgttttttgtgctggtgtacagtgccatgattttggctcacttgcagcttcgacctcccaggctcaggtgatcttcccacctcacctgcccaagtagctgggatttcaggcacgtgccaccacgcctggctagttttttgtggagacggggtttctccacgttgcccaggctagcctcaaactcctgggctcaagcaatcctcctccttggcctaccaaactgttgggattacgggtgtgggccaccacgctagggcacaacagaagtttttgagcttttagagacagtagtgttttctcaagggaaatcttattagggacatggaaacagagatttcaatttgaacagctgtgcactggcacagcagaaaagactgaagccacacctatttgaaatcgctaaagttaccacccatttttcagcagtttggggccatttcccaagtctgcattttaattactatcacccaacaacagttccttccttgaataattcttaggttaaaccttttttcacatgtaccctataaatatgtacaaatataatgtatcaatttttaaaagttactgaaaactccttaacatctcactattgccttcatgatcctcagtctcctttgattatattaaaagattatattgaaaatgagtaggaaatcaagtagaaatatataaagagcattgcaaaaagctaatttagtttttaacttgtctaattgaaaaccgaacctttctcttactgctcttttagtagtaataataatgtgtatggttcatgagaaaggctataaaatataactaagttttacattatccttacatcagaactctgtgtaacactgatgcaggagttttctcagccaatttgccaactggggacctccacggccagtgacacacacacccccacctgctaccagggccacagttggccttggaactgtcattggaggtgccctgcccacttggcctgcgtgtgctacagcttgtacccatgttcggcgattcccaagctcttgtcccccatccaagaagaatgaggatatgctgacaattcgaagggtgaagatgggtggagaggaattttattgagcaagggaatagctctcagcagagaaggcacgtgggggtggtctccaacccctgaagtcgggtggtttctttctcagtgtggctgagttcaggacttctatgggctcagaataggggagtgtgctgactggtttgagtatgcaaaaaaggttaaaacaaaagcaccacttaaaggtgggcatgacagtataaaaaacaaattagggaaaggtaggtatatgtaaaatcagtgatgggtagggatcaatcagaagaaagcgcatcaaatgggaagacaggttctcaatccagtccatagatttgacttgtagcttggctttcaggctttaaactgcctttggtttggaggggggatttcactggggacctgcccctacctgcctaggcatttgtctgcctcctgccactatcaacacctcacaagtttcaataatcatttgttgtttttttaactcaacaaatatttattgaacagctactatattttatatatctcagacactgttttaatcactaggaaaaaatatggcagtgaataatataaacctgtctatcctcatgaagcttatattccaaaggaagaaaaaggcaatatacaagataaattagaaaaatgtatactatgctaagtattggtaagttgtaaaataaaaaacaatcacagaatggaaacacaaagtgtaaagactgtgggtttggataaaatggtctaaacatgttttcccgcgacataacttttgagtaaaggctgataaatgtttgttgagtgaaacaggtatgaacaaaaaacagtaagacatttaagtgtagaattcaatttaacattttatttatggagtacctgctatatgtaaggttctgtagtacccaatgggaaaatactaagataaaggtgtatctgcacttaaaatatcgtatatatttgttaatacataattgattaggtaaaaataagttcatatttttagagttctctttaaattatctttaaattcccaaagtaacactggaattttaagtagtttattcaccttactagacctcagtatccactttaaaatgaagattttcaatgagcaataagattctatatctatcatgggaatgtagtactgataaatggcgaagcagataattttttctcactttgtaatggtgactttactgtctaaaatctaagccaattatgtaattataccaatggaaaaatatgctatatgtatttgtagatatttatctataaatatgctttttatttctctcaatcttttaaaaaattatattctttctagagtgcatattatatgaaaaaggcataaagatttttgcaaagcccccccaaaaaaaacaaaacaacaagcaaacaaaaaacccaaagatgagaaattataaggctgttatatgaaaataaagtttccatgtacaactaaatcattctagctacaagaacacttcagtggcattcagagcatagaatttcatcacagaatggaatcttgtattgccccttttatcccacacccgtgtgagctttggagggttgggttctgctcacttctctggtataataacataacaatgctcatgggaagtgtatcatcatgtttttcttctttttaacaaaaaaaaaacaacatgatcccaaagtaagggaaaatcagaaagtaagttttattgcctttaatatattgtatttttttttcttatggggacttttgcaactcagattagggcgttttggaattattatctgagctgcagtgtcaagagactgactccccaaagattaactccccaaagggtacaatggtgactcacatgaaggatgcacacgaaaggctttgtcacttcggtaattggagagcgtttttagagaggatgccaggcacccatcagagcattcctactctcttacaaacccagtgctgttagtgaatcttctatggattcagaagctgagatgaaactaatgtctcatatctgtggatacaaaagaagtaaagaaaatattgatttttgattttgaattagaaattgtggggtcatcctctgcctactttgtgaaacaaaatttctcacaatttccagaaaaaggtaattcatcttctattatgtgtctgcttgtgagaatttctatataagcctgcagaaagtgatacctccctgaaactctgtatccttgatctaaagatatgaggatgcaaaaatggttgtgactgttggaaaaataagagaagcctattgtcttgttttattttctggattccaagatggtaaaactgctctgattttctataattaagaaacgcaatgtctctagaaagatggtgattggaacgtgagtaaaaacaaacaaacaaacaaaacttattttgcgagttttcatccttgtgcacacaatggtgcactgccaaatggaaatgtttgctaagaccaaatacatataaaaggttgagagaagaggggggcaggaggagagagagggggagagagagagagagagacagagagagagagaaagcatgagtaactaatacgatttccacaatgtaaaaatagaatttgacaagccaacattcacttggcaaatactgtgcccttcctcatgttcatcttgctcataaaaatgtctttgggaaactattttattgaggttaggcatcacaaatcaatccacgttttaaacatttggagtttcatcttagttccttggttcttccttggagttgttattctaaacatcaatttgtaaatcttttcatatcttcttaagcaggtgtcaaaccaactcctttggcagaattctaaaagcaacttgtacgcaactctaagacagatgaatgtatacaaaattcaggcttcatctctgcacagagataagtgtgaactaaggttcatgcttctttcatcttgctttggtttctcagttgctttatctgtttttaaataaactgtgttgtgtatattgaagctatacaacatgatgttatatgatatgcatatacagtaaagtgtatattataggggagcaaattaaaatatccatcatcttaaacattttttccttttgtggcaaaagcagctaaaatctactcatttaacaaaaatcctgaatgcaataaaatattattaaatattttctgaatttttatttgaagtagtctacaaatatttactaggtctttatttcttctgagtaaacaacaccaaacaagatgagatttgtgatgtaatgaatacttgagtaatctaagcgcaatttaaggataagtctataatccaggcagacatatctaaataataacccttggaaataaagtagtaaaaggaagcacacgctttctaacttactttccttgacatgaactcagtttgagatcagtattgaacatgacattttctttttatttatatacctccgtttatccacaagtattaagtcaaaattgattttagcaacagaataaagctctgtaggttctgttcaatgatgtcaaatctatccctgacaagtgtcccatttttgctcttcctgaatagcatggcttcaaaaaaatctagaaaatgaaaaattctatagcgcagaaggttaatagtggtgaatctctaaaataagtagattgttttggagtcatgtttgtgtcttgaatcactttaaaaattttgaaaacaaaatttgatagattttgaaaaaggttatgtttgcatttctgttgttaaggtgatgtttcctggagtgatctaaaaagaacctatgaggaggtgaaataagagaactagaaaacagaagacagcatgtttctaatcccagaaattaggtttctgggacaggtaaggaaaataaagagcccaggtgtacaaaatcaataaagagcaagaattattaaaggtagttaagagagcctcactttctcatctagcatctcaagccacccactgtctctgggtgtgttcttggtaaaaacagacacttaaaagtttattactaagaaaaaggaaagagaataagataaaaatacagtcttttgaaaaaaatctgcccaattttattgacaaaattcaccatgcatttcaatatagaatgaggaaacattaaattaggtattatttgcaaaagaaaaatgctttgtatgagggagaaaataaccatacatattgagtacagtgtaccctgcttgagtgataggtgcactcatatctcagatgtcaccactatacagttcatccatgtaaccaaaaaccatttgtatccccaaatctattgaagtaaataaaaaatttaaaaaataaaaatgcaggccggaaacagtggctcacgcctgtaatgccagtacttttgggaggccgaggcgggcggatcacaaggtcaggagatcgagaccatcctggctaacacggtgaaacgctgtctgtactaaaaatacaaaaaattagctgggcatggtggcgggcacctgtagtcccagctactcaggaggctgaggcaggagaatggcatgaatccgggaggcggagtttgtagtgagcagagatcgcaccactgcactccagcctgggccacagagcgagactctatgtctcaaaaaaaataaataaataaaaataaataaataaataaaaataaaaatgctttgtatgtagtaaaatactaaaagttatgaaaatattgaataataatattttaagaagtgaaaaataaaagtttccctgaaagcataaagaatattatctttaaaattctgttacaaaatgtttacttataatttttttcaatgaaatgaagtagcattgataccctgcttacagaacagcatgagacttgaatctgaaaggcaaataaccaacagttaggagggtatagtactgtgtgatatatgtatgactgctatagattcatttatactgactgaaacacatgttctaattaacctgagtgggggtcttaaaggattcctggtcaactgttatactgcaatgcatttttctcactttatatttaagtataccccctttaaaagatggaatgctttaaaatacatttactacataggcaatttgattaatatttgtttttattttcccttcacaaataattcgatgagctagcttatgaaggcaatgcatctgcacatttaggaatatgttccaaatctagtctatgtttccatgggcatttaccaactgcatataacactcacagcaaaagctaaacaagattagtgattcccaactaccagaggataaaatcaatttatcatccattctagcagaagccatggagttttataagtgattaaattgaaggaggcgctttgggcaatgtagaaatagagcatttcttgataaaatgatgagtgaggttgtcaaatctgtgataagcctgtgatgccggctaggcaggtcagctcctctgggaccctagttacaatggcattttcttatgtttgacatgtatctggatccaagggagagaacagatttcccaaaacaaccctttattgttttctcatttccatgtcgagtaagtaaagcatacattacatatttgtgtgttttcttcgaattaaggtttgttctagctgaccacagaatagagacaataaaaattcatgatgtgggggagagttaactggattatgtcaggggaattgtttgtgtctagcccttgcctctgataattagttaccctctgaccttaggtgaatcactttcatctcctcgttttcagtttcctcccctgcaaaataatgaaggcaagcagaatcaaatggaaagttcttgccacctctaacaggtcatttttttttttttttttttttgccttcgtaaagcactacagtataagcattaaatttacttttgtatagtgagtattttcaggacgagaatagcatagggataaatgtatgcttggttttttgaggttgaatagtaaccttaaattttgttgttgttgttatttctatttgcattctaagaatatgcttgtgcagaagtgtagacgatggtgaagaaatgagaaagggtaaggcatgagaataaagacataggagactaaacaaggtaggcttatgggtacaagtggtaaggccaaatcaccttcttcaaaggtaggcctcaaaattcaccttgccagaatttcaaaagaaggtcaaaaaaagaggaaaatgagcagcaaagatctactcagccaaattgtgagtactggattaggacggattgtggagtgaggctccttcctacttcttatatttgctgggtctaaatagaagccccagatgtgccttgattgaggatggcaaaaaagtgtgaatgctctgttgaatgggacctcaccacagctcttccctgccctgatatgtgtctccaagtgtatttgtaacccatgcgacgtgaagaaaacatacagccttcttgggtgatgatcaagtctcctaagcctaaatggtctctagatgtggctctgagttcaggcggtgatgactttctcaaaagcccacaatacgcgtggacatgtgctgatgtccatgtggaaacatgctaaaggaaaggaaagttagaaacataagaagccctccatttacttcgtcaattccttgagtttataaaattgatcttttcagatacattcaccgatttagcaaatgatgataaatacattgaatttaatcctgtctggtttatggctattaaaaacaatgaattttaatggagaacaattgaaactaaaataaaaattacaatgaactagaataaaatagcacaaattaattctgccagtcagaagtgaaacattgtaagatatcccttgtgatcttctagaagggttttgctttccgaggctctggcaaactggttggaagctattgccttcctgattttcacttacttcatcccctaaaagccttcttttttttcccatatcaagatcaaagacgaaatccatgtctaccaggctgtttgtagattttatcacttatttcatggggattgaagaactattagatgatatttgagaataacagccaaatgagcatattagccattcaggtataacaaaaatggaagtcagcagtctatctttaattttgtcacatcctgtagacttaaatcatccaactgcagagcatctgttaatgtgttctcagttcttgagttatagttaacctaatgccactggccctactaagggggaaattcagaaacttcccattggaattgtggagtgggcattaacctcgagggaataccaaggtccacagtacatgtaatctcctttccacttcttaatgaccctgttttattgtgttcattttacaattgtgaaaactgaggctcagagtgaacaacgtgtcagtctctgctcttcttgtacatgcacctacttaccacttctacttattgaatctggtctcaggacttagtactttatctcctctgtttctaaatttgggttaaagttgtgtctattgattaaaaatcttaaacactgaaaaagtatgaatgcacttaaatttcccatttctgaaaaacatttactagttttctgattaaaacattgtttatctatctatatctgtggtttgtataatcatttttatcaagaattgaaggtaatgtattttcaaattagaaatgtatactttaccgtttactatttattaataaataagtcatattttaatatgcttcttccttccagtaaacaacacttctctttttttggagagttcaatgattttagccaacttcaggcttcttagttcctgagtctacagtgtacttcacccaaacttgtcttcataagtaaatccctcataatccatattcattctatactttctcttctccaacaaaattcttacctttctagtgttcttctatccgtcagaattaaaagaagaggtcttgtcaaattgattcttattgaatattttttgatgtgatttctcaagttctccctaaatgatttttttatttattctaacatgtatctatgattacttacttttaagtaatcatacatatgatttccatatataaacatatatatacattatatgtatgtaatttaatatataatatatttaagtaatcatatatatggtttatatataaacacatatatacaattatatatgtttattcaaacatatataaacatatattctaacatatacataaacatagaataaacatatatataattgattacttacttactaaagtactgtactggagttgaaataaagaaaaagatacatggaactcacagttagtaagagaagttaaaggtacaaagtaataaatggcatgtagtctgtgtagataaagcattaattgaattcagaagcaggaaatacatctggagatgatcttggagagcctatcaatgcaactggcattcacactgcttctaaaagaagaaggatttggaaatttaaagatgggaaaggatatctgaggaggaattatagcatgagtctgcctagaccacatcctcatttcccttcaggaactgtaatgaagaatttgggagcctccttggccatcttcaattacttcacagagagaaacatcaaaatttcctccaccataagcctgccctaatttatttttgttttgttctacagagcactccatttttagcagaaataactatagattgcaatgcttgaaaccaggttgtattttgtgaaaaatacttgttttaagataaaacaatttaattcacattacttaaaattctataagcttttccccccaaactcagagaattggatcaaattggactttagaaattttcattttcaattccgtttacaatcagtaataaaattaagcattttagattgactttttctttgatttgtttatatacactgtgaacgaaataataaaacaaagttgtataggaagaaagttgcaaaaaaaaaaaaaatcctgtcggttcagagttcatttagataaaggccctttgagtcatgttccttactttctggagaggagaactaatttttactccagtagatggttcatatatcaatttaaagagggaaaagtaacacagaaacacatttccaaaagcatgggtgctgaaaagacttagactaattttctctcaagagcactaatgtgttaatctagccaaacacagtcatagtgtaagatcaagaagtatgatctatggtgtcacatttttaaaagtacacatagcattgaagagaaatcttacctgtttcaaagcaagtcctctacattcagccttccatataatttcctgttggctgtgacttcttcatactgcatcttaaatagattatctgtactctgccaatgatctgtctattgacatgaattatgttccattctgacttgtatatatacaagctgcaatttgaaatcacttttagtctaatttatttagctgaatatatatatttatttagacagagttttgctctcttgcccaggctggagtgcagtggcgccatcttggctcactgcaatctccacatcctgggttcaagcgattctcctgcttcagcctcctgagtagctgggataacaggcatgccaccacacctggctgatttttgtatttttagtacagaccgggtttcactaatctataaaccaaatctataattccactaatctataaaccaaatccccaagccagcaccacactgtctttattattgtaatttggtagtaagttttaaattggaaactgtgagtttcacaacttttttgccccaacattttgactattttgtgtcatttgcattctatatgaattttaggattagcttcttttttttatccctccccttcctccccccacaccccgaaggccctagtgtgtgatcttcccctccctgtgcccatatattatcattgttcaactcctacttatgagtgagaacatgcggtgtttggttacctgttcctgtgttagtttgctgagaatgatcgtttccaggattagctttctaattctgcaagaatagccactggtgttgtattgaagctgtatatcaatttgaggagtattgctgttttaacactgtaactcttacaatccataaacactgaatattctttcatttctttgggtctttaaaaatttcttttagcaacattttgcagtttttagagtacaagtcttacacttttgtgtgtatgtgtgtgtaatttattcctaaatattttcttttttatatcattgtaagtaaaaatttttattaattttattttcagattgtttattgctagtgtttttttatattgaagttgtatcttgccatcttgctgaactcatttattaatttgatctttttgtgtgaattccttagaattcctaaatatcagattatgtcatctgagaataggtgttaccaaaacagattatgtcatctgagaataggtgttaccaaaacagattatgtcatctgagaataggtgttaccaacacaggggttcgggctaggtcctgcatcttgcagcacagaaagccaattactgagatgatgattattgccaaggaagaaggctttaatcaggtgctacagtcgaggagatgggagttcagtctcaaaccatctgcctgatagactaaaaattaggagtttgtatagcagggaagaaatgtaactatatatgagaaaacagaaacttagttggggggaggtaaagaagtaatcctgataaatgaggggcctggagtctcattgtctggttgctataatccggtgagtttcagttcttttctactttttgggaggcctgaagatatttttctgaggcaggaactcagataaaacaaatgtaagtttcaagctttaagaccaacagggtcaatttctatgtttatccaaagacgtgtctgtgagagtgttgggttggtttcaaagggatggctttgtttcttccttctaatttcggtacctttgatttaattttctagactattttatctggccagaaccaccaatacagtgtagaatagaagtgggctaaacagatatttatgtgttgttcctaatcttcaaagaatgcatttcatttttcaccattaattattgtgttaactatgagttgttcattgttggcctttgttagggtgaggcaatttgcctctattcttagtttgttgactatacttatcatgaaagggtgccagattttgccaaaatttttttcaatctattgagatggtcttgaggaatttttttcttaattctattgatataatatactatattcattgattttcatattctaaactaatcttgcatacttgataaatcttatttggtcctggtgtataaatttttgtatatatttttggatgatgcagtctgctagtatttttgttgaggatttttacatacatattaataagaaatattgatttatagttttttctgtgatgccttcacatacttttggtatgaaggtatataggactcagacatgaactgggaagtgttcccttctattctatattttggaagtgtttgcgaaggattactgttaattctttaaacatttggtagaattcaccagtgaatctactttggcttgaagtttctgttgtggaaattttttttttattactaatccaatctctttatgtgttttacatatatgctaattttacctttcttcttgaggcagttttgttatttgtgtcttcctaggaatttgcccattttccccagtttatctcacttgtaggcatagaattgtttatattattcctttgtaagcttttttatttgtaattaaaatcctggtagtaatatctagtaatattgctgttaatttctccttttcaaccgtaagtaattagagtattctttctttttctctttgtcaaagtagtgtgttggatagtggccttgaaaaatatatgcccacccagaacctgtgactgtgaagcatttgataaaagagtgtttgcagatataattaaaggattatgaatgagattatcctgtgttatcaaggtacatcctaaatctaatgacaagtgtcattataagagaaaggcagagggtgatttgaaacagacaaaagagaagacttagacaagggtagaagggaaggccatgttaacctgaagcagagattagagttattcatcaacaagccatggaatgcctggggctaccagaagctgaaacaaacaaggaggtatttgtttgtgtacccattaaccaacctctctttattcctctctttgccctatccttccgagcctctgatgaccaccaatctactcctaactacatgaagtgaatatttttagcattatatatgagtgagaacatgtgctatttgtctttatgtgcctggcctattttatttaccataatgtctatttccatccaagtggctgcaaataacaggatttcgttatttttatggctaaataatattccattgtgtgtgtatatatatgaatatatatatatatatatatatatatatatatatatgtcatattttctttatccattcatctgttggtgtacatttaggttgattctatattttggctattgtgaatagtgccgcaatgaacacaggagttcaggtatctctttgatatactgatttcctttattttggttttagaaccattagtgagatttctggatcatactgttgttccattattagttttttgagaaatgtgcatactgttttccatactgtctctattaatttacctccccatcagcagtgttcaagtgttgcccttctcttcatcctcaccaacatttattattttctgtctttttgataatagtcattttaagtggagtgagatgatatttcattgtgatttttgttgttgttgttttgaaacagagcccctctctttcatccaggctggagtgcaatggcgcaatctaggcttactgcaacctctccctcccaggttcaagcaattctcatgtctcagcctcccaaatagctgaggcatgctgcaagcgtgcaccaacatgctggctaatttttgtattttttgtagaaatgaggttttgtcatgttggccaggctggtcttgaagtcctgacctcaagtgatctgcctgcctcagcctaccaaagtgctgggattacaggcaagagccgcctcaaactgccatcattgtgattttgatttgcaattctttgatgataagtgaggttgagtattattttcatatacttgttagctatttgtatgtcttcttttgagaaatttctagtcagatcttttgctcattttaaaatcggagtttttttattgagttgagttccttatttattctggttatttatcttttgtcagatggatatttgcaaatgttttctcccattctgtaagtcgtaatttaattttattgattatttcctttgcagtaaagaagcttttttatttgatccaataacatgtaatttttttgtttgtttctttttgcttttgttatctgtgcttttgaggtcttactaaaaaaatctttgccaagatcaaacttgtccaacccgcagcctatgggccacatgcagctcaggatggctttgaatatggcccagtacaaatttgtaaactttcttaaaacattatgaaatttattggcaatttttgtttagctcatcagctatcttaagtgttagtgtattcaatgtgtggcccaaggtaattcttccaatgtggcctagccaaaagattgtatacctctggattagatcaatgtcctgaaacatttattcagtgttttcttctagtagtttcagagttttaggtcttacatgtaaggtcttacacttaagtctttaatccattatatttgatttttgtatatggtgagagaatgggtctagtttctttcttctgcacatggttatccaattttcccatcaccacttattgaagagactgtactttacctaatgtgtgttcttggtgcctttgtcaaaaatgagttggctataaatgcatggagttatttctgggttctctattctgttcccttggccagtgtgtttgtttttatgccagtactatgttgttttgattactgtcaggttccaacctgagctggggtctgaggggacaggtggcaggtggctaaaagaacactcaagggaccataggcagttgggaaatggtgttattctcttcccctcctatagagtcagctgtgcagttatatttctcacagacaacagtggctcaaagccagatacgagctcacacaaacaggttacattaaatggctacaaatgtgattacatagtgcgcggaattgtgcgcctgcactacaaacccactgtgtcatgctgtaccagatgtctgcctcagccttctcctgaccaaagcacagccactttccttacgctccaccctctaggctaagggagttctcctagcagggagacatgcccacagggcagaaacctggacacagaggccacagcagcaatacagggagcaacaactcactactagtattcctgctatgctgcccatgattattagggtccagcataggccagagcccagagacacccaccatgtctatggggggtcatcagtaaggctgtcagctgccttgatttcctgggaaactccttgcaaagctgctatgttttgttgattgtcagggatgaaggtacaacattgcattcccaaaacagcacagatgccaccttgggcagcaatcaatatgtaggcctatcaggttctgcactaccactttcctggtttgatcaacatcatctgtcaacagaaggaggacaacttgggtgtaattcaagtctcaagtgttatgctctggaagggccataacttgcatttctacagttacgacacctgctccagggatggttaatgctaagaggtagagccaccagggggctcatcacacttgcaaaaaccaggaacgtagcaccttccagttatgtgggcatctaaggaatgtggaaataactgtggcaagcacataaggccacccccaggtagagcggccaatcctgtttgctggcaaatatgaccatactgtgtctccacagtcccataaactcccagggggcacaaagtcctctggggcccagccttgatgtggtcacctattccatcacacctttggtgtggtgataacatattatatgtgttcagactatggcagacaaccaccccacggtgacattaccccagtgttgctctacacatcatgatacctgtgttaggggcaccttgtgttctcccactaacgagccccatccatcacagacattacaggtcagccaggaagcaagcatgccatgggttttgtggcatcccctatccaaagctgcccatgttgcattctaaacgtcagccatggaactcctagtgtccatccatgtccagttttccacagaagctggatgtatgtgccagggcaagacatcccctgctgctgcttgaagggtggtgcagatccaacggttggacacattggtcaactcatcgtaggtgtgggaccattccacaatgctgttggagcatgtcaacctatggtctaaatgacaaagtaggcacaggtactaacaggggtaaatcatgcccttcaggcaaaatacaggccaagctttcatctctagataacaatgcaactgcaaaggacttctgccctgggtgatggtaccacaacttttcagcaccccatggttcctttgggtctatatcttgccagagttactggggagctcataataggccacacaggaaatacagatgttccctggagacttccttccctggccattcccctatgaatggtcaatcatagaggccatatattaagtacccaatgagtgacatgtaaatcatactataggctctccctgcaagggactatgatagccaaccatacgtcatggtggacttggagggtctgtggccaaagccaggttttttgttcccctgcctttacagacattggggcaggcaacaacagattaccattgtccccatacctggttggaggaagtcatctttggtgtgcatctgtaagtggatggggtcagtggcacagtgtagcagtgcctctactggggcctggctgccttttcatggccgctcattcaagctttggagcaccaggtccaaccttgaactctagccccacaaagaggtggagtaacatgcaaatgtaacttatttttcaggagtcccttatatcactcaataataccagtagtttgtgggttatatggaacctccactttatgtccatccattgtgcccactgttgtacgtgctatccaggaaaatgtgttcccctatcacattcaacagtcaggggatgactgtatagggcacacaagtgttgcagggcctgaattgtatgttgttggttggccatcctgcaagggtaggcaaacagcagactggtggccgtgtctacagctgtcagcacatgcatatgcccctgcaacctcagcagtgacctgatgtagtctatttgccatctagtcaagagcatccaccctactgtcacttgttgtgtaacattgggcagctgtctctgtctggggtatgtctgtgtccacgctgggcatttctggcagacctcccagatatcttacatagacaaagatagaccatagcacttattgacctattccattagtttactcccgacgtggcccaatttctgctgcagccatagagctacatctcgtgtaggtgctgactccaaccaccggacctggccaaggcatttgcctcatcattgcccagggcagtgaaaggcacatgtcctgacacatgataaatagttacaacctttcgatggcccatttcccataggtctggccacatggcctggccccaaatgggcctgtgaccaactagctaattctgtaactttcaggtagttaaccacaaggttagggcttaataaactgcccagctaccagtgaagattaccataggtgtctcctccttagtgatcaccatccacagtgccctgagttcaacctattgactactttgtccaggtattaaaccatatggtatcagtactaggctggaccatgacagcagtccaggcagcagtagcaccctggctggacccatcctgtctaccatgcctcatcaggaatgggaggtgcctctcttgaaatggtaatggctcagtgtttaggggcgcctcaggctgacccatggccttatcttgcatcaggactacaggtcccaagacttcttataattctgctgataaggggcttgtactcagggtactctgctgttctaagtaggagccccactttgctaaggtggatatctctgccatcccagtctggggttcattacccatgaacatacttgctccccaactattgggtaagttgtccacacaatgactgtagcccttcctgtcacactctcacaagcctgaagggtggcatatacagttgttaattccttctctatccatgaatagcagagctcacctccattccaaagttgggaccaaaagcctacttgtgttctacagtgctctctgcactgccataggccccagccaaaaccttctgtggtcacatgcacatcaagttcaaatgggtgccccaggtcaattacttgtagcacctgcacttgctgtatggcccatttggctgccagaaaagccatctcagcctcattgtcccaatcccaagtaattcctgtttttgtcaactgatacaatggttttgttttctgagccaaatggagcacaaatgctttccaatatcccaagaggctcacaaaagtctctagttgcctcattattgtggtctggggatatgcctgaattttattaatgatggcctctggtatggcgttcgtcttacccaaccagataactcccaaaactttggcagacaatccaggcctttggaccttgttttcattcacagccaaactgcatgctgccaaatgttgctgtaggaggggtgccgctatttctaaatctgcaagagaatcagaggttaacataatatcatccatataatggaaaaggtggaccccctttatgacatatggtgggtttatgcacacagccctgcagcaacaccgtgaaagtctattgtcgccctttccatgtgaagacaaactgttcctggctctctggtgtgatgtcaattgggaagaatgtatgggccaagtccatcacacagtggtactgtcccaattccatcatcaagtgatccatcaaatccgtgatagacagcacagctgcatgtgaagggggtgttactttatttagttctcgaacatccaccatcatcttccaagttccgtcaggctttctgactggccataccagagaattgtagggtttgtgcattccatgcactatctgcacctcctctaacatcttactagtctcagttatcgccatatggccacctggaaagtggtattgatgggtggaagtaacctgtcggggttgtggcaggacctggggccagtgatacgtatgtccacccgataatggctcaaccacatgtatttggagtctgaattctctgaccgtggcttgtaaaaccaagctgtgaaaaatatctaccctggaatgtattcaagtatggaggagatatacacagtttataagcatgcagccaagtgcctgaggccaaggtgcaaagatgcaggcttcactcccactgactggcctctgtctatgtatgcaaccttgcctggaaacttatccgggttcccatagatgaggctacaatctgtgccaatgtctaccagcagcagcacctgctgtacattggtgggagaccagtggactgccaattccacatgtggcctcctgttgtctggtgtccccccaagctgggcaccttgaccagtttcctaatcaaacacaaaacgctctataccttcacccatctgcaagtagtccttgagctggagcatctgggtgggacatggtcaagcagcatcatcccgcccgctgttgggcattttctggaattggtgattcagggacaattgcctccacaaagttaacagcacttcattgggttgcctctcagttttctctcggtcaaccccagccaaaatcaaaccaatccacatatgtgtatgagtcaccactggggcccttttgtcccatgagatggccccctgcagaaggagtaccttccccctttttatggcatagactcctctgcttccccgagggctgccatggcagtagtcacctcatgtatgcagcaccctgcacacagattgacagtggccagggagccaaaggcactcaggggtgcagagcacaacacaaggtccctcatgtgggaggtaaggtgttcatcatctggccctcgggtattcggatcaaacatagcctgctgcatacccatctcctgaattacctgcaccacatctgtttatgactgccatttactcacagtttctggtatttctctggcatagtcccacaccatttgcatggcctccatcagccattcaattatggtgtggttgccttgcccctgtgctaaccacttgctcacctgcaattgctgatggagggagggatgagtcataatggaggccaacttttccatctcagaggaggagcagacaatactgttggctccctcatcccaaaggcgaagcatctaggtgggtaggatttcccccaagcgctgccagcactgtttactttattcccacaactccgttggggtataggcagtgtatgacttgtgctccatcatggtaggaggtctctgagcccacccctggggcctcaatgacttcctggtgtattttctgatgagccactgggggagcccacaacagaggttcttcctcctcggtgtcagatcgggcaggggtctctgactggggtggcaggcccaagcctacactaatagcagcctctaattctcactccaacctgtgtacgtcggccttcaggctctctgcttgtgcctggaggtcccttacctgtgctgcatcctgcagggactgagcatgcacttcccatagcacagtcaaaaatgcccatccaattctgctgggaaaggcacactccttctcagtgctctgtgcttccaggtgcttcagtgccttatccatgcacacaggggacctgtccaccaccacccatgtctccaccagggcccatcttagcagcatggctgtcactgggtaccataacccatattggggccacacggctgacctaggatcatcaggggccaagggctcactcacctcggaatcctgctgactacaccaattgtcaagttccagttcccagactaagctggggtctgaggggagctggtgaacaggtggcaggcagctgaaaaacactcaagggaccacaggcagttgggacatggctttattctctccccctcctacagagtcagcagtgcagttatatttctcatagacaacagtagttcaaggccagatatgaactcaaacaggttacattaaatggctacataaatgtgattatatagtgcatgggattgtgtgcctgcactccaaacctgctgtgtcgtgctgtactggatgtctgccttggcctactcatgactaaagcacagccatattcattacaattactagggctttgtagtatactttgaggtcaggtagtgtgatgtttccagctttgccaattgtgctcatggttgctttggctattcagtattgtttgtggtcccatgtacattttagggttgctttttctatttctgtgaagaatgtaattggtattttgatagggactgcattccatccttgatcattttagatattttcatcattttaacaatattaattcttgcaatccacagatatgggatatctttccattttagggggtttgttcttcaatttcttttgtcagtataattttatttgtagagatccttcacttttttgtttatatttattcccaggtattttttttttcttgtagctattgtaaatggggttgctttcttgatttctttttcagattgtttgctgttggtgtacataaatgctactgagttttgtatttaatttttgtataataaaactgtactaattttgtttatcagctgtactagttttggggtggtctttaggtttttcttttttctttgtttttgagagggagtctcgctctgtcacccagcctggagtgcagtggcctgatctcggctcactgcaagctccacctcccgggttcacaccattctcctgcctcagcctcctgagtagctgggaccacaggtgcccatcaccatgcccagctaatttttgtattttttttagtagagacagggtttcaccatgttagccaggaaggtcttgatctcctgacctcgtgatccaccctcctcagcctcccaaagtgctgggattacaggcatgtgccactgcacccagccaggtttttcttaatataagattgtgccatctgtgaacaggagtattttgatttcttcattcccagtttggatgatctttatttctttctcaaacctaattgctctggctagtacttacctagtagtatgttgaataaaagtagtgaaagcggttaaccttgttgttccagatctcaaaggaaagggtttcaatttttctccatttagtatgacaatagctatgggtttgtcacgtaaggctttattgttttgaagtatgttccttctataccaagattgttgagagcttttatcctgaaagggtgtattatatcaaatacttttttagcatctatggaaataaacatttttttaaaaattctgttaatatgatgtatcacatttacagatttaaatatgttgaaccatctttgcatcactgggatgaatctcatttgatcatgatgaatgatctttttaatatgttattgaattatgtttgctagtattttgttgagaattttgcattttattcattatgaatattgacctgcactttccttttttgtgttgtccttgcatggatttggtatcagcataattctggcctcataaaatgagtttggaagtatttcatcctcttaaatattttttgaagagtttgagtagaattgttattggttcttctttaaaaatttggtagagttcagcagttctcattaagtcctgggtttttatatgggaggctttttattactgcttcaactgccttattcaatattggtctgttcagatgttctatttcctcatatttcaatcttggtaagttgtatgtacctatgaattttttctttgaatttttttgttgaaggttttctgatttgttggaatatagttgttataatatgctataatcatcctttgtattttgtgatgtcattaaatacaaagctgtaatgtctcctttttcattttttattttatttatttaggtcttcttttttttcttccttagtctacctaaagctttgtcaattttgattatctgtttttaaaaatcaacttttcattttgttgatcttttgtatgtttttagtctcgatttcatttatttattctctgaactttatgatttcttgcctcatactaattttgggtttggtttattcttgcctttccagtttctctacatgtatcattaggcagcttatttgaagctttaccacttttttttatgtagatgttcattgctataaattttccctttagtactgcttttgctgtatcccataggttttggtatgttgtttttacattttctcttgtttcttttttttttcaaattgtcctaactttttcattggcccattggttatttaagagcatgttgcttaattttcatatattcgtagagtttccaaggtttttcttattattgatttatgattttttccattgtggtcggaaaagatatttaatacttgactgttttaaatttgttgagacattgagacatgttttgtggcctaatatattatctaccctacaaagtattccatgtactgatgggaagaatgtgtattatgcagccgttggataaaatcttctttaaaagtcatttaggtccatttgctctataattttgtttaactccaatatttgttcattaattttctgtctggatgatctgtccattactggtagggggttattgatgtcttgtactattattttattgtggtgtatatgtccatttagatctactaatatttgtttaaatatgaggcactgttgtgttgattacctatatatttacaattgttatatcctcttgctgaattgacccttttataattacatagtgatcttctttgtgtctttttacagttttttacttgaagtctatttttatctgatataagtatagctattcctgctttttgtttgtttgtctccatttacttggaaacttttgccatttattcacttttatcctatttgtgtctttataggtgaagtgagtttcttgttagaagtatatagttatataattggatcttttaaaaaatatattcatctaccctctatcttttaattggagaattttccatttacattcaatgttactttttataggtaaggacttactactgccatttggttatttgttttctgatgttttgtaactcctcttggcatttcttccttcttaccatcttccgtttgggtttagtaatttttctctggtagtatgttttgattccttgctttttattttgtgtgtctcttataccatgaagcttataaaaaatcttatagctatataaagctcttttaaacaaacaacaattaactttgataacaaagaaaagatacagaaacaaagaaaactataaaacgatctttgaacttcatccccccagcatattgacctttttgttgtctcagtttggatctttttatatctcttaacaagttctcatagttattatttttaaaaatttgtgttttagtcttcatactatagatatgagtggttttcacattgcaatgacagtgttagagtattctgaatttgtctgtgtacttacttttatctgtgagtctatacattaagatgttgtttaactgcatattagtgtctttttcttttaaactgaaaaattcattttattatttcttttaagaaagggtctggtcttggtgaatttcctcagcttccgttttctgggaaaagctcctcattccttcaggtttgaaggatacttttactgagtatagtatgttttgtttagcaagttttttacttcagtactttttatatatcctttttttaacttcagtactttttatatatcattccattccacctggcctggttttcactgagaatcactgagatttcactgagaaatctgttttcagattgatcagagctcctttttatattatttggttattttctctttccactttaggattctctctttgccttgatatttcactgtttgactattatatgacctgggatagtatcatttgggttgtatttacttagtgatacttgacctttctgtacctggatatatctatttttctctgggtttgcaaagttttctttatttctgtgaatactctttcttctccttgctttctctcaaccccctcttgaaggaaaatgactcttacatttgctctttaaaggctattctctagatctcataggcgttctttgtttctttccattatttttctcctgtgactctattttcaagtagcttgtcttttagttcactgattctttcctctggttgatcagtcctgctgctgagactctctgatgcatttttcatctaattcaatgtattctttagttccaggatttctgtttgatatttttaatgactttaatctatttgttgaatttctgtaataaatttctgaattgcttttctgtgttttctgggagctcatcaaagagttttgttttttttttcttccagtaactcaactcataccatctcattagggtcaatcactagtttctttctttgtacatttgaggtggccacggttgtgttgtttcttatatatgtacatctatattcttgcattgaataattggttatttattgtagtctttgccttctggcttggttagatcttcctggattatatctgcttagaggtgtactgtatagtttacttgttgaattctcttaactttagattgtggccttcttattagcattacatgtcacctcaatcctaggtttgccagggctcttgcaaaagcttggggtgctgcttttctttaatgggatgggtttcccaaatggaatatcccagctatgtgaaaaggctgtctatgggttcatgccaagaggatccatggagtatgcctctcattgtatggtgctgctgaactgcctttctgttttagtatttctgtagagacagcctctaaatttttcacactatggttgcaagcccctctttgattcttggttctagctgtactctactttctttttttcctcctacaggctttcaaaatgcttcccaacacatcttgcattaagacaagaattaacttactgcagaggaatccaagataatagagaagctggctgcctactctgatctcatttttccagtgagacacatatgtgtgaggggaacttttctgcatagtgcttggcatcatgcatacagaaatgtgtttatcttagtgtctgttcacaatttatcatttgtttgtggccctatggattttcacagcctaagttttgagttttgggatattactggtgatagtcttggtgccaaacagttgtttcagttttaattttgtgaaggagagtgatgccaaattgttgctgctccatcattttggtgatatcacccacttttgttgctcttcctattaataaggaatcttaagagcacgctagaatattgaggaacaaagacaatgttaactgctaggcaatatagatttattggatgcccaataactaaataccttgaccccaatgggaatttgtagttcttattgtcagaaaaccactggtcctatggaaaactaagtatgagctgattccctccaaatcatgaggtgtgaggtgggggcaatcgtagctggctcattgtccaagaaatccagagtgaaatcctatgatcacttttagacaattctgtttattgacatatcattaatcattatagattcctatctcaatatgtcagtaaaattgctgtactgggactatataaactattattcaaatgtaagtatataatatactaatgacagcttgaatcaccttctacgatagctgaagtagatcatcataatcttaacaccacattttttttctatgcattgatctatacatgacaactctcatttccactgcaatttcaacatgagagaaaaagtaatgagacagagtagctgtgttctggttagaggcgcagacaaagcagtttcaagagactctttactatcatgggtagcaattaaatgtgcaatggtcaatatggtcagtaatgggggaaaaaagcacatggtgccagattgagccaaccattgtgtacaaccattgtaagaaagagaaatttatctatgtttttctgattcatgcattggtacacacatttacagaccagaatataactctagaaattggcagctattttaatgcttccaatggtctgtttttgttaaatgaaaaaggtaatgcaagaatctattttagttatttaaaataaattttcctcatatggaagttgaatgttttacagcaggatggtctgggaatgggcattttgcggcagtattgaattttcatatgttatagttatgtagcaagtgagttcatcatgtcaggagggagtataagttcatctccttattagtctatgtctgtaatctatacgactattaaagctaatatttctcttgactctgcaactaacccctgaagagaaaaagtcatctggccaaatcccaaaacactcctgaatgcattagggtagattatgaacatgtagatgaaatacaaggtttatgaatctcccctctgttgcctgaaccccctttcccttgccacgcttctttgcttttctgacagtattttattggctataaatgaaattcaaacagtgccccaaaacgaaactccttcgcaaaatctttcttgcagtgaaaataactgtatgcacagtaatttaatcctcttcttcaaaaattgatacatattacagtagtcctcccttatccacggtttcattctcagagttttagttacccatggccaactgcagttcaaatatattaaatggaaaattccagtaaaaacaattcataagttttaaatcctatgctgctctaagcacggtgatgaactctggtgtcatcttgctctgtcccatacagaccataaatcatccctttgttcagtgtatccacactgtacaggccacctgcctgttttcacttggtaagcatcttggttatcagatcaaaggaacgtagtatatatagggttctctactatccatggtttcagatccactgggggtcttggtatgtatcccccacagataacagttgactactgcattaaaattaatccactattaggtaataaaaacttggtgaagaggatcatgagatttaattgtcaggagactcccctgaagaagtgacatttcagctgaaacttgaatgacacttaggtattgatgttggagaagagtaatctagcacaataaaatataaagtgggaaggtggaggtaagtttagcatcagaaaatgtctgatgtggcttgaatgtggaatggacagtgaatgggataagaaggttgacatagcacagatcatggagagactcagggacttgtttggatttaattctgaaagtaactggaagccatcgggagatataggcagttgagtgatataatttaatttgtattttaaaagatcactttggcaggtttgtaaagaaaggattgtctgatgggcattaatggaagcagagaccactccaggaactctggaattagttcaattgatagcacaaaacaacagagaggtggttagcagccatgcagatggagagaactggcctgagttaggatattttggagacatacaaaatgattttgatactatttagcagctgcataatagcccattatatgaatgcgccatgacttatttaaacattggaagaggcgctttcaaatttaagcaatcaagtgtattctgagatctactattaagattcctgcttcccaaattgtcttcatttacatttacccagtaactatctatttaaaacgcataaggtggtaccctggctgtactaaagaataataaatagttccattcacccttgctttttaaactatgacccatttcagttcagttttaatttttgagtaagaattagtataatatatgaaaagcattctgtatgcagttccaatatatattcaagttaccatagaattgaacgttatcatttcatgggatttttgtttttagttttgagtagaacaggcttgaaaaaaatataagaatacctgtaggaatcagatgatatttgataattgaacagctctttggttttaattcaaaattaaactccgaagaataagaataacttaaataaaccaataaagtttggctatgcaattcagagctcaacttaaaaagttacgcatccagtaaatttttcagtaggctgttcatttttatgctaattattaagtttcattctattcattaaaatgttaaactttatcctgagtcacctaaatcttccatgagctctgcatgtagaaaataatttggcagatgcttatttggaggaaattgcttacttcttaatacaacttttttttgagagaggaaaatattagcaaaaaatttttatgtccctaaaaattcaaacattttgatcatgagtaggagcataaacagagtgtatcatatacagttggaataaaaccttagatgcatgcaactcaaatggaatgaatgattccaactcatatgcttgttaggattcaatcaactctcagtcattcactgagttgagttacaagtagaagagagtgggtaatgttaaagacacactgcacaattcttgtttataatatggctttaaaatctagttgggaagacaagaccacatgttggtgcttttgtgatttttgcatgctgttccttctgcatggaatgactttctttaacttcgtggccacacagttgctaattatctttcaatctgtcagtatcacatctgtgaaggttttctttctacattaaacagtttataataatcgttgttatgcttttttggattcacatgtctgcatctctaaacgagcgtgtgttccttcaggaaaatgactatgtcatgtccggagtgcttggtgtaatgtcttatacagtgttggaccatcattaatattgagtattgataatataaggcagtttgctgtgaattctaaatgtctagatctatcgagaagtgtttagggaaatttgtatctctcaagagaacaagatcaccagggcctctaatcctggtattagaattacaatcagggcaaatcctgaaccatttgaggcttgagaagagggaacagatgagggaggaaggatgggttggggaagtcttcaagagtttttcaactctactaatctttggttctacatttcaaagtttgaattttaaaatagctctattacctatataaccattactttgtggtctaaaagtaaaaccataaaatcagcttagcacaacagaatgtactggactgaggcattcacattcagtcaatttttcacagtataactcagaaagaggttaaaaagttctctttgctttttgagaacccattttgtagttcattgttgcagattgtctgatgttgactttcagaagtgaactgaaatgtatgagaaatctggaaatatggtaaagacaaggaatcaaagccaagaagcaaacagacacgcaggggaggatatttaccgcatcgtctcactgagcatacctggaaaactgagaagctggcttttgaatagtgcatatataatcagttctttggtctgtaaattcagtaatcatgaaaccccatgaattagtatcaacatagcagtacatgtcttcattaatattttgtatcattacctctgtagcctctctgaggaattcagggaattttatgggggaaaaaaaaccttaaaacttgaagcaactaaaatttatataaaaatcatacagaatgaatgaataaagtatattaaatatacaagctcttttcttagagacttagaatataaaatgaatacgaacccactttccccaataattagccttgatacacaagtaagcataagcacaatattttttcttgccaatttctacaatgacccaaaacctttaatgaataaaaaagatatatcctaactaattaaataattatagttgacaataactttattaggcaaaaaaatctactaattttcattgtctttttaaatattacagtattcgggcattgttatatatacattataaaatatatatctagatatctagatatattcatatatatatatatatatatatatcttgagataatatgaatgtaacatttcaaattaagatatacacctctgaagagaaaaatgacactcatcaccatggggaaagatagtaatagtagttaatcaacaaatgtgtgctgaattaaattgaatgaatgcaggatcctctaagtggttggtgaaactgttctggactctaagttcatttcctaagctagatactctatagatgacatatactgaacaatttctataatgcaactgcttcttcctaggtcgtctttttacagaatggaggaaatggccttttaattccacaatccactctggtagctataattatattgtttctttttataatgaagtagaaagatatagtacattacaaaaagaataaatttataatctaacaaactatgaactcttaagcaaccaactcttaactggtggaatctggaaagcgcttcttaaataaaaaagaaattctatcctggatgtctccagaaatgagttgtgttactctagcgccctcctacattaatgtaaaaagtagacaatgctgagctccgcagtttttgtgcagtttccagctttcaaagtaccagatagaactctgactccaacactttccatccttatattccccaaaatgtatatggcattttaattatccttcaaaaatcttgacttttctgacccttcatctcttcttagtagaggaacaagagttcaggaacaagtgtggagatgggggtggggtcaaagggaaagaaatgcaaaccagactcttacccaatgattacttcttaaataatatggtctgtaacagaggttgccaagcctttcctatatagaaccaaagagtaaatattttaagctctttaggatataaagtctctgtcacaactactcaactctgctaatgtatcataagagcagacacacacaatacataaatgaatgaatgtggctgtgtttccataaaactttacttactaaacaggtggtagtctgaatttggtctgcaggatatagtttgctgaccatggtttatagcataatctttgagtatagcatacaaaatatcattcagccgatttttttgtaccagaaatttccaaaatcaactgaataatttacttttttttcccttaaattactctacagtaatctctgtggaagaaggtgaactgcatttacaattgcttgaaatagtgagaaaagttacaaaaagaaactacaaatacaaaacaggcaatatctgataaaataaatacactctgtcactatgttaaacaccagaatttttgtatttctatagagaacaccccaactatcagacctttttgaagcattattcgcatttacattcaacaaatatttaacctaatccttataatcatccaccatttttcaaactttggaaatccagatttagaaagataaagcagacctcttaaataggaagtggcaaatctaagatctgaaccttgatcatctgcttccaaatcctgggctggttaagaaaaatattagatttaaaaaaatctaaaatacattcaaaggctttaattccgcctagtgtttttcagtgccagataattttgtaacaggcaattctcagtaattgtaaaacacacaaatgatgactttcactgtttttagtaataagagtaaatcaatgcaattctcagtcattttgcttaatggagcacattgaaaaacaaaagagctatactccctgtttttttctaatattttctgatgaatttcaatagctagactctcaccatactttaaagatcgtcattcttccttaaaagcaaaaggcaatttaatgagatacttgcagtagataaagttgccgtatttgatgtttccatgttttattttctgggagatgacacagaacaatgttgtctgagattgtgaatttccatacagagggatcattgaagcacccgtcgttcataaaacactctgtcatgctggagacaaaactatcaaattttattaaaacttagttatctcaagtcaagctttacatttccaaatagaaatagtgaactgcaatgtgtcagaactctaaatttcattaccacagcaggtgtcattatttggcacataggactagggtttgtgataactacatcatacaactccaaaggaaatagcagaaatgttctttgaaagcactcttctatgtctaagataataccatttttgagcagtccagcctaagaatgaaaaaatatatatagaaatactgaggtaaaggccatgatgattttcatattacccacaattaaagtttgaaattccaggaaagcatttttagatattatagtatcaggaaaatataaggaaagaaaattagctcaagatttccaatctgactttgtgctagcaaataatgttatgcaaaataatatctattattaatatataataatatctattatgttttaaaaaataaaataatatctattataattataatcccataattttttcttatctctggtaaaatatctgctctttatgttatctcaagtcaaattatacagtttagaaatgagtgagagatacttggaatcatctttcctcattcataggcatctcaaggaagaaatcataatagaatgatatctattattttattttgtagtgtttatttttattttataaaatttttccataatttattggggtaccggtagtatttgcttacatgagtaagttctttagtggtggtttgtgggatcctggcgcacccatcacctgagcagtatatactgcaccatctgtgttgtcctttatcccttgctcccttcccacgctttcccccaagtccccaaagtccattggttcattcttatgcttttttgtcctcatagcttagatagaatagccagatataaatttagatggctaaacatttatatatcatcagtaaaatttcggtccaattctcatttctaaaaattttggtactagagagcactctacttttatgattaaaaattttaagaatcttcctttaagacaaaatatgactccttttaatttttctccctggatccaatatccccttattgtataaaagagtgtccatttccttctcatggacaacctttaaaatatttaaataaaactaattttaaccgccaccaaccctcaatcatatcatgtccaaaataacctttccaacctccttaatctatttttttttacaataaggtttattatttccttttatcagtgcagttttggatgtgcaccatttaaaaaataaggtctttctttaaaaatgctcataaagtaaatagaataatacaaatatagtgtcaggaaggcaaattgtttctaatacgtcttttgacctaaatggtgaatgcctattgttaaagcttcagattattaaagtttcaacagcaaccctgtcgaactattggctaattccgataattttcaattaaatcaccaacattatttgtttttaatttgagttattatccagccaccagtctaattgatttcatatttgtgcaactgattttctaatagaaatatagtactttgttgttttctttttctattacatttaattttccttgttcctgtgcctttattcaagttgctgataaaaactctaatctgaaaagtccgagcaaaactctgtggcacattcccagtaagctaaattccagatgggcatcaagcattaatcaatatcccagggcatactattaaacctgttaaaactctaccaaactttttgccattctgctcacaagagtatcatgcgagtttgtcaaatgcctagttgaaacatagactcactatgtcgatggcccatatgaggcccataaagaaaattcagagctcttaaaaagttgctatgaatctgtaatcccataatttttccttatctctggtaaaatatctgctctttatcttacctcaagtcgtaccagagagtttagaaatgggtgagagacatcggggatcatcattcctcattcataggagtctcagggtagaaatcataatgaccatatttcatttttttttctatgtctgtgcccttgtgtgatagtagcatagttgcttgacagcatattgaagagtcttcattactcactgccattttctttcatgtcctagaagtgaaaaaatgttgtttggttccagttgaccacgattgtatctgatcttttcttctgttttatttgtttgtttcctaacagtttatgtttctcaacataaaatactatcgtcgtcatgccagactgctctctaggatcaccttgttttctcaccacaatgccttagaagggagcagagagctcagggtgtcactagtcagcttatatctcatctcatgttatttgaacaataggactctttaggagatataagaacattataaatacaaggtgcaaaatgtatgtaattatgacacctttttaaagtaaaccatagcaaatcacatgaaatagtgctttcttgatacaatattattatcgtttcttctacaaacattatttcagttaaggagagtgtgcaagggctctcctggctacctgagcaagcatttgaaagattcattatatttcctagggttaaaaactattttcctggagtttctaaaaatgagagcctgccataaaattgtgaagtttcatgggaaaagcaaagtaacttttaaacaactgaaatttttaactattttctagaataaaaagtatagaaggtcagtggatcacagctattgttttagctgaaaaaaaaacggaataagttgatcatggttaggtagattataattttattattacttggtaaaattgaattgtttgggccctggtaatcctcggctatttgtgtgtatagattaaagctcctggttctcacttaaccaaactgaaaagcactaattgtcagagaaagaaatgaagtttttttctagtgacttgttttcgaaacaacgccacttacatattttcatgttgtcacatttacatctgagaattattggtggaaaacacaaatggcataactattaaaaatgggtttctaatcataattcaacatgactttgcatcaaatagaaataccaaattgagaaaaggaaatgagtgtttgactaaataaatgtaatgaaatggtagtaaaagagtcaaaaattattctttgcattttctgtcttttcagtttatctatctatctatctatctatctatctatctatctatctatctctctatctatcatctatctatcatcttgatgtattgattcattgattgtggtaggcatgagcttattatgtaaaataagatatgtgcttcagtgacactgtttttgccaagaggtgttgctttgaggccttccatagcagcttcctgggcatctgggcattgatgggcttgcgaatgagctgagttggcagctgcggcactactggttgtagtcttgctagtatgctttcaactgtatccccttgggatatcagctcccttacctcatcagtgcagctctcacccatgataatgtttgtcataaatgtgacacaaatccagtccccatgctgtatctgcttatgttagccaatggagccacacagtggattagaataacgcacaaggacactggaggaagttgttcataagagacaaagagagcatatacagacagtggacatgaaacatttaattgagtgaagcttttttttctgatttgaaaataaatatatgttagggtaaaaaaaccaagcctgtaaaggaaaacagaaaaattggagttaataaagggacccacagcttcactactcaaagaaaactatcgctaaaatttgggttgcatgtaactctttctaatgtgcatatatgtgtatgaacaacatatttgatgatgtgcagtactttatttaaacttttgcctggtacattaggccattcttgcattgctataggaaattcctaagatcgagtaatttataaggaaatgtttaatttgcacacagttcttcatgctttacaggaagtgtggtgctgatatctgctaggcttctagggaggactcaggaagtttacatttatggtggaaggtgaaggaagggcagatgtgtcacatggcagaagcaggagcaagagtgagagtgaggacgtgccacacacatttcaatgactagatcttgtgagaactcactgtcacaaggacagcaccaaggggatggtgctcaaccattcctgagaaatcctcccccatgatccagtgacctccctccaggccccacctccaacactgaggattacaattcaacatgagatttgagtggggatgtacattcaaactgtgtcacctactattgtctgtttcgttcattccaattgtttgatctgataaataattctatagaagacagtgtaggctgaattgttcaaacattttgccatatttcaagttaagttcccagaagttgggtttattaaaatttaaatattttaagactcattacatatatacacaaactacatgataaaagagttatgtcagtttacgttgtgaccatgatacagtggatttaaaactttttattacatttctttttctttagtagagatgaagttttactatattgcccaggctggtctcaaattcctaggctcagtcagttctcccgcctcggcctcccaaagtgctgggattacaggccaccctgcctagccatgatatgatagtcttataataaaaaatccctctcacattttttttagaaaaaaaaatccctcctcttctttacaaaatatgtaatgatttgcctttattttacttgtccaatttctaacacagtccctattaagttagaaagctccacaattggaatcacataataaataatattaactaaatggcttaaaataacacaaggaaccccaagaagagagcttagattttatgtaagtattcagtagtcacctacttgtattccactaaattgtgaactccaaaaacagtgttttttatttaaagataaatttttattcaatacctgttttgtattaggcattttctcattttttgagaatgcaaaggaaagcaagatagaggatttcagctactatgcatgagacagcaaggcaaggggaccagttgaatatcaggctcaatgtcatatgtctggaatttatctttacacagatggtatttgtaagggtatatatagaccaaaaataaggtgagcttggaaattgatgatttcacattaattttctgcatgtcacatttgaggaatggattttactttaagaataaataatctcttgacagcctatgcatcagaatccatgtaggaaatagtgaattagtcatagttcaaagttgatcatctatttatttggatgttaatattaaatcataaaaatacaatattcgacaagtggataatgttattgctgggatgcttgaacaaaatgttcaattattttaaatgttatcaaatcatttaaaattgaaatttggaagttttatttccacaggagtaaaactgaatcatttaatgtgacaatgtccaggacagagtttcttaatcaaaaccctcgttagagaaatttaactccttatattacattttacggcttttgttttaattttatctaccactatagtcaatgataaaatgtgaataaatagaaagaaaaatattgtcattttattgtcttctttctattgatataattaccagagtcttctcaaagagggcattaaaaactctcttagggcactgaaagtcctttttactcggtttgaggtttcttaaaaggagtaaatgaaaaagtagggtagtggcttagagaaatccaccctggagaagacatgaacagaaaaataattacttataaatgggacaagttgatgtaaaatttgtaaagatgggttggagagttttggcaaaaatgtgagctctggaggaagcctgttgggttcaattcctgttctgtgcactgttctttcttttatattgttagttttctcaactgcaaagcagtgtaacacagtcgctatgattgctatgaaggttaaatgaaataagacgtgaagaccatttagcatacagtccaacaaatacaattgagatttataggctcagaagttaccattagtaatattcaagcacctggaaatctcacacttaatattaagaacaaataatgaaataggcctaaagactaagatgagttataattgtattatacttagtgcaataaattagacaaaccaggaatagagagattgttttactcttcaaagccttagaaagctatggctgtcacagaagctgttgaaattagtgaggatattatatgtcagtgggtaggagaggaaatgaaataagactggccacatagtcatcaatggtgtttagagtagccacattgtttcataagaacattcttgtcaacatatgagaactggagggtgaagattaaaaaaagagagagagacagtgatatgcaggatgagctcagttacaccgaatgctgactttatcacactgcagttacagaaaaggaagaaaaggccttagttaaaatataaataatatatcaagaaagcggaagcaaggttcagtgaaataaaacacaaaaatctaagaaaagattaaagggaagtatcttgatattgtgtatttttgaaagggctgggacaaaatgcattttggtgtacactgtaaagaaagataatgctaaaatcatagactaaataaatacatatgaaagtaaatttacacagaaaattagaagtatattttttgtttgttttcttatgcattttttatatggaccagcacagtctatagcatgtggtcccacttatgagaaacttcgtgtttatttgttcaatataaatgttttcaatttttttgtatgttaacaaagaaaaaatatatgaaagtaaaaggaagaaaagaaattactcaacataaattgggagatgattttttgtctctctgtgaagcagataaaatggtcagtatataacttcagtctctgtgtccagagcaggggttcctaacatgaggtcaatactcttgagattaaaatatttggtgtatgagatgatactctagggtgataattcagagctttcatctgattctcaagaacattgatgatccctttccttaaagctcagaaacaagcgatcgggagaaagataagtaaatgtgactaatgcatacatgaggcatgccatttgtatttatggattagcttttagtggtaatggtttagaggaaagcagtgctaagctcacatgggcaggaaagcaggcagcatactgaactggctaatattaaaatgtagggccgggtgcggtggctcatgtctgtaatcccagcactttgggagtctgaggcgggcagttcacgagatcaagagattgagaccatcctggccaacatggtgaaaccccgtctctactaaaaatacaaaaactagctgggcatagtagcacgtgcctgtaatcccagctactcaggaggctgaggcaggagaatttcttgaacccaggaggcagaggttgcagtgagccgagatcgtgccactgcactctagcctggtgacagaatgagactccgtctcaaaacaacaacaacaacaacaacaacaacaacaaatcagatacaaaggcatttctctgcaaaaggggaaattcctcttgtaaaacaaaaggaaactttataatgtactaaaaaatatggcaaagtgacagataaagaaagttgtcttccaaaataagcaatggggaaaggactccctattcaataaatggtgctgggataactggctagccatatgcagaaaattgaaactagaccctttcatttccccttattaaaaaatcaactcaagatggattaaagatgtaaatgtaaaatctaatactataaaagccctggaagataacctaggagataccattctggacataggacctggcaaagatttcatgatggtgacatcaaaagcaatgacagcaaaaacaaaaatggacaaattggacctaattaaactaaagatcttttattcaggggaaaaaaaaagagcaaagtaaacagacaatctacagaatgggagaaaatagttacaaactgtgcatccaacagcagtctaatatccgtaatctataaggggcttaaacaagtttacaggcaaaaaacaacctcattaaaaagtgggcaaaagacatgaacagaattttccaaagaaggcatacacgtggccaaaaggcaaatgaaaaatgctgaacatcactaatcattaaagaaatgcaaatcaaaactacaatgagataccatctcacatcagtcagaatggctattattaaaaagtcaaaaaataacagatgctggtgaggttgtagagaaaagggaatgcttatacactgctagtgggaatgcaaattagttcagctactgtagaaagtagtttgacggtttctcaaaaatttcaaaacagaattaccgttccatccagcaattccattattgcatgtatacccaaaggaatataagtcattctaccataaaggcacacgcacacatatgtgcgtcacaccactattcacactagcaaagacatggaatcaacctaaatgcccatcagcagtggactggataaagaaaatgtggtacacattttatacaccgtggaatactgtgcattcacaaaaaggaatgatcatgtcctttggagcaacaagctagaggccattgtcctaagcgaattgacacaggaacacaaaaccaaataccacatgttctcacttgtcagtgggagctaaacattgagtacatatgagcacaaaaaagggaatgacagagactgggggctacttgaggatggagggagggaggagcataaggatttaaaaactacctatttaggactatgcttattacctgattgacaaaataatctatacaccaaacccctgcgaacaaacaatttacatatgtaacaaacctgtacatgttcccctgaacctaaaataaaagttaaaaaataaagctgtcttccaaaggaaacctatggaagttctatacaaaggcaaagcatatatgaaatatatggtcttctaaatattcatgttaagataatcagtaaatgcctggaagacatagattggcttagaatgttataaaaatgctaataatttatagcttttgttttgttttgtattgaggcggagtctcgctcagttgcccaggctggagtgcaatggcatgatcaaggctgactgcaacctccgcctcccaggttcaagtgattctcctgcctcagcctcccaagtagcgggattacaggcacacacccccacgcccagctaatttttgtatttttagtagagacaggttttcaccatgttggccaggctggtttcgaactcctgacctcagatgatccacccgcttcagcctcccaaagtgctgggattagaggcatgagccaccatgccggccctatagcttgtttaaacaacataaacttcttgagcacatgggggaaagtacgtatgaagaagcagaaagagcactatttagttactgaagtgaaaaataatgaaatatcttggaatcaacttgaacaagatagggggaggtatgttgagaaagtattggcagtttccattaaaaaaagaaaaataaaaattacaatcttggcgataaagagctggaactagggaaaaatatttttaaaatttaaagaagtaatacaatatttacaattcaaaaaagtgaatatttacaatgaggagagaaatgaaaataaattatactttgattccttcttaacatgacaacaaaatctcaagattttcaaatgagaaaataggtaatttaggctttttttgcatggttcttcagaatttatgattgtagtattctacagaatatgctctcaaaatacagggatttcaataaattccatattgcatgattattataaaaatatggaaaagtgtgttgatgggggatgctaaagttctctgcttataattttatgcagcttattattagatttatccacagactagcttcaggctctgaacatttctaacttttttttctttccttcccactttcttctgaaacttggagtgttattgtataggacacaattttatgtgatatgactctcagaatatgacatctagcctcacaaccttatgtcacaacatggggtctgttggcacaacattctgtaagcgtatatttggaactcatttctatatcaaaatagctaacaatagcttaattctatatggaagtaactgcaaacaatttaacttcctcttactaaccgaaactaaatgtacccccacttaacattttgttactcagactctagaaatattatcagacactccaccaccacttgacacaaggaaaaggtcatagagggaattaagagcagaattggccaggcgtggtggatcaggcctgtaatcccagcactttgggaggccgaggcgggcggatcacaaggtcaggagttcgagaccagcctgaccaatgtgctgaaaccccatctctactaaaaaataaaaataaataaaaataaaaataaattagacaagtatggtggtgtgtgcctgtaatcccagctactcaggaggctgagggaggagaattgcttgaacccgggaggcagaggttgcagtgagcagagatcgcaccactgcactccagcttaggcgactgagggagagggagaccctgtctcaaaaaaaaaaaaaaaaaaaaaaaaaaaagctgaatcatacagccctctgaatcagttgcacttttctagaaattttgcaaaaattttatgaaaaacaaatgaccaagtgaacacctagtttcatacccaggactttaaaggtggtctatgcaagtgggaaatttgaagctcaaacattgtatatgcccacataaatctacctataggctaatgtctatttgtggataagggaatttagaaagactatccaaaaagttaaccatattatagaaaagatgaagataaagcaaccaagggaaaaacactggaaatataaacattatgagatgtaaagaaactttattttaacattagtcaatatgtccacttgtgtattgctgaagggagaactagagtcttaaagaaaaagtgattgttcctgatagaacaataatttattgcaaagtacacagtcttataaacactaccctttgctggaacatgataagatttgtgttcatggttcttcatattcactcttgctccagagtcaatcttgaaataaaaataagataattccagttcattttcagagtcctctcagtccatctgtgtcatttccctgtccctgaccccatctctggatcccattgctgttatgattccaagtggatgggagaccatcttcttggctttatgttgggcaagtttgcatgtaatattcagttttgtttgctctctctctactctgtttcaacccaagattgcaagctgtatttcttaacaattatttattaattatagataaaatactagatgttattggcaataacataagagtaacataaatattaaagttaagttagaaaagcattgaattaaaaatagtctatgtaaaattccaatcttgttaggaaaatcaggcctaaaacaaagttctacaaatgagtcctctgtcattttagatggtataagttaatttataatggaagtttgcattttatcagaggataatcaaatgactgacttgctgcatttgaaagccttctgatactaaaacagtctgtataggagaaaaatgggggaaagaaggacttcctggtgagagtaaaaatatagaattcaagcctacaaataaaattgaacttgatttttttctgtggatactttctcgtattctgggttaattttctttataatattttgaaaggaagtaaaatatgcagagtgccaaagacagcaacagaaacctcccatactcctgaggctttaggaacacctgtcatgaaagtgggtttggctgacgtaggaataacagtgatacaatatgagtgccttttatttttgacagtctctgcgtttatcaattgcaaatgtacggtgtatacagccagcaatttgtcaaagagtgttgtagaaatatgtctgacccacataaaaagaccctatgcgtagaaaagttttgtttatctgaactgtatgctcagtaatctaacggggaaataagaacaacaggtttctaatctttcttggccactgagaaaaggggcttcatatgttgtaaaatgcagttacatgctatctaaagtaataataaagattgttttcagtcctactcttaacttcctacaatttagacattaccagtagaattcttttctaaagttcctacgaagtcaatacctcctgtctgtctattgcatgctttacactcaggactagagtctaaatccaagctgagcaatttattgccattatgattttaggcaattagaattaaggttttcttccatagctcataaacaaaaatagtatcacttaatgattaggcataaaattgctgagatgtaatataagagaaatattttgcatgcatcctaaaattctatagttaatgtacacacacgctcatacacaattaggcgtgccatgtccatcttttctaataaaatgtagttttaatttttaaaaatgatacaatgtactttacctaacatgtatattttatatatatattatatatatatgatatatatcatatataatatattatattatatcatatataatatattatattatatcatatatcatatatatgatattatatcatatatcatatatatgatattatatcatatatattatatcatatatcatatatatgatattatatcatatatattatatattatattatataatgtatattatatatgatattatatcatatatattatatattatataatgcatattatatatgatattatataatgtatattatatatgatataatatatgatatatatattatatatgatataatatatgatatatatattatatacatggtcatggtaggttttcacgacaggcatgacactcaaatctcttaaaataatttttacttctttttaagtaatcaatcaacatttgtttatttaaactttaaactttctaattcgtattttttaaattaattgtaattgacaattgtataaatttatgggttgcaatgtgatttttttcaacttttgttttagatacaagggctacatattcatgtttgttacaagagtatatcgtgtgatgctgaggtttggggtacaattgaacctttcatccaggtagtgagtatggtacccaaaggatacttttctaaccctttccccctcccttgctgtccccacttgtagttcccattgtctattgttcccgtatttatgtccaaaaagtatgtgttaaaaaacggttcatctcacattgactgtattccctactttatgatcattcagtgtagatggatggagtttccttgatggtggcatttaattatgcttacaaagaaatgtgatgaaaattcaggttaaaagagaaaatatatgaaaggaattttcttcatcaggaacttcagcaaggtaagtattgtgctgcaacagcatgcaatcatccaatatccacgtttattttctcctttctccctcattctacaataatgagaaaaaagcagacacatgtgattcctaatccaatttaaagttttgccacctgatggtagattgttatttttgaaccacatttagcaaaggacagcaaattgcactcagaattacacaatattcactggaatctgtatctttcattctaagtcgtttttctttctgcaattgttcacttgttagaagcaatatctgccactacttatatacatagaagagagcagctgagagtaagcattagttccacatcattaatatgagtattaataataataaaggaaaccctttccaaatggggatttatgtttgagaattcagtattttagtccaaaggaagaaaaacaggaaagtttttgggcaggcttttctctacatttttaatgatgcattgggggagggtgaggcaataagagacacagagaagcaggtggaagggaagtaaggagggatgagaaaagcagagtactgactgttgactgctcactgctgcctcccccatgttccccccccaccaccatttttaaagactcatcatttgtagctttatggaaaagaaactaatgcatctagagcagaaaaaaataaataatgtacttgtatcacttgtttattgctgtgtgataaaacactccaagacatctctagtcacgttgcgtgaagggtcaaggacacacagggtcacattcattagacgctgtgattgtgaaaacgtaccacagataatatatttccccaaaatattaataaatgcaaaagagaatcatcaatatttttaatttgagaaaactctgtatttgcaaatagttcaaaagcatattttaatcaaataattatactagaacttaaccattaaaataatcccaaatatgaaattagctgtttttcaatagtgaatcttgtgtaaggtagaaagacatttatatttgaacggttaaaattattaccacaagtcccctaatgtttcataacctaaggcatggatttggggagaaaatcaacaatttatagtgctaggcaagccaacaatgatacagtagtaagttttgatagataagaaattttgttggattctgaaatatacatgacaatatctgtatcctatcaactttatgaatgtgtcctatttggagggagaaaaggtatttaggagataaatctgacacagaattactgtctattattataaatgttaaattaaaaaaagttttcaaaataagtatctgagaaaaatgaaattaatgcctattttaaaacattaaaatacctacattttaatctcctaaacatataatttctttctttattctggcaacatccttatttacttactaagtttgtatcaatgttaaagccttcaattaaaaaaaagtaaaattgtaaaaagagcctgtcatcatgcgagtcacagtctagtagagtcaggaaagtaaattagtaaaatatgtcacgtcagatggtgaacgccaaggagacaacacaagaaagggaggtgggaagctcttctggtggggaggccttgcgattttaagttgggtggtatgggaagatgtcactgagtagatggtatttaaataaaggactaaacaactgaaaaactaagccttattgttccctgggacagtgagcatttcaggcagagttggaagagcaaatgcaagtaagtgcctgaggtaggcattcattggccaggtttgagctataacaggccagtaagacttgggttgagttacgtgggggatattagcagcagatgacactggggagagagcaggcatagaggtaggtagattgaatgaaactacaatggctaggtaagtctttataagaattttggctgtcatgtgattgatgtgagacgctatggaagggatttgaacacaggaataacataatctgatttacatttgaaaaggattattctagtactatattgaaaatagatggtgagtcagaaaagaaaggaagaaatatccaagccagttaggaggctattagagtaatcatatgagagaccatggtagcctatgccacagtaatcgcaacaaaggtgatgagaagtaatctggttttggaaatatttacaaggtttggaaggaagagctaataggattatccagtatcttggatatgggctatattaatcaactttaatttatgtggccatgacaaacaacctcaagtctttccccaaatgtcagtaatttacaacaatgagcattgatttcttgctcaagttacataaagcagctgtgggtctggctctgctcacctgaaggtcagcctggagctgcttgacttgtgctcatgtttaccatgcatcctagaatccaggctgtaggagcagtttctatcacataaatgctctattcatggcacagggaggggtgccatagccacagtgggcaatcttcttaaaagtcctgtggagttaaggcataagtcacacctggttacattctgctgccccaagcaatgtggccaagcccatgtggctgggtggggacaaacacttctcctacgggaggtctctcaggtctctttatctgacagagaagggagcaagcatttggcaagcacaacacaatcttcaacattgcagacaacagaaatcaaggcttttctcctaacaaactagaaaaatgaagtcactgtccaccgagatgggaaagacaacaggtagaataagtttaaaagcagacaaaaaattgatgataatatgaaactgtgatgtgatattggaattattttaaacattatcataaaaatttattataaaatgtagaaaatctaagttatcaaaagtctgatcagttgtacaagtgacatgaaataaggtactaggtcattttcatttgaagtgaaataaccacccaattcagaacaattaacagggggtaatgaaaatacctgtattcatacacgtagcccattttaaagtcatataattattattcacagatcatcagctacatttaagggatggtgatattcaagctgtcttgtatttcacatctctaagtgtcataaatatttccctttactatagaaaaagcaaaccagtatcaaatcgacacagaatgattatcaacgtatatatcccttgtgtagatgtagtattctgcaacccctgtgtaagtcctttttcacaacgctatatcatgcttcttacagcacttaagctgctggtacatgggtttctgaagaatgaggaagggttaatcagcttttggcagagatcagcaaaatttgcaagcattttagcctctccatcaagactcataaaatattttggaaactacaggacaaaaaaccaacccatccaagcagaaaattaaaaagcaatctgccagttcaatggaattcaacctttgctaggctgcaaatgatggtaaaatggttaaatattcattcatgattacccagagacataaagctacggtagaaacatgaaaaaaaaaatacatagactatgggcaggtgggaaagaaaacaggactaaattgtgcatcttatggagcagtgctgtttgttttcttttaacctgatttctatcaagatgctgaagaactgtagatttagataagatgaggaagaagagggggatcatctctccaactcctggtttaaaagggacactcttttttctttttgcattgaatttttgcctaaaatttccttttattatagacgtgttctctttttcttgcttgagagtaaaatattccacaaagtcaccaatcatgaaagtcaagaaatgtttgttgtattgactgttaatttcctaaaagaaaaacaaaacaacagcaatagttgaataagggaagactgagtttattaagcctgtcatggtaaagaagagcacacctggacaaaggagtgccttgaaaagggaagtcagaggagggtgtttacacaggtgcagcttctgggctgagtgatttttaaggcgtcttgcaagacagagcactggataaggccaggcagagtttagaacttaatagctttggattggtgagcacagtgtggcaagagtgttaaagtgattacatgagcaaggtcttaatcttgacagctaagctgtttacttggttcatggccttatattccagaagcaagcagttaaattatctttattggattcagtattgtttaatatagggtcagagaatggtgtccgtttcaatgttctgttgagagtttacctatcttgtgaagttttgggagaaaacttcaaccaagtttagagatatctgctccatgtcccaaacttcccagataagggagattactctggtatcattctctgccagacatcacatcaagaaataacagaagctgaaactggaattacattataatccataaaaggctgataacagaaagaagtattacaatgaccctgtcttcttcagaagatccaataaaaaggctatgcaagactgcagaagttactacctctaatttcttggcttccatacatatcattttatttcttttctggcctatgagtcccaaaatgtggcatagatattgactccaaagagaggaagtgattaaaatctacccccattggttagaagctggccattaccaatactcctggtatagcataaaaatgcctcaaacaatacggcatgcagtactgctctttgagggctagtgccaattaagggaacttgcatacttctgtttcttttatttttaacttactgttagaaaaatgttaactaaatttttgaggggaaatgttgtcattacagaatgcgtgtttcattatgcatatcctattggtgaataatttgcaaatcctcatttgacctaaggagtgtttgattgtcaagctttatatccccaaattgccatcaagcagataacttgtctctatcatttttatttttgatagcaatttttctgactctaagaaacctataaagcataattgttctaaaatatctccactattaatccttttagtctcattttttcagaacatactgaaacagaaatagtctgtcacctctgcctccacctgcttttcttcttcctccttgtacttcagagctaaggaatgaatacagaatttattctctcaggagagtgaaacaattgatccagtaattgccatgtcaagggttttggtgagagaagtattctaaaatcacaatataatgcaagtctcataaaggatttcctaaacagtatgttgctctccctactgaataaaatatacctcatcctacatttcctccttgaggtctaataaggagagacctatctggtctatggatttaacactctaagataatttactttggacaaagatctttggagaagcttcattatattttgaagtcattaacatgactcaagaaagtccccaattaaatgaagatgagtcatatgacagtaggcaactgtagatagtctctgcccctacattttgcctctgtagaaatattctttacattcatgggcttccataggcctgatgttttcctatttttgttgttattctgcttcattactgcaaatgtcagacctttaagagtgaggttattaaacagcaaaacacagagcaataggcatttgtaaaagatatatatccagggaagatgctgctctcccactgccagccatacaagctgaggcttccttctcatcactgaagaagacaaggagacaagaagcacattatgtcataaaggcaataggaatcttgcaagtaaccttttcaccagaaaacctctcatttgccctgccttgcatgtactgttcttgaatgatttattgccaaaatattcttgaatttcccatattgttaatttaatgttcttagtaacaaaaactaaccgtgggattgatataacagaaaattccagtcacctcagggcagaaattattattttaatctagccatgaaaataaacattttttttcaggaaactcaagtccttaaaaatgaggtgaagtgtgtctaccacaaagtgtcggcaagccagggaaagtcaggcagggtgttcaaggaaattaaacacatccagcttcttttttctactgtcttcttgtttagttcttctaaaaatcagttttgatggggagctctggcaaatgtttgtgttccgttagtttaatgtgatagaggaaaaaacattctggctggcagctaggctataaggggagtgctgagatttgaaacagaaaccacaatttataaaacgactgcaataagacttgtaaaacacataaattatagcaaaccacacaagaatcacagatgatctaagaatatactctttaacaccagctcatttagatctacatgttccaaggtaagaacacaaataaactaatctggcagaaaccatctagacttgtgttctaaagacaactgttccagtaaatcctctttatttgaaaattcagaccaatccctgctaaggccatcttatcaggtaattttggcccctaaactctaaaggtatccttccctgactctctcctttagagacccccccttacttcctgtgatatgcattctccctgtcaagcattttaataagtctgactttaactgtaatggtgttggttgctcttagctggaaggctttaacttaaaataccaggaagattagagagataactataagtaaaaatcatctaggttatgataaataagctgttgaattacatgacttgtttctaggatttttctctaaacatgtattaagtcaaactttctccaatttggagtgaagttaatgatatcttttaaagcttctctatagaagcagagagtagaatggtgattaccaaaggctgggaagaggggatgggagttggggagatgttggtcaaaggatacaaaatttcagtcaaataagaagaataaattcaagaaatgtattgtaccacatgatgactatagttaataataatgtagtattcttgaaaatggttgagtagattttaaatgttcttgccacaaaaaatgataaaactatgtcagataatgcaatgttaattacccaaatgcaaccattgcactatacatatacatatataaacatcatattgcacttaataaattttttttatttaaataagtaaataattttttaagaaaaactctccaggtgattctaatgttcaaccaaatatgagaaagtataagttaaaatattaacacctttcaataaaacattttttaaattacatgatgaattacatatataaaatggataggtccatggtgagtgactttgacatacataaacctcagtcaaggtataccccatacccaagaacattccctcattcccctttccattcagccccctcccataagtaaggattgtttttctagcaccatagattagttttgcctgttcttgaccttcatgtgagtgaaatcacacaccagagcggttgttaaagatgactgacatgagatccaaaaatgtcaacctagaatgaaagggcttcagctttgagaagctcttcagatacatttcactgtaataccctaattttccacttgagatcaacaagatcacacagctagttgatggcatagttgtgaacaaattcattgtttcctaaaccctctttactgatattccttctgtcattcatcaacatgttgataagtagcaactaaactataaacttcaaaatatatctaaaacctcaatttttactgcttctcctttagttcaggcctgatgaactacttaactaaactttccagacaaacttccagactggtctctgtctttagattcttacttatttattcattcattaaaaaaccactccttgggaattcatagtctaatgaacctcattttgcagtccactcctgactttattacacagatctgattatgaagtcttcattggttttaattatcagggttacaaatatgtgggctgctgactaaaggcaatccacagagctgatttttccttctcataaaattagtttaaaaattaaattacttgctaataattaaaactgggacaattctgagtgataatttagtaccctgagttttcttgaaacataagaatgtctaataacacagagttctcacttttcttctgtaatcactggaaactgaggagtgaatatgttctttagtttattacagctgcaacaagtgactcactgtgtttctgacaatgtggccacatgcagccacacttcatttatctgtcaccttcttacctatttaggcattttacattttcaccctagttttctgagatgaagtctaaattctttgtccaggcaagtgaggcctttgcctttaacagcacactttccgctacatcttactgaattatatccagcctaaaacagttgttcttccctgagtaacaaaatatgaatgataacactattttgattggaaatctaacaattttgcttttcttctcttttttcccccatagaaataaggaatagttgtattttcccttacttcttgggatggcatcctcacccccatgaggaaagataactaggatctcagttgattaggctttaaagttaataggaaattagagtctatatttaaagaacaagaaaagcagggcctttatcacaagaagcagagtgccttgaaggagttgatattaagcaggttgtgtttcttttgcctgctgagccgggctctagtagaccaatagtgaaaatgtggttcttgctaaggaagattgcaaaccagtctcagagacggataagtcactagatagtgttgacagtataggaatcatcacagggtactcttgtagcataggagggagtagtatatactagaggacctgccatctggactagaggaagttatttctaagtgtctgaaacttaggcctgaagagctagtacatatatgagtaagcaaagcaaaaaggtgtttaggcaggggaaatctcaaagataaatggatagctcaccaattcaaggtatctttggggtagtttaccatagtcacagagaagctcaggtaggagggagtatggaaagtcaatgattaggggatttggagaaaaattgagtggaacagaggtagaggatgaaatcattagcccttgcattttattcagtgtaattttccttctttcctgagggagtgggagttatcaaaatattttttggagaagtgtaggatgacagaattgtaatatcagctaccgtgaactgttcgaagttctctttgtaacacaaaaaaacaaaaactgatttattcatagtttattttttaaaaatactttaaattctgggatacatgtgcagaacgtgcaggtttgttacataggtatacacttgtcacggtggttggctgcacccatcaacccatcatctacattaggtatttctcctaatgctatacctcccctagaccctcaccccccaacatgccctactgtgtgatgttcccctccgtctgtccatgtgttcttattgtccaactcccacttatgagtgagaacacgcggtgtttggttttctgttcctgtgttagtttgctgagaatgatggttgccagcttcatccatgtccctgtgatcattaaaaagtcaggaaacaacagatgctggaaaggatgtggagaaataggaatgcttttacactgctgggagtgtaaattagttcagccattgtggaaagacagtgtggcaattcctcaaggacctagaaccagaaataccatttgacccagcaatcccattactgggtatatacccaaaggattataaatcattctactataaagacacatgcacatgtacggttattgcagcactatttacaatattcagaggttttatggtaatattggtaaacaaatatagcaaatagattttaaaaatgaaaacaatggatcatgatatattccacctcatatgatcagaattcatttagaaatgggcttcagggggcttgtggcattcagagaaggctttatataagaaatggaacatcctcctaaaggaaacatgggtgttgaactacagtgagattgggggtaaaacatttcaagttgaaaagtttgaggccatggtatgtgtatttgtgtgtgtagcttagagggaagactgatgttgggagattctgaaatgtgactgatagctaataattttgaaattgacttggtagaaaatttctgactcttcttaagcaggagagtggcctaatgaaaataatgtttggattattgcgtgtggcattcaagttttctagaatgcaaagattggtattagcaagagctgttggatggatagcaagatacactaccaaataaataatttagaaaatttgaaggtacaaaacaccagtgtaaacaatgtttccagagttgaaacctgaagctcaggtctccaaatcactttccctgtaggaggagtgaggaaatcagttttccttgtaatagagctgcctccccttctattctttctacttggtaccatctaagttatacttggtctcagaaattatcataacaggttgtattactccattctcacactgctgtaagggcacacccaatagtgggtcatttataaaggaaagagatgtaatggactcacagttccacatgaggggaggcctcacaatcatggtagaaggtgaaggaggagcaaaagcacatcttacatggtggcagcaagcagaagtgctgagtgtaagtctcttataaaaccatcagacctcgtaagaactcactcactatcacaagaacagcggcactggggtaactgcacccgtgattcaattacctcccactgggtccctcccatgattatgggaactacaattcaagatgaaatttgggtggagacacagccaaaccatatgagatcattctaacagtaataggtatctctgttgatgtatccacctgaagaagagagggagacaggcaggggagtcgtttaggtcgtaagcacttagtgtgacttttcagccacggtgtaagttcgagtgtgtccaaaggtctgaaagcccaaatttcacaggtgtacagaatgtgtaggtttaccaggacttattctactcccaatggcatctttgttttgcataagagtctggtattcttataattcttttcttttctattattttgagactttaattaagccatagagtgtaactgtaaattcatgtgacctgaaactgtaatttttattatgtttcttcttaatttacacattggaagccattttgttttttaatttttattttttgattttattttattgtggtaagaacccttaagatctatcctcttaaatgtttaaatatataatgcagtagtgctgactacaggcacaatgttactccagacctccctgattttgcacaactgaaatttcatgcctgtttatttataacttaccatccctcttccctcagctcctggaaaccaccattatggtctttgatttggctattttaggtacctcctcccagagaaatcatgcaggatttgtctttctgtgactggcttatttcatttagtataatatcctcaagattcatccacattgcatattgcagaattttctttattttaaatccggatagtattccactgtctgtgtgcgctcatccattaatgaacacttaggttgttttcataccttgggtattgggaatgttgctgtgataaacgtggaagtgctaatatctcttcaagatcctggttttaattattttggataaatgctcacggtggaattactttatcatggttttttttttttaaaggaaccttaatacggtttccgtagcagctgcaccattttgcattcctaccaataccatgcatgggctccatatcctcacagacacttgctgcctactgcatttttttcaacttttattttaagttcaggggtacatgtgtaggtttgttacacaggtaaacttttgtcatgggggtttgtcatacagattatttcatcactcaggtattaaacctggtactcattagttattttccctgactctccctcctcccaccctccactctcttttgaaaggccccagtgtgtgttatttccctctatgtgtccacgtgttttcatcatttcactcccattcataagtgagaacatgtggtatttggttttccatttctgtgttaatttgctaaggataatggccaacgtctccatccacatccctgaaaagggtatgattttgttcttttttatggatgcatagtattccttggtgtatgtgtaccacattttctttatctggtctatcgcagatgggcatttaggttgattccaggtctttgcttttgtgaatagtgctgcaaagaatatacacttttgactcaacaatcccattactgggtatatacccaaaggaacataaatcattccattattaagacacatgtcttttgcttttttcataatcaccatcctgagagaaatgaggtggtgtctcattgtggttttgatgtgcatttccctgatgactagtgacgctaagcaatcttcataggcctttgggcccttgtgtgtcttctttggatgaaagtctggtcaagtccatagctcatttttgttgatgttattataaagttctgttatcattgttgtttttgttagtgagttggagtttcttatatattttggaaattaatcccttatcagatataagatttggaaatattttcccattctctaggttttttttttttttttcgttttgttaattgtttcctttgctgtacagaagctttttagtgtgatatattcccagttgtctatctttggttatgttgtctgtgctttaggtgtcagagtcatgaaattattgccaagacgaatgtcataaaagttttcccatatgttttcatctaggagttttctagtttcaggtcttaatttgggactttaattcattttgaattgatttttgtatgtgtagtataagagtccaatttcctttttttttttttgcatgtggatgttcagttttgtcaacaacatttgttaaagagactatctttacccaatttcctatctttggtatcaagccattttaacaagaattttaacactatacattttctgagagatgcatatgcttaggatgaacagtttaaattactaaattgatagcacatgccagattaagttctgttatgtctttactgtaattctttgatatttttaatatttcaagtacagatacattctaattttgatttaattctgccagagcaaaatgtatcttatttgtttatattgaatcaatattaaggaaatatttacacaaaaatatgatcatatattttaaatatctgtactgtaaggaaaatgcttttatatcttaaaagttattgaaaaccatgggtattattaggaaacattagtcattattttgattaatagtttaggctaagtcacttgaacccctgatggtgcctgtcagattgtggaatacacatatatctatttgcagcctctctgtcataagggctatgacaaaaattattatttaaaaactattttgagtttcacagaaggaggctataatttctataaattcatgtttatgtgactttgaagtagattcaaacaaatgttattaatatcaatttatcctgttaatctagggacacagcacactgatatttcccaagaaagagtaaaagattgaaaggacatcaataggtaaaaccatcatttgctgaaaactctttgccctgagaagcagaagcctgtcaaagtccaacacaaccatatatcaacctccctgtcaaggacatcacacctgcagtagaatcaacactgtaacaggttgaggatgaccttagtgttgtgctattgatttagtctccatgttgttattagtctgatattctaaggttcaatgaatttgatccacataaagtaagtatcaaaaagaaaagcgtggaacctaaaaagctccagtcaaaagcaatcacttccaggttttcaaacataaaaattaaagggattaaacttggattgattaaacttaggggaacgggactagtagatttgataattgtgttatttgaagatcaactgaatttttgcacaaaccttcatggccaatagaaatgagttgtgcccccatgtacctaagggtcaccgatctgcaacctacaagtagggtgacctgatttgcctgagactcttccggtgaccaaactcaactcatcattgacattaaaaggagagcttttaaaatatagatcctatgggcagcaattcagagttacagagtctaaccttatagcagtgaggtccattaatctgttttttttttttttttttttttttttttataaagtacccgagatggttttgataatatgggtgcttgggaaactctcctccgaaaaacatagagttcctgatttggaaatcttgctgcttaaataaaatatgtgtatatgtgcacacatgtgtggtgtctatttttccctttcctttttccaaaatgccaacaattatttccccctgtgtattatgactatagcttgtgcaattacaatgtttgtatgtatcacagttgattctaattaagtattaagacgttttatatactagaccaagaacttatttaagaacttattcctctctttttctgtttgcaatgatcagcatagagcctgtatatagaaggtattccataaataagctaattaataagacaagacacttggaaccattcagatttttaaacctgttccacaggacattgaagagaaatattcaggggatgcttcatgaatgaagtgacacctgaagagaatctggaatacactaaggcccagacagggaggagaggtttataagcaggagggaaaaaataagaataataccatgttgacaggcatgattgcgggaaaatttgtagatggtggaaagtgtgatttggtaacgtaaatattttagattcttcaccaaggggcaataagatggcagtagagtcttagtaaggcacatgtgatcataatgaatatgtttggagtcaagagaagctggtataaggaaattctggtggatgtttacaccatatagtacgaacgtcctgctcagagtcaaatgatttcagtttcaaaatgtgccatgttggtgtgctgcacccaccaactcgtcatttaacattaggtatatctcctaatgctgtcccttccccctccctccaccccacaacaggccccagtgtgtgatgttccccttcctgtgtccatgtgttcttattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacgtaccctaaaacttaaagtataattaaaaaaaagaataagaggccaaaagacactaaaaaaatgaatgaaagaaacccatgccttatctcttgttatataagtagtgttatttattttctggtctatgtatgatttataccgcaggaccacatttgtacagagtccagctcctgagcaagcttttgtggtgggcagcatatgaccataaacaaagcttatttttctccttcttcccatctcttttcttccctcttttccttctccttccatttctccccaccttttcagagaacgagactgcattgattagttctgagttattcagctcatatgatgtaatcattttaatgtatgtgatgagtaagatacaatctcctcaatttcaactacagattgctgacataatgaaaaaaatatatttatatatgtcactggaaatagataaaaaatgcaactgatataagctgggctcatgaagggtcctataatactctgtggaattcacaccattctaacagccatgaagaaatactgaagtattttaagcaaagttgcaactattattatatattcattatagctttatcatgcctaaatactattgtataaagttttcttcccacacgtcagaaacaataagattctgaaaaatattataataaagttattcttctgacaaatgaatcctagagaaaattccccacctgcaacagttccttcctcagttttctctgactcaatacaatttcattcttttcgttttgcagctcaaaaatcttggtgctatcattgtctcttctcagtttctctcttagacctaacgcattaacttcacactactttcaaaatatattctgggttcgatcacttctaaccaaccaaatttaagctaccattggatttttctcacctggattattacggcacacctttaaattcctgtttttgctcctacccacaatatggtagccagaaagatcctgttaatttaagtcagattacagcacttccctcctctaacgactttccttctttctttcctccccctaacgactttccttctctcttagagttaaaatcaaatgcacttattgtaatgtatgagacccctcttggtttgtgcccccattatctccctgccttcatctgttttgactcttcccctctgctctctcctttagtcacatggtccccttgctttatgaacatcctggcattctcccgacattgtacatacatgcaatgcactcagcctgaaaagtctttcctcagataaatgcatgtctgactccctaattcccttcactcccttcctatcttcattccaaaggccactttccagtaaaggcttactttgccgcactgtctaaaattttaccccttctctccaaaactttttcatattcccaattgtactatgttattaatttggtgcaaagtatttgtggtttttgataataattgtgaatattactttctctctactggagagaaagctctttgagacatgtattttagtctcttctgttcactgttatatcccctgatatgtcagtatctgatacataataggtactcagtaaacatttgtcaaatacatgaatatatgaaattatgacaatatttgaaataattctaattatatttgaaatgctagaacatatatttatgtctattcttgaatcataacatagaagaagtctatagaaaactccattcttttatttcttatataatctatatattggattgttcttttgagctctgagaatatcaaattaaaagtactgaagtaaatactaattagtttctatcggtacctttatttgttctgaatgtttctcacttgatgtttagtgttagatatataccaagacaaaattaaataaaatagataagtgtttttcctataattcatcctaattattcacatttaaaatttagaagggactttattagatgcactttttatctatttttagataggaaaggccaatttgcattctcttcaaggaaataattggtattcataaaagttggactaacaatttcatttacatttgaaagaaaattaaaattaatccaatgtaggatattatacaaagattactatgcaaatatatttttaaaagttgctatatcacatagtgaacatttcaatggaacattctaaaaatgttgaggttttgtttcttaaaaaaaaaatacattcatacgtaagtgtgagctcttctcacttccataatagaagtgagaattatgctgtctgcgtactcatgaccggcatagttttccacaagtgctggctttaataggtgaatataaaatgatgtgattttttcttttttactgacatgaacattattattgtgcctttggttgaaataaatacttgaaatgtttgaacacacacacagccccatataaaacagttaaaaagttgttcttttgggcattccatttgttggtcagatatctgtattaacaccgattcatatccctcaagctgatgagaatgcagtgtaactaacgttgaatctaaggccaaaaagtatctacaaacaactggagccttgctggaaccatttgaggccgccttctgacctcctgtctcggcatatagctctgccagtgctttaacttgaactagtgagatctgaagcccctaaaaaaatactcatttttatagcttctaacgacagtatttgtcttttgtgtggaaatcatttttcagcctcaaacccttagattgggttcatgtggatttcaaaataagttgtcttaaaaatattttgctccataataattaaaacccatatcaacacatttttggtaactatttttttgcaatccttcatattaagagaattgtaatactttttttaaaaaattatatgcttagccatttgtatgtctttcctctacaaattcctcaaaagtcccacatatttttttctgaaatctcctctattctctcttagtttgttgtgttatattgtacatggagatgaaggatggtataatgtttaaaagatttttggctttctgaggagtgtttgtttgacttatttgcttttctgcagagcagtggacacagctcacaggctggccgtgctaccagctcttgctattattcactgtaaactcggtgtgcagggtaccgaccacagacagctgcccaggcaggtggtgtgcactgcacagagtctccgaggtaaggcagcgtaagagccagcaagacctttttaacaaaataggcgttagccagggtgaaaatggggaaattgcacatatatagcacttgagtgtccataagttgcatttcacctccttttttctcactgaacctcataatcatcctgagatctacttacgtattatttgtcccattttccaaataaagaaaatggggtaaagagaggttaacttatttgccaaataagagatagtggatgaaatcttgatcctcttactacaggtttcttactcttccctcagcagctcagcctcctctattgctcagcaggcattgtggagtgaatggcacagacctctccattcataagtccctctttcccattttctttctccttcaaagagcactggtacagtcacctgaaaagctaaagatgcagtgtgacaactgctacatcagcaattccagacccaccttcccacaccatctcacccctaccttgaaaagaaacctttgctttagattaacattaattaagtcatgcattagactaacataagactttatctattatctatctaatctaatcttttattctatccatctatctaccatctattatgtatcatctatttactgaattatatatctaatcttctatctcatctatttatcgatttatccatctatatgtaatctactctgtatcatctgtctgtctatctatctatctatctatctatctatctatctatctatctatgcgatatctatcacttttcaacacctaattcacaaaaaagaagccatgagggagattgtagactgtaggagaggtacacttatatatgtaaacatttagagaacaataaaagactacaaaacaatattatgtttaatgaaattaccatccaaaaaacgtgtttgggtgagcaagtggtaccacatctgagggaaagttgattgtgtggtagaaaaacagagcctttggcatcagaaggactgagtacaaaccttggctctgccaattaatattgggtgacctggaagaacatgtctaacttctccaacatacacattttttttcttgtaaaagtgatggttatagactcttctaacagaagtgttacaaagattaagtgattaatgtctgtaaagctgaagctcagtgcctagcatacaatccactctcaaaaaagagagcaggtttccacacctgtaattcttaataaacttcattaaatagcaatgtctaattattttgttacatagcaatattttatcagcaacgtttattggattccaacaaatattctttcaacaaatacacaaagaaatggaatatttcatggttatacttttttctattgtataatgtcagtctttttttttctcaagtagtaattaaaacttgctttgaaaaatactagtgtaacctaaaactactgtattccttaaaagtacttagaataaggagagggcagcaaaacaccacaggaagtataggggattgcatcccagacagacatggtcttggcttctggatctgcctcttggtagctgtgtgactttggatgaattgcttaatctcaccttgttttaagtgagataaaatggggaaaataatatttacctcacagttctgataggaggggtaataacataacgcatgtaaatcatgcagaacagcgtattatgataggtgcctaataactgttaattccccttcttctctttgttttactttcttctacttttctgtccctaatattctgatcataacacctccaggaacaaaagaagaaagacagaaatactaggacagttaagaagatccagtgagaaaaactcatatagagaagacaagattattgaaaattctaatcatttcactgaaactgatgtttccttgaaacaaacattacccataagaatggctgccatggtttatttaggaaacaaagtgtaatatttacaggggcagagaggacagcataagaatgaaaagagttagtgaaatctgacctttggtgagctggcactatttagtaaatctcccttgccttggtgaaagggattggcttccagtacagttaattccacatggaagagaaatataggagctttagccctgagggatattgctctataagcccaggttcttttcagattattctggttgattaaacacacagagaaataacccttttaaagttgtacatatattaagaattggagtaggcatataagcatcaccttacaaccgacaaaacagatttccaagcaacatacaatttaaattaatgcagttgtacgtaataatgattattttccaaatgatctatttgattggtatacatgctttctgactcttctcccaacagtgccatcagctgtaagggaaggattgtggactaaactcactcccgatatttagattatgaaggcaaagaaactatggagaggataagacaggaatttttaaaaggagaggactaagaagacaggggcagtatgtactatattgttaccctcccaggctggaggtgtggaaaactattataaaccgctaatgatcatttttttggtgttcgttattagaaccaatggaaggaaacatagcaggtgaacctcactgtattctctaaggtctttccagaaaagttgtgcctttataattaattctattgtctattagagtatacagttaagtgcatataccaaacttctttggtaaaatgtatagaattaaagactttcagggctgataagaggcccagtaagtcatacaggttagaattctcagaaagttaaaagccttatgagaaatttccattggctcaaatcagatgagaataaaacttgatcctacgtgtcttaatattcagtctaggagacttgccagtacccagtgcttctttattgactgattaaccattttctaactcactaattaggcaaaccagaatatttgtatgctccctgtgtgtgattgtctaggttgcaaattgagctaatttaattttgttgtttacaattgatacatttatttttgatatcctttggtagccttttgttagaggtgagagttatagttttatttcctgatcacactatcatctcatgttaaaatgagggtaaaaacacaacaatcaaattctacaacattttcaaacacttattagcaatgaaacagaaaatgtaatacaatctaccctgtaagtttaattaagtctcaacctttgtgttttttagtactgtgacaaactccgggcatgacagtttcacttagacagacatgacagttttctgttagcaggacctggttaccttgtagctggaatcaggccaaagcatcttctggaagaggttgctcataggacttgtggacattcatagcctgaggcaccggggtgaagagtggaagtgacactctaggtgctgggacatgttgtgcacatgacagaggccccacgtggtatcttagcaagtccacatgttttatgtcactcatgaaacatttcagtaatgagaaatcattgcccctctgcatgatgataatgaaaattttgaaggttattaggaatcagcatagctgatggattataagaacgacatctggcatgtactttttttttaaccactttatttgggtatgattgacatataaaaactttacatatttaatgtatccaactcaacaaagttggagataagtatggacccttgaagccatcaccacaatctgtcataaccctatccatcaacttcaaaagtttccttcttcctttttatttatttattattattatgatttttttgggggggaaataagaacatttaatataagaggtacattcttagcaaatttttaagcacacagcaccgtattgttaactcaaggtggatactgtatctctaagacttattcatcttggaaaaccaaactttgtattctttaactaacactatcttctcccatatctctcctgatcccacccctggcaactaccattccactctctgcttctattaactacttcagattcatcacctaagtggtaccatgtagtatttgttccgtgtctggcttatttcacttagcacaatgtctacaagattcatctctgttgcctgagtgtgggattttgattggcatctcaaatcctgacaatttctgcagtatgtttattgtacgagtttttcaaagatttgccaactgtcccataaaactaatatgcatttaaaataaagtttttaaaaatataacaaacaacaaagtttgagttgggcaggaggaatatattttgagatctactgcacagcaggatgactatagtcaataataacatattgagtatttcaaaataactaagagagtaggtttcaaatacctgaccatcatttcacattgtgtgatatgtatatatacatacacacacacacacatatatatcacattgtaccccataaatgtatataatttatcaattaaaataatattaatttggccaggtgtggtggctcatgcctgtaatcccagcaccttgagaggccgaggtgggcagctcacgaattcaagagatagagactatcctggctaacgtggtgaaacctcgtctgtactaaaaatataaaaattaactgggtgtgttggcgtgtggctgtagtcccagctactcgggaggctgaggcaggagaatcacttgaacccgggagtgcggaggatgcagggagccgagatcacgccactgcactccagcctggcaacagagcaacactctgtctcaaataaataaataaataaaataaaaataaaaagaaacagaaaaatcgaattattttatttcctatgaataaggcatttataaattattgtggaaagtgcctgtataacagaatattttttgaatatcataagtttgatatttatttcaatcatattttggatagatttcagcccattgctaatcatccattctccttgttttatgcaatgtcaaagaccacttcattttgctttggataaataagttttatttgatgaatgctgttgtcatttaaattacatacaaaaaaaatgacacaattacattaaatacatggaaattaaatgcccgtctccttcctacacacccacacacatttacatatctatacctttgtcatgtcatctcttcccacaaattataattttagccattttttctgtatttaaaatgaataattatctttcaccagttaaaacacttttatttgcttgcagaaacgtaatcattttctaataaaatagtagcagacactgcagtaaattctagccagaatttggttattatattaatctcacttcccatcactgaattcctttgcagggtaattagattgctatctgattctatcttgagtccaccaagtcaaggtgcaggcaggtggaaagtgtgttaaataagtgtcctgcttgatgggttctttttaatgccgatgagtttgtgccagtacaaataaaattatataaattactgtcaatcattagaggtttaaaaaagccaggttatttattatgatggtgtatatacatatatgtttatatacatatatatgtgtgtatatatgtatgtgtatatgtgtgtgtatacacgtgtgtgtatatataaatatgtgtgttatatgtgtatatatatgtgtgtatgtgtgtgtgtatatatatatatttggctaagagtttcttataagcatttcatacatggctaattatttctccagctttactatgcacagctatcaacctaagccctactctagctgatcatccctaaattcccttcagaatcctgccatattagagtaggagaaagagatgatacttttgtgtcaagtgagtagagtgagaatatgtcagttttcatatttatagagtgacgtttgacatctttaaagagaagttcctgaccttccctttgtctttttctaaccaagaaaatgtcagccacttccattgcctatctccagccgcatctagtacttctctctattccaaagcttcaacatactcttctgtcattatctgatcatctattggtcttcctctttcatttcaattcaagggaccttgacttatttctcatggttgtcttatcagaacagttcctgatgaaattaatttactgaatgctggaacaattccagccttcattacataaggaattcagtgaaaccttccttaagctcacaactctagtgtcaattatatattataaacacacaatcacaaacatttttaaaaacatgtctgcattataatgtcaaaggtagaaagaaattgcccatcatcgtccaggttgtcttgaccatccttaagagtgccttctacatttcccttccatattttctttaatgatagaaaattgtgtagaagacaatagaagaggaactaccccctctaggtcaataagacttttcaaccacccccaaaggtaatatctaaattgtacaaccagaatttacctgactggccagcatatataaaaggggccattacaaaagtatggcacacaggtcagaatagagatattcttctgaaacaaattacaataaggtcgggtacagtggctcacacctgtaatcccaacactttggaaagccagtgcaggtgaatcacttgagcccaggagttccagaccagcctaggcaacataatgagaccctgtctctccattttttagaaaaaaaaattagcagggcgtggtggcacacacctatagtcctacctacttgggaggctgaggcgggagcgtcgcttgacctagggagttccatgctgaagtgagcagtgattgaaccactgcactcagactgggtgacagagccaaaccttgtctcaaaacaaaaaatgaagaaactccacaaaatcacaatgacctcctcctccacagtcaatgatactagtggtgaaaatgatatgaaattccggcaacttttaaaaataaaatttattcctacaaatttttgttgtcgttgtttattgtttttgagacagtttctggctatgttgcccaggtcataatacagtgatgcaatcatggctcactgcagcatcaacctccccgggctcaagtgatcctctcacttcagcctcctgagtagctggaaccacagtcacacaccaccatattcagctattttttatatttttttagagatggggtttcacaatgttgcccaggctggtctcaaattcctgggctcaagcaatcctcctgccttggcctcccaaactgctgggattacagcatgagccgctgcacccggcccaaaaacatttttgaatctccttaacttgtttctaaatcaccactcttatttccactgaccacttaaacagatgacttgaattagttataaaactgctctggctgtttaatagatttgatataaaatacttttacattataatagatttgttttagatatgagtttttctttttgggaaaatgatattaaaataaattttacttatatttttaaaaaaatttctcattttattgatagggtatgttttaaaaataagattctagtcttccattaattaaaacttgtgctaaaaaattaaaaaggttagcctttcaattttaaataccaaatatagaaaacatacatgttaatttacagaatgtgtacttgataaaccaaacttaaattgagcaaggaacaacatgacgcattttaaggcaaatacataataaatgctaaaatgttgtagcaatattctggctttaaagaaatattgattaaatttattaagactgggctttgtctcaacacttaatggcaactatgatttaaaattaattaaattatgtttaacgctactgtgcatgtccttgaaacctcagtcaaattatatggtcattagctttcatttttatgataatgaaacaaaaaatacagtttccaaaatatatttttcactaaatctatggctaaaattgaatttaaatttctaggtttttttatttaatcaaaaaggaattttacaattcaatcaattgattgaaactaaaacttcaaattagggaggatttaattcaagcctgctattgtatttattattatttaaatataacatgcagacgcctaaactacacagcagacactctattaggttttgtatatatagaatcacacacacatactcccctagtttgtgagaaagtgctctaatattacagacacagattaaagtttagagaaatcaacttgtccaaggttacatagctagttgcacacacagaattttaaatcattcttatgtgactctaaaagaaaatacggaagtgaactgattaactttgcagttaagtttgcaggaataccctgggcaacacagaccctctgtcacagccaaatgttttgtttcgttgttgttccttaaatatgaccaatgctgtcaattctgcaactatattcttgcatttcctcatggctggaaggtctcatttttttttctgtcctttagatattaatcatcctttaaggctaactgagagccacatattcaaagaagacttccaaaccattacactattgaactatcccagcttttacctttctcgtttgggaacttagagactcaacttatggtattattaatactgcctatcctcagaccccagagacaaaacatgctgtctactttctcagtatcctccagagagcatgttatagaaattgacacatagaaatgatctagtcaatatttatttactaccagttgctggtacctggaaacattcttagtagtcttggttttcctggagtcctaatatagtatagtacagccagagacctgtttggttcacagaatttaagtaaacttcttgatcttacggtgtctgctagcatcatgagaacaggcaatgcaatatcttaagaccagttaaaaggaattagttttgagaaaagcttatagaggttacaccactttgcccttcacagaatctttcatttcagccacaaacccacattatcaattccctttataagctgtggatgacttgtcaggaaagatagtaacagtcaaccaataaatggaacattgtctccctaattcattcagagatgtttgcccatggagatactacctggtgatcttgccttacaacatcttgggcccagagatattgctgagattcttgtatttcccctctcatgtccagcattaatgtataagtcaaatacccatattctgtaaattctacacatctaccagtaggcaaggctggagatccaagttcttattatttaatcaactaatcagaaaggaagttctggctgatatttagaagttctgttaacatttcatagaagtaaatgtacaatttcccagaagaaaagtatcttgggaacacagagaccatctacatggacaaaagtaggggctaataatgatatgttacctcttgatattttagagaggcaacattgcttagtgcataagagtcaagacctgtggttgaagtcctgttcaactctgtactctcaatattaccttaggcaaataattaatttctctacacctttatttccttatctgtatctatatctctgtcggttgagttacagagagggtagctatgaccattaaactagatattttctggcacagagtaagtacttaatatacaaattttatatatgtttcatatatcatatataattatatattagagttgtatattatataacaaatatacattatataatgtagtttgcaaataaatattatataatgcaacatgtaatattatatagtatatataatatataaatgtagcatattatttaaaaattaaaaatatgtataaacatatatttagaatagcttacttcaattttatttgaggaactcattttttggctgtccacaacataaggagtaatggattattggtagattttcacagtctgattgtcttttattagatttagatcttctttctttccttctcatttctaactttattcagtttatagtacttagtagtttacaaaatatgtttacatatatcattgaatttgatactcctaagaaccccataagcaaagtatgatctcttattatacatattctatagataagaaactgagcatctagaagttaagtgactgctcaagatcacgtggctaggagtttacccaaagcctaaacttaggtcttctgatttctaatctagtgtttctcctactataatatttcagtctgctttttcctttcactctaaggcttattattttcactaaattcaaattgccttttctgctttgttaaatactagagttagacatttgtaaagttaaacacacacacacatacacacacacacacacgacattaagggcaagatatatacttccaaggtttctgagaggtacagcttatacaaggaaaatcttttgtaagaaattgtatagatctacttattcatgtgctgagtacacattttcaattttgactattggtataatttagagaaattcaattaaaaagaaaaaaataagtactcctctttaggcatttattctgttcacctgaaagtatattcatagccattttttttttgttaatgttaaataacagatccctttccagggatcctttccagggatccgttaagtgcagtccatgttagagttaatgaaatagtaccacagtttcagagataataaatatatgggggtaaggaactcacattgctacgcttttttattctgtttgaagtgatttgctttttgaaaaattgaaaatcagtggaaagctagtgaataagactgattagatgcagaaaaccacttgtgttctacaggtaaattagaaagtttgttgctacaaaaaacatcccttcgaaatgtaggcatacacaatgatttttaaagttgttagaagaagtctgcacatgagctgttcattttctatttagaataaacgatgtgagtggttttgactcctttctcccagtggcccatgccatacttcaaatatgaaaggaaataaaactgcaagctttaaggaaaagataaactctcatgcctgctatatttgcagagtaatcaaggattatggtatatttatcccatttcctcactcctcccttcttgttatttcagtcttcctcatcaaaacacttacttttcactgaatcctccaaattagcttctcatgcatattcaccggcagatcacacagtgactctgtaatggctgcagcctctttgcaattgaggcacagtgggccagacccccaccaggcaggttgcctgttgctggtgtaggctctgggaggtgaacatcagctttgttattccagctgggtgctgcagtccttgaactagcagctttagtcttccttaagatagcatcgtcgttttaatgagagtgaatgcatagcaataaatgctatccaagtcacaactggaattctcctaaggggagatgacctttcatatttttaatgaagatttatctttcaatttccatgaagcaagtggctaggtattttgttatttcatacgaaaataaaaggcatctcatagtaattttttctttgaaaattatttctcaaatttttagacttttagtggaagcgcttttatcttggaagattccactaaaaaagtagaatatttaccactttgggaggctgaggcgggcggatcacgaggtcaggctgaccagcatggtgaaaccccgtctctactaaaattacaaaacaaattagctgggcgtggtggcaggcgcctgtagtcccagctactggggaggctgaggcaggagaattgcttgaacccgggaggcggaggttgcagtgggccgagatcgcaccactgcactccagcctgggcgacagagcaagactccgtctcaaaaataaaaataaaaataaaaattaaaattaaaattaaaaaaaaggaaaagtagactatttacaagatttacaagtaacctagttggattataacccttcctcctgcaaatttatttttctatgatcctagaaaggtcttcatagtataaggattcttttggacttttgtgttggagataacagctaaaagaaaaatatccatcctctgacacacatacatacctcattgtatttatttacttatttattttttattttttaatgaacttatggcttctactttcatagcaactgactagaactacacaggaaactatagacagcaaccttagttatttcctggtttaagtgatgggatgtaatcatactgtatagttgtgaatagataataaaattgcatgacaaaaatgaaattgagaacagacttctgccacccttctgtaataaacagtataggaacaacactagacactagaatgataagaatgtgtcaggaatagcccaatacaggaattcattttttgtctgccttggcatactgcattctttatcaacaaaagttatttttaaaatgtcacataataataatatatgttgtccctttttttaatcttaaaggatcacatgttaaataaaaggaacaattagtagactatatgaataccttcaaagcaattttctaaaacaataaatgtagtcagatttgaaaatcaatcaatttaattatatttgaaattatgatagtaaaaatctatatagtcttaattattagattatagtttacctatcttcattgcatttgatgaaaaactttaaagtagaattatactttgatataatttagttttacttaaatttgttgttgcactaaattatcaagctatattttctttcctggttattctaagtagtgtcaagcacatatcagaaaacccactaaattggtactttaacttttaaaaacagtcttattagtgccatgtggtttaaaacttagcttaattcaaacagatataattttaacttaaaactttttttgggggacggagtctcgctcagtctcccaggctggagtgcagtggcgcgatctcggctcactgcaagctccgcctcccgggttcaggccattctcctgcctcagcctcctgagtagctgggactacaggcgcccgccaccacgcctggctaatattttgtatttttagtagagacggggtttcactgtgttagccaggatggtgtctcgaaaaacattttttatatattaaagtgtttttcaaatttgacaatgtagaaaactataatattttatttcaagaaatgtgtataccttaatccaattagcacctagattctgacctatgttggcacatagtatgatcagccagggcaccagcatcttgattacagaggtgattggatagatccacccatgtcaagcagacccaaatgttttcttttgacttcgggctttccaaaagatacagtagagataacagaaggattgatgaaaggctgaaaccacactatgaacagcatacgtaatctactattaaaagttcctaattagggtagcaacaaaaactttagtcagatctggataaggcagtatctctggctgtgttcttgtctgtttctcctcatcctttttctgttattctcttaatttcctgcagagaggtagacattttagtccacctattttgttaatacaaaggagcagtttctttatattgtcgttaatttactgatcgtataggattatcaacctctttcattgcttaatgttcaaattttaaaaacactttttcataaactatgcttgcttctattgctctaacaatatttgttcctatgttctactctaaattatgcaggtttaaaatctttctcttattttgctgcattcttgtgaagtctgcatacagattcttgattcaaaaaatcatggtttctgtacctcttcctcaggagaggttttacagattctactgatttttggtagacagaaaccaacttttaaccagtgtactacttggaaaaactctttccaaatactgtagaggaaagatgttgggctttgaagccaaacagacttgtgtttgaaacctggttcccatgtttccagctgtatgacaatagcaatttacttcctaaacttaatggagtaatatcgtattaatatttatcccaaggtgtgactgtttggattaaatgagattatctatgggtgtcccaaagtcacgcaaatcacaagttcccatcttgttttttctctgtggttacttctttttattttttttatttttaattatttatttatttatttactttttgagaaggagtctcgctctgtcgcccaggctggagtgcagtggcgcaatcttggctcaccgcaagggctgcctcccgggttcacgccattctcctgcctcagcctcccaagtagctgggactacaggcgcccaccaccacgcccggctaattttttgtatttttagtacagacggggtttcaccgcgttagccaggatggtctcgatctcctcctgacttcgtgatccgccctcctcggcctcccaaagtgttgggattacaggcgtgagccgccgcgcccggcctctctgtggttacttctaatgttggaagtcatcacagtgaaattctttgtgctatcttcaccatgggaatctttctgtttattccatgcccaattacatatatttcacatttcaaactttatcttgagtgaaaagaaagaaggactagctcctgatatattcctcatggatattctcataaaaatttgagtgtttcttttccagtaaagtaagttaatcctttccaacgctctgattattagctcagcacctctatggtattatagttctttttgaaaaatactgcaataattttcattttcataaattcagtggaaactgagttgctccaggtagggtagcccaaagctgactgacaacttcaaagctcacagacaagggcaaaaagcatgtgtgctgctccttgtgaataatactacaggaaaaaaaggcaaaattcctattcaggtaggtagatggtcaaaagagtttcctacaagacagtgtcacgtgcaattttatctacattgttataacttccctacctgacaagacagtgtcaagatttgttaatgagatggcctcacaagtgtatatttaaatattttatgaaaagccattgtagctttctatggatctgacagtagttaaatgcatgagctcccaaggcctatttcaggggctacgtgtatatatctttttccttccaaagacagatgaaggtgtgcaagtcactctactgatttgcaaggacaagaaatgtgctttttctctaattcattctgatattagctattggagttctctttgccctatttcagcactgtttgtacataaatacaccttattactacagaaaaaaattccatgatgaaacctgaagtgctttaatgcactggtctgtagacacagcccatttttttttttctctttacctttgattatcaaggagtaatttgctcaccagcaaacactggataatgtaatatataactttctctaacagaacagaatacagtgagtaggcatttttgaacggtctgttttgatattttggtcccactattctaaattttggggatgcttgtgcggaggtaatgcttaatctggtatcaaataattgctatctgcatctgtgctcattaaatatcattttttaatccagaattttttcctgtactaaggacaaaatgaatattaggccttagacatttttatgtgacatctaaaaattgaagcaggtatatctctaagtaaactaataatggttgatgattttcataataaatgtgcacatttaacattttcctcttcaaattctaaaggttggaaagtgaaggtgaaatcctatatgaaattgtctatatatgctataggttataaatccagattatcattttagattctgtatgttgacatgacatgtaagaactgatgttgtatgaagagtaataataatgatattagaacaaaatgtaatttcctatcagcaatgattagtatttaataataaaatatattaataattaaacattttgaatatagccaaaactttgaaataagaaatgaaacacttaggtaataaatgagaatttagtcacaaaatactgaagtaatattttagctaacttattagcatttagccaaataataagaaaatacttaggttccacttacctaaaaataaatctagtgatgtttccagatgtttagaaaatcattttctttaattaagagatagatacatttctgtgttgtaataaagaatgcaaggagatattttcttataaacctgaaaaagatgtcttctgaatattctggaatctgttttgactcatcggctctattagactttttagttaagtgtctgtttttaagaagatataattcatggtgtactcaaaataatactgttggcagactgtatatgagctgtggaaaggattgcaaactgtaatgggaagtattataataggggatctccactctgctcagatacagggaacatttgataaaatatttcttgaatgaatgattattttacataattattatctagtataatgctatgttttcagataaaaatattttatgtgaaaatatttttatcagaggtcaactttaacgccaccaaaaaattgaataaacatttttgttttgctttcatttcaggtactagaaaattaccttgcatatcattaatagtttataggacttttatttgggaggtagttttcaaaaagttatgatttttgtctagctctgagctctataccagcctctccatcccatgcaattttcatatgtcaacctattaattttgaaacaaaacaaagatgcattgaaatatttctaaatgtccattctacatcgagttctgcaggcgatagtgttgttgcataggcatttaaacatttaaaaacttttcttttctttctttttttttttttttgagacgcagtctcaatctgtggcccaggctggaatgcagtggcatgacctcggctcactgcaacctccgactcccaggttcaagtgattctcccatctcaggttcccgagtagctgggattacaggcgcccgccaccacacccagctaattttttgtatttttagtagagacagggtttcaccgttttggccatcccgacctcagatgatccccccacctcggcctcccgaagtgccgggattacaggtgtgagccaccgcacctggccaaaaatcttttcaataaaacgtgagttctgtgggttgcttggaaaaatatattctagggttctttgaatttaaagacactaagtactctattgcagtcttgaatattaaaactcaaattcacattcacattttaaggtttatgaaaagtcaaaaagtccagaggattatttagtctagacctcttaacctagagctgccaaaacgtatttgagcagaaaatctgttttctctatatttctgttgtcttttttttttttttttttttgtaatccctaaaaacatccaaggaaaggacattgaaaatccctgggaaagaaagcaatgcctcctgagtttgaagactgggtctcctatcttttttctttacagtctcagacttagggatgtctttctttggataaactatttacttccttcattttctttacttgatctttcataatgggttacattgctattaaccaaaactatgaaacatgaataaagctgagaaaaccatcagtcaagtaacaggaaagtgcgcatatttgcccatactatggacatcccaatgttcccagcgggcaggggacaaggaggacatgaacatattctccaaagccaggggagtttcaataacatttttaaagtaatatgttgccattatggttgtcaaaactataatggcactatgttagataaaacagtatgaaaagcaatatcataaaaaagtagataaaggatggcatgattttatgtgttgaattccccaagatatagtacatttgtttttttccttgtgaccttggacaaaagtaacgatattctataaaaatgtggtttgtataactggagttagtgtcaggggtaaaatgaaagttggaacaagcagaaaaagaactatgtatggaaaagaaagaaaggattgtttaacaaactggtgatatgggtttctgtgaaacttgtgtagataagctggaaaaagatgaatgatggaggagcacccaacaaatattaatatataatgtcaacttaggggtaaatatcaagtgttatgcgtctctttgggtccttcgatttctccatttcgtacagtgctttagaaaaagacacacagatgtgctctcctaagttttttgtttggttggtcctttttattttttgagacagagtctcgctctgtctccaggctggagtgcagtggcacaatctcggctcactgcagcctctgcctcccaggttcaagtgattctcctgcctcagcctcccaagtagctgggactaccagtgcacgccaccatgcctagctaagttttgtatttttagtagagacagggtttcaccacgttggccaggatggtcttgatctcctgacctcgtgatctgcctgcctcgaccttccaaagtgctagcattacaggtgggagccactgcgcctggccttttgttgtttttggttttggtgattggacaaagaactctggagagctggagggatgacagaaacattgcctgacagaattatgacccaaagcacaactcaagcatatcaagcgctctgagaaattttaaaatatcatattgaatagtgtttaaatgtgctgtcctacatttgattggaaaaggacacctgcataaagacctaagaatgatttagcggcagtgcacacaaagaggagtcagttatttttacttatcaagcttgcaacagcacagtgtgaggattttgcgttcctgagcctttagtgtcaaattttttgtgtgtaaatccaggctctgacattagctatgtgttcttggtcagtttcctaagtaagtgtttgtcaattaaatcttttcttcatagggtttttcttattttgttaaataggattgttaagtggattaaatgagataggtgtaaaaaaatgcatgttatattatctggcacataaaaaatgtggtttatttcaataacattagatgttattatgttgtcttaattgtttgtatctggaaactttgtttctggatacgccatttaacaagaaatagaggctcactggaacatgctaagaggaaggaagagatacctgtcctatgaggcgtgcttgacaggattcgagtctggagataaagaccatgtctaaatgtcattccaatcctgggattccatgattttagagtatttctccttaatcccttcacttctctgttctttaaaacaaaacaaaacaaaacaaaaataacacgcatttttcttcatagaattctgtgatgagttgtattggtttttgttttgttttattaccatacacacacgttcacgcacacatagagcaaaattatctaacaattccatttttgacataaagttaaattgttttaagtcaggcatgcaatattaattaataccaactggttcatacatacaaaacaattaggccaggtgtggtggctcaagcctataatcccagcactttgggaggctgaggtgggtgaataatgaggtcaagagatcaagaccattctggccaacatggtgagactccgtctctactaaaaatgcaacaattagctgggagttctcgtgcgtgcctgtagtcctagctactcgggaggctgaggcaggagaattgcttgaacctgggaggcggaggttgctgtgagccaagatcgcaccactgcactccagcctggtgacagagcgagactccatctcaaaaaacaaacaaacaaacaagcaaacccaaaaatacaacacagtttcttataaaatgtatgtgaaaacagaatctaattttgtctctctttttctttcttactttcttcttcattttttgaaaggagtgggaacagtagataatgacctactgattgacacaattgctagacttttatccccactaccagaggtggctacccgtgggctccaaatcctattctgaagcatcaggttgccaagcaagtttgcacactgcctttctttcttcctttttccccctcttgtttcccctcatacatttttgtgtcagagattgataagttttgacaaaaggctagtggcttacattaaaaagttagaaccccaaaagccttagcctatacaataactgttcatttaagctctagtgatacatttacaccctggtatgtcagaagaacttttttttctgtcgcccagggtggagtgcagtggtgtgatctcagctcactgcaacctctgcctcctgggttcaagcaattctcctgcctcagcctcctgagtagctgagattacaggcgtgcaccaccacgcccggctaatttttgtattcttagtagagacagggtttcatcatattggccaggctggtctcaaactcttgaccttgtgatccacccgcctcagcctcccaaagtgctgggattacaggcttgagccaccatgcccagcctagaggaattttttaaaaagctaacactttttagtaaatatttacttgtaattaattgtaattattggggaatagatttttaaaaattaaatacttagggctgatccaatcattacatttgtatatttaagtacatcccatttaaacttgtctattactatattaaagttattaaagcaagtgaaacaggagtggtgacttttctttgagggaattttaatactggtggaaaaggccagattgccaacttttaaaactgaaatatgttgtcagtgggaacaaagtttgaaagaaatgtaacacaattttattaccaatgtctctaaggcgataaaatctttctaaacttggtagaaaaatataagaatgcaacttcctagcagccacatggcagttaattttggcaatctgttttgggccattgtaacccacaaatatcaataataactgaaatggcttaaatcttgtctaccgaaaggcttacgaaaaaggaaaagaaaggagagagggagtgaatatgggaggaggtgaagatacaccttaatggtgattcaaggctgcagcatattctgtgtacaaataaataggcttcaacacctgctgatgtgctggcatctggcctgaaagcaaccaacatctgtttgtaattttcagtgggagcccatgacagtgaagaactgtatactgtcactgaatatatggccttgttaacatactaaaaggatccagaagtgagatcatgaatggataatttgggacatgtgactcccatgtgatacggtgataagatttgttgggttttctttaaaggttgccattagagttttatcctgaaccattatttaatagactttaaacgttggaaagtgctttctagaggaaagcttattttaaaagagaattttcccaaccagcttacatcttccacacttttaggggatatgtgttttattggggtagatatggacattgtacaacagctcaaatttatgtaacccccagtgcccttgggagagcccatggagaagaacccagagtgtgagcaggagtcacagtggggttggctttgagcctcaaggcaggtcagaggggtacttcaggagtcctcctcccctgtctctaaaaacgctggagttcttgtgcttcttgattatggctccaattgtgatattttaggcagtaactcaccgttttgtcacctttcctctgatacaagtgctgatcaagttggtaaactcccaggtcagaaaattggggaagactttcctacatttctgttgagggaaatgaggaactgaggccttagaatttctctttaccatttcctcataatcaggaaagttctagagatgattttgtaaaatagtacattcatatctatctcgatggatcatgaccatttttctagtttcacggattcagtgaatgaattctctgttgtaattatttttaggtgtaacactatatgtagatgattgataaaatgcctaactcctaagagtggtgagggctccaccataataactacacatgatacatcattacaatcaggctttcattcagaatttctaaatttaagaaatattacctattatttgataatcttatcacctgccatcattcatttttgcaaatttgaaattttgtatctaacttagattgctgaattagattagcctaatataataaattcttattacattatttttatttaatatttaaagtgaagactatggaaggaatttagtaatgcttttgctagttaaaaacagtatttagttaataaagataaaaacaaaaatattgttctgcacaggggtaaagaggtaggtatctgtgacttctcttttattggcagttaagtttttgcctaagtgctgagactagatttagagcttccttctacagagatttgcctacgtttacaaacatacacattcctttaaaaatatgtgctgcatttcctcaaaaatctaatttttattttttaagaagttcaaaatttaaagcacttctactgtgactgtagaacaaaatagtggtaataattatcaagaatccaacatgtagatttaaacaagctatcacagttttcatctaattagacttttaaattttttttgtttcgtgattaattttaaaatacgtattcagggaatcaagaaaattttcaacttaaaaaaagtggatttctctgtgaataacatacaaaaaaagcttagtataaaaataaaactcttgaatatctacataaaggccataaacaagatcaatatttgtaaagcaatttcctttgctcattaaaaatgcacaaatttaaacacattaatatttaatttcatttttaattataaagaatacaagtaaaaatcaagcatgttcatttttgatggcttttgaaaagtgaagagtttgaaaaaaagaaagtgaaaaaaagtgaagagtttgaaaagtcagtcattttgttttcattttttgactcaggattgcttgggagagataaggacatgtgtatagatacagagacctgggtatggtaagtagtgggagtagaaacccaggtcaaagttgttgcagcatagaagtcatcatccaactagtctccatagacaatcattttaattttctatgcctggttattaattattctaataaaattagttatttgttcctaatttctttaatactgactacttttcacagttttaaagtatcgctaagttatttttgcccattaaataatatttctaagttataatatattttccaagtaccagaaagtaaacccaacaacgtgaaattaaactgtgtaatcttaattgagtgagatggtagttttgcctggagccactagtaaatctgtacttctccaagtgttaattagtgagtctgtattcaattttgctcagagaacatttgaagcactcaatatttaatttcttattatacaatgtctgttgctagaatcttgtacctgcgtcttagacacatgcatgttgttcatcctcagctccagaaaaacacaaccttaactaacatacataagaatattatatgctgtttatttttcaaatgaggtagttaattgttttaagttagattgtgctattttgaaaagaagggattccgtaagaggttacagtacattcagagtacttaaaatttatttctactatattttcttgaataattactataagttggcattttctatgtgctgtcttttataaatatctcccaaacttcattttatctctgctttataaatgagaaaattaaagattcaaagaagtgaatctgttcaacatcatctaacctgtaagttctaagctccaggatatgaacttcaaaacttatactccttaccacatgttatgcacttataactgtgggtttgttactcgctgtagacagttagtaaatgtgaattaagtcagattttttttaaatccctgctccattaactcccctttcaattatttctattttcaatagtatgcttcctattattttccagatgaaaaagtcctttaaatattttttaacaatgtaaaacagatgggcaattccttgagacttgggtctccaaaattgtagctgacgtattttactttgtgtttatttatttgtctactaaatatgtttttgctgggaaaaaaggtctgtccatagtgatataaaatcactctccctagatgatttcattacatatttgatccaacagagaaatttcgggtcttgatacatttcacttgggaaggtacatagccaatatctgattccctctcaattttttttgttgttgttaaatattttctaaacaagtatttttttaattaagtctcaaacagctacttctcaaaattccattcctttctgagctctatagaggaaagatatgataggatctataaacctaaataagcaaacagccattagaaatcttaaagatggattgtattgatgataatatagacacctatacaccacgctccattgactaatgagaatgttataataggaagtgcctcagacctctttgtgtgccaaaatgccagcccactgagaagttaacgttatggtcaatagtgtttgcaaccctccagaaagctccgtaaattgaacagactgttaaccttcacttaagctttcacatcagtctaacgggtgctctgtttgctgctgactgcccgctagagactcactcattgaaagatatgtagttcatcattcatcatttcacaaatttggttccaggaaaagactaaaaattaccctaggcacaagctgtttaatttccaccccctcacatgaatctaacaaacaaccaaaaatacaaacgacattgagtagaaaataagatgtaagttttggtgcctcagtgtcatataatgtaaaggtatttatgtgaaaataacagcttgccttgaagtttcttagtgtacataatattgcagagaataacccctttcacttttaacccacgttctcttaaacctctttctgatcctatttcctgactcttacttgctgcttgtagaagctcatgattctacaattttagatccaaccaaggcagcaagctcaaaattcacccccaaacacactctttcccctcacctaaccaattatatttcctatgcttaaggcatgtattttcagtaagcagttaaaaagacagcatgacttttttattaaaccctaaataatcatatatagcttttctggtttattaatgtatagaataattctgcagtggtagaaatttaacaggggaattttatccataactatcaatttcatactttacctagataaccagaattatgtgacttgtttgttgaaagtaacatgcgttgtatgacttgtttgttttttattgaagtttgcatctcaaatgataatttaaagtttttgttagtgaaagtagggcagtgaccacacctttatataactattattaccttgattaattgctacattgtaaaagaaaatattttctacaattacagaatcctcagaacaactctgaaaacaaatgaggtattatccccaattaaaaaaaaaaaaaagattcaagagatttagtaagtacttcggcaagatctaaatatatggaagcaaattagaaacaaaccacatttttctgagctcaaagcccaaactattttctgcctatttcattatttcttctttcctggcccacactcctgtaagtgtatgtttcgtcttaatatatgatgtttgctttattaagtgcttgtaatgaagaatgcttgtcaattgagatcatatttaggaaatgttagaattgctgatttgttttgtgataaatattattaaaatgtaagctcaaggtaagctggatattttgtacgttttcatcaaagctttatccccattacctaggtcagtctgtgcctggaaaatagcagtgggtagttaataaatgctgaataaatgggatgtttagatacatttggccaagcgacactctcacctcaaatttgtgtgaaaaatcaccccaagaaataaaaggcaattagagacaattgaaaaattaattcagctgatagaaccacttgtcaaatattacataattcagaacaatatgactgaatcatgatgaaggctaaaattctgggtcttaagcaactttaaacctttcaaggaaaggctgattgacaaacacaccttctgtgtttaatcaatgccacaaaacatacggacccaagaattggtggaaatctagactcatcttcagaatggtaaattattcttgagttataaggcctccattgcctaagtgactaaaatgtatgtttccagaaagatttagcattttcctacaggttattatatgcaagaaatgcctttctccaacaggtgatagaaaggtcagaatcagccatctcctaagatactttattttattttgttatattgcaataatatgcaatgcttcagtgttataccaatgaaataaaatgataaattataatagcagtagctgagctttccaagattatacaaattaggtttagaattgaaattttatgaaaacaataatattttaactgcggatagaatattgaaagtgacctatgctgagagaaaaaggagaaaatttaggttacaaaaatatcagatgcattaatccaacataattttgtaaaatggttatcaaaggtcaacactcaatgtaatgtattataataaacaagaaaatgatggccatttttagcaaaaaaaaaaaggattatttgaataatccaattttattttacttagagacatttttcatataaaattagaatgaaatttatgttttaagctactttaatcatacatttttgttgttgaacaggatgctaaggtacagaggaaatcatgcttccaagttgattgccaaataatagtagcattgtctaaactcaactagaaattttgtcaatgcttttttttcttattgcccaaaatgatgcagtgagaattgataagataaggatattctgaccacgaggagtttacaatctagaaatgtggtcatatgcataaatagctgtaatacaataatgactatggcaacagtgaagaacaaaagagtgatctggcaataagaaaaaataagatttctgttccctctaaagaagccctttctagaactctagtgaaagttaatgggtaatcaatctaccatcacaagttaatgggtaatcaatctaccatcacagaaaaagtctagtctggagtgggtgacttcaagaaaaggtttccccatagcaaaatcaagtgtaactttccaaaggctttgagattatattttcacatctgtttttgtcgtttgcatgcatatagaatcacacatttatctctttctgttactgtgctatattacacaaaaacaactggttgggttttctcaagaggatattttggggtgacctgagttaaaatagaggttatatcatcatttaaattcactttgggcagccttagaagacaccccaaagacataggctatcatcctagagaatgctataactgctgataataagggacgtgccatagatattaagatgctaccgggagggaaaataaacagtgatttataacgcaagccctgatttgaaagtcacaaggtcagacacttggaattgcaggtgttgatttgtgatcaagaggtttttcacatggacaactctagaaagccttatgcagagtgagtaacagcacaaaggtactactagaatattggcaaaaattaacccaagcaatgcagagaccagatcactctgaatgtgtttctattttcatagatttcacctagtatatttaggttaaagaataaggcacaatgaaccttccctatctctaaaaaggaaaagaaattttttttgctttcattatcacttttctaaatactgagcagctcgttagtatcctcactctgatctataaatataaatataatattaatatatttatgatattaagtataaatattaaatatagccgtattaatatatctataatatttaatatataatactcattaatagataacgaggcaacactatggcattttgttccctatgttttaatatcttggagatggttatcttgtagtatgttgcagaaatgcgttatccccatgagagcctttggaatgtgatgacaaccatagtgtgggagccgacagagtcactgcttaggtgggaaatgtctaatagaaagaaaagaaaacttagaacatagctttgaggatcttgtattgaaggatggagaagacagcaatctgagaaagtgaccaaaaatatccaggagaaatactgggaggagtgtagggtcctggaagtgaaggaaagagaacgtctcatgaaagaaagggaagcgaggcacagtggatggaggcagctgttggaaacaccacttgaattacttgattgtagttcaatcagttttcaaaccccagtgagggaaaacctgagatgtctgtgggttgaggagggaatgaagttgagcatgagaatctgaagggagaaggaaggcaacgacggctcacagattcctcatcaccaaaggaggggaggtggatcagggaaggtttgggcttagctttttaacacaccattgcagctatttttaagacaaatgtaagaaactcagaacaagagatcgcttataaaataattgaaaaaatacatagtttaaatcagttcttataaaacattgaggtgacaagattaatataggtcttgttacatttttatttttccattgttaagtgtaatgcaatttatataaatatcagtttcctttagcattacttttgcatgaccttagctctatgctttattcatatatgctatttcatataaatgatataaccctttgaaattcaatttagaaaaataccctaaagatattgtgagccatatttatacacagttgtataacactctccttgtactagagctggttttacataacgatttgggattgagttccttttttatgaatgcatttttgaatgccacttctcttgtaggcaagtgtatgggtattgtatatttgtccctgatgtagattataaatctagatttataaggcatcattaggcctagcagcccaagttttcatatctatttcttcaagacaaaatatttcaacattactaataaatcatgaaaagtactaacataaggagactgaaataatttgttaaatgttatttttcaaagtaaaacaatttcactcctaggctttagagtcaggaaaacaaacaaacaaacaacaaacattgtttaaaattatgggttcttccatgttacactgatactaccatatgacaccccgagcttcagttttcttatctgtataatgtggacaatcatcattgcaccgaaagaattcagtcaatgctaatagagtgcctagcgcataggaaaactgtcagaagggtacctttagctgcaagtaatggaaaccccacttaagtctagcttaaacaactaggaaatttatttgctgacataatttggaacatgagctggggaaacagtcatgattgatttaaggagtccactttcctttccacagtggtgcattcctttatttgcttgttgtctttggggtaccccttttatgttggctagttacagaaatctacattcacatcctcgcactacatcattcatcagaagagagtgcattatttccataagctctcttgttgtagtaaggaagctttttcttccagaagccggccctgcccctacatttcccctgtgtctcagtggcctgaccgtgctcacttctgaagcaatcctaatggctaggagaaagccaagggcctattggccaatgttcttaaaccaattattgcaaaggttatgggattatccttagggtcacttttggggttgtaggctgggtcagattcttatgtatcactgtatgaagaagggaatgatactcaaaaatattagagttaaattttgaataatagtagggcactgatgaggcatcaaagtgacacctatatttaacctgtttggggccctattccttcacaccaaagaaggaaaccaaagcataagtcccatctgagccaattcagttcatgcgttgaatcacaatatgttggtggtcctaaaattattggcccaaagttgagtatcttggtgttttgttttgttttgttttgttttgttttgttttgttttttcggagtcccactctatcgccagactggagtgcagtggcacgatctcggctcactgcaacctctgactccctggttcaagccattttcctgcctcagtctcccgagtagctgggattacaggcacatgccaccacacctggctaatttttgtatttttagtagagaccaggtttcaccatgttgtccaggagggtttcgatctcctgacctcgtgatccacccacctccgcctcccaaagtgctgggattacaggtgtgagctaccgcacccggcctaaacctgagtatctttgctctctatcattcccattttcagcacccgagccttaaataaggtaatggaataaaatgaaaaacttgtgcaaatgctttacaacatagttaggtaagtttatctgaaaagataaactaatttcctatatatgactttgttacattattctcctatgagtgtcaagttattttaagaattcagagttacctattaaaaataaaattgacgagttatcaaaataggcctagaaatttagaacatggctaaaactcatctgtacgaaagaaggaaggaaggaaggaaagaaagaagaaagaaagaaaaagaaagaaggaaagaaagaaaggaaagaaagaaagggaaagaaggggagggaaggaaggaaggagggagggagggaaggaatgagagagagagagaaagaagagagaaaaacaaagaattggggtggtcgtgtgcacctatagtcccagctactcaggaggctgaagtaggaggattacttgtgcttgagaggtggaggttgcagtgaaccatgatgatgccactgaactccagcctgggtgacaaagtgaggccctgtctcaaaaaaacaacaacaacaaaacaaaacaaacaaaagaaaacaaagcaaaattacaagctgtaatttcacacctgtggtatattttattttgcttaaacaatatgctttaataaatatatattgaaatgacagaaaaataatattttaaaatgtatctgggtctacacattaagatttagtttgcagtattccaaacatcatttaatggaattaaataaaatttccaaatttataaactaaagaagtgctgctttcttatgaattcccactctaaattcattaatttaagatacatgtggcctttctttgtaactttaatatttaaggaaaattcagaatacttagcctcatccttaatcaaagtgtaataaattacaaaccccaccaaaatctctacctactgaaaacttctaaaggtaggagagagtatagagcctacagctgactccctacaatattctacatagcaaagtgaattaatattaggcttaacataaagcatctgttttctaccattgacatttacacacacatacacacacactcccccacacatatagagtttgttagggttcaccaaaggtaattaaccatcagatgtatattaatcacacacacataaacatgcacacatatgtattaactaacacacacacatttacaacaaaatagtagacagaaaaccattataagtgcagtttggtaactttaaggacctttgatgagaaatttcaaagttggtgacagttcatatgaggaagggtttttcctctgacaatcagatgagctaattaatcagcatttgacccggctggatcttagccagcctaactgttaatgagtgtgcactgttttgccagcaagagcacagtctcttcaaaaaataattgtcagggtcatttttgctatgaacaaaatcttattttgaaatgtgctagacttttttaaagcaacaataagaatgacacgatcattcttaaatatttcttattaaatattatggtaccaccaaacatgagcattgttttatttttttttttttaacaaactcattgctcttcatttatagttttacattttaaagtcatatgatgagaactatttcttccagtttgctttctgctgccaccagacttgataccacaaaaggtgtctgggtgcatgcctgtgatgatattgccaggccgttcctttcttggggcctgtgtatacatgggcctgcctttttattagcacctattataatatatggccattaattattagctgtacatattttctactagactgtcagctccttggaggtacaaaacttatttttctcatttgtacagcctctccgatatcttttatcaacttcatgtaatcctgatagctcagtgaggaactgaggagtggggtcccctaagaaggacataagtctaatttttaaagactaggtgtagggctgcagcttggctctcagctgtgtatgattccaaacaccgaagtatctccacgtcatcaccttttaatcacattttagtgtgatttataagcacatatttggaataccaccacaaacacacacatacaaatgtcattgttatttatatgcacgtatgatggtaatatatatgtctgcaagtttgtgtgtgtttgattaatatacatctggtgattaattttctttttcatttttttttgagacggaattttgccctaatcagccaggctagagtgcaatgtcatgatctcagctcactgcaacctccacctcccatgttcaagcgattctcctgcctcagcctcctgagtagcctccggattacaggtgcacgccaccatgcctggctaatttttatgtttagtagagatgggggtttcaccatgttggccaggctagtcttgaactcctgacctcaggtgatctgcccacctcagcctcctaaagtgctgggattacaggtgtgagccactgcgcccggcctgatgattaattttcaaacaaaccgtgtgtgtatgtgtgtgtgtgtgtgtgtgtgtgtgtaaatgtcaatggtattagaaaatagatgctttacattaagcctgctatggattcacgttgccatatagaatattgtagggagtcagctgtaggctctatactctctcccaccttcagaagttttcagtaggtagagattttggtgtggtttgtaatttattacactttgattaaggatgaggttaagtattctgaattttcttcaactttaaagtacaaagcccacatatatcttaaattaatgaatttagagtgggaattcataagagagcagcacttcttctttagtttataaatttggaaattgtaattaattccattacatgatctttggaatactgaaaactaaatcttcatgtgtagactgagatacaactttttaaaatatttttctgtcatttcaaaatatatttattaaattaaaatacagtctttaaacaaaacaaaatataccacaggtgtgaaattacagcttattatatgtatttttttttttttaaatttactctgtcaatcaggctgaggtgcagtggcattatcactgctcattgcagtctcgacctccccaagctcaggtgatcttcgtaccttagcctcctgagtagctgggactacgagtgtatgccaccacacctggctattttttaaaaatgttggtagaggtaggattttgccctgttgcccaggctggtttccaacttgtgggctcaagctatcggccggcctgtgcctcccaaaatgctggggttacaggtgtgagccactgtgcctggcccacatatgaaattttgaaccaacaatcttctgagctctttttatagaaattgatgtaagatcacaattatttagtgatctgatatattttagctgctgtctataatatttggaaaggatctgcaatattaaactgctttacatttcagttataaaaaaaaagttaaaatttcatgtcactataattattacaggtcacctcattcactgtctttccttttccttagcatccttagatagccacagaacatttccttaaacatttcttgttacttatttcacatactcacaagttcccccattccatttctagaaagcttttggaatgttttataaaacagtatgagcattattgctgtaagaatgctattgaaagtggagtgtaggtaggcttactatacaaagtggagtgtaggtaggcttactataaaaaacaaggtatactaaaacactcactgctataaaaaacaagcctcaaagacacatgcacatgtacgtttattgcagcactattcacaatagcaaagacttggaaccaacccaaatgcccatcagtaatagactggataaagaaaatgtggcacgtgtacaccatggaatactatgcagccataaaaaaggatgagttcatgtcctttgcagggacatggaagaagctgcaaactatcattctcagcaaactaacacaggaacagaaaactaaacactgcatgttctcactcataactgggagttgaacagtgagaacacatggacacagggaggggaacatcacacattggggcctgttggggtttgggggataggggagggatagtattaggagaaatacctaatgcagatgatggattgatgagtgcagcaaaccaccatggcacgtgtatacttatgtaacaaacctgcacgttctgcacatgtatcccagaatgtagagtataaaaaaaaaagcccccaaatatataatggaatgttgcaatgtaagtttatgtgttattcaagtgagattaaaaatgtgtgttcctggtttgcagaaggcaccctccacatgatagaggaagcagagttttcctttggttcctctgcatccacatagtataccaggaagagaaagaatagaatagagcacaaaagagattttcatgagcttttgtagaaaaagcctgagcccctttcactcacattactttggccagaactcagtcttctgactctgtctacggaggaatgaattttagctgtgtgccaggaggaaagaagaacaggttcatattagctttccggcttcgttgtcttctcacattttgttcccaccacattgacttttctgtttgttcgtttgttttgttttgtttccagaaggcactacagggtcatgccacaagttgtttcttctacaaggaatgcggaatgcttcccactttatgcaggttacccagctgacttctatttttcatttaaaactcaattcaaatatttagttatcaggaatgtctgctctaatatgatacatattattattcataacacacaatttcaacatcagtgagaatttttttgatgaatgtttatctcccgaagtagactgcaagtttttaatgacaatgatcatgcctgtccaccctccattattacacagctcctatcaaagtcaatagaatatgaaattatgtttttaattaatgaaagaaaactccaccctccaactcttaatgacagtacaggttgagcatacctaatccaaaaatctgaaattcaaaatgcttccaaatccaaaactatttgagtgccaccatgacatcacaagtggaaaattccacactggaccttgtgtgataggccgaagttaaaacacagatgcacaacacaccatttattcagcatccccaaagacaaagagattctctcagcctccctgagctgtgatatgtttctgtgcatgcccaggtttccccatgcaatcacgcccacaaatggtatcacacagcatggtaggcagagactgaaagcttgccattcttgattgttgctgttctttaacagctgatacaggtattctggtgatgctactgtgttagtcagttatcctggacacattgttttttcttatattaatggtatgttagatttttttactgttaagttctgacatgtgactaagcataagaaaatgcttgcttattggtagcatataaattcagagtcaggaatgatagtgagagaaaacaaccacagagaaaacagtccacaggtgtggctgagatagtgatgcctctgctttctgatggtgcaatgtatacaagctttgtttcatgcacaaattatttaaagtgttacataaaattaccttcaggctgtgtgtatatggtatatataaagcataaatgatttctatgtttatacttgaattcaatccccaagatatttaattatgtatatacaaatattccaaaatctgaaacactttttgtcccaagcatttcggatgagggatactcagcctgtactcccatacaatgaggccttaaccacagaagaaaacaataggttcttcaaagaaattggttgtgacatttaaagggtcaaaatgggtggtaaatgtggaataataattgagaaatgtaaaataattgagaaaatagccaagaatacctgagtatgaaaatagatgtgaaattttagcagtctatcaataaaatcttgatcaaacaccacttattcagctgccatatatgagtgtcaatgaggagactgtagagcagttagcatgatttttacattcagtttattaggtagaagaaaccctgcatccattgtcaacattcattctgaatgcaatgtcactatctattttattggcttctttttcccaatgcaatatttgtgatgaagtgttccccaagttatgcttttatcttctttgtgtccatctaattctttgtgggtgatgtccactactctgacagcatcacctatcataaaatgctctggatctataattccagtcctgcctgagtcctgtttctgcattttctttgctgatctttactcaaagatgctctgaattcctctgaaacttaacctgcctcaaattaaatttaggataagacttctccttttcaatatccttctcctccagtattctctgtgttaattcagagtatcaccatccatcagttatcaaagccaaaagagtcatttttcatttcctctgacccatttgccatgaccaagagaagaaagagcttcagctcctgagcctaggatgtctgtttttgccaattatgccaatccaaatccggctgtcatgaaacctggatggaaaaaacaaagccagtgccagctctgttcagtaggatggaaaatctctgtggcttggtagcctcccaggttcctacagagaaggttcattctgagatgaggatctctgtggcatatggtcttcaggaggagaatatctatgagaaaagagtctccctaaaccagaaaaatgagaaatgcaaagaagatctggacaaggcagtggtggaagtgtcccctttagatatttggttagtgctggcattactgcctgtggaccagatggtcccaaagttactacacactgcactgtatgcctgcctgctttcctgcctgctccagagtctactgagaagctgtattatttgtggatgtatgtgacacagtctctgcactgtagttataagccatgtgtcgctccaattcctaagaatccagtcattccagagattactcctcatacatgaaaatcctccagattcctactttctgataaagaaatattattgtgaacagatcagaaccaatgtaggaattcaacctcaagttcaaaaaaatcatcttctagatcaaaatgaggaaagactgcaatttaccattcaaggcaaaaatatccatatattgtaccagacacctattaacttcaataaggatggtcccaggttcaagagtgaggagaagagacccacagccagtgaatgaaacatggggtttatttgatggggacatacgggacagtccagtggtggcaggctggacagaaccgctacagcttgcaaactgcatgcagtttatgtagcattttcacttagcaccctctccttagcaacctccaggttaacaattcatttcttaagttgttattgctttcaggtatgtctgccatacagggtcgttctcggggtatgcttaagttattgctgtcaggtacatctctcataaaccatagtaatccagaccaagactgctcccttccacaggccaaaacctccaacttcatctttctctgtcccttgcaggggtatagttaccctgtttactatgtttattattattattattaatattattattattatttatccctgactggtgataccctgaaagtcttcccacctgagagcttggttattgcttccaaccccgggtgaacccctaagctagaccagtccgttagtgaccagattccagtgaagaagggggcagttggcttgcatatatggttcatgttgaaccagcccttcatgttcctggagctcccactaaggggatggagaagggatcaggaaagagggttgaatgaagaagagaaacacgtataaatgtaaaaacatgcatctgagaaaagaatcttagccccgttcttaaattcagaactctatttttgtgcttttaaacctgtcagtcctcagcgtcactccctccaccactgccatctcagccctgaagcttcctggtttcttcacagaacaaagatcagtacttggaatgtggcaagtactcattaaatgttttggattgtgcaaaacagtcacaatcaattggtacctctctattaatgctcccccacctctgtatctctgctcatgctatttctcatttgcaatgctcatccctccttatttctcctttgaagttttattaatctcaactgaaaaaaggttttcttcttgaccaaactccaatcaggcttccctgaactctttttcaactaggcctgacttttagacgcctgtgtttgtgtgcattgtctaattgcagtaagaatcttgcagagttggtttaattttagcaagactcttgcagagttagtttagccaggttctcccatgcttcatatctgatcaccatcaatatctaattgggttccccaccctccactatcctccaggtgatgtgaagggaatgatatctgatgaccctggcctgtcttcagcaagaatcctcataggttagtttaaacagaattcctccttacttctaatgtttcttctaagtaattttccatccactgactcacatcgtgctttttggctgtaattccccctcattcatgctgtatcaggaattgaacccagttctgttctgaggtcccttttaccctattgcaataatactgaatagaatctgtttctattgccttaactaccgtccagttctaatgttatttgatacaataatccatcttgtcatgttccatatgtagccttccaggcttttccagatgagcctggcttggtaatcattatctcttctaggatcttacagctctatttggtgtttgcacgtctattactttattctataactgattttcttactagtgtttacacacacacacacacacacacacttttcataaatgtgactccctataacccaatatacattttggtatatttggatcattgagtaaatacattaaactttttgttttcttttttgtctcaaaaacttacaaatcatctggcttttaggaggtgatttgtacacaaattacataaaaagtgaatttctttcatggtgttaactgttgagaaaatcttacgccaaccttttcaggagccatggtggttccgagatgctttaaaaataaattaccaatcctctgtaattttgcgtcctctcatctcacctactcataataaatgaagagaagatatgtcatgcctcacaggcaatcatatactgataaatatttaatgactggctctcaaaaaatattaaaaataccaatttgtagtgtttgctgatttttatgatataaatacacccaccatgacagatgcctaattaccaacatgacaacgctgaccctggagttaggaagaggtgtgtagtgacacatcatcatatctttaccatccatatatgatagctgtgaataaactcgaggacataagtcatagtaaaatccaatttttaatgatggatatgtttaaccactggcttgaaacttcctgatatttaattataagctctcaaccactgtgtgggttggctccagcacatcagaaaaatggattgcagcatattcagattatataatcactctcagtagcataacaaggatattacttggcataaaaatttcataaattgattatagacccgtgttatcaagaaacatactctatatattatttcatcactagtgttccttgaaactgaattttacaaggttctaacattgtcacatgcctcaaatcatcctccaaagatactaataatctagttattgagttatataaatgtataaggaaggtacgtgggaaaaatatataatagtatgaatacatggaattatgttgatcatgaccattattccttaagaggaatattatattttcagaaagatttgaagaacttaaagcttatacctccagtggcccactaattcacagtctaaaatgacagaacatgataaatttcaatatcttatacaatttctcatagcctctggcaggagcaattcttgaaacagtaggtggaaatatactcattaagctgcaaaattgcctatattcaggacacctgccaagcaagcattccctaaattaccacctgttaccataacatcaaagacatccaaaatacttgcttactaaatctagtctccctaagtatatataattttcctataatgctgcttgatggtagagcagtatcttaatttcatatacataaatcaaagttgtttctggacagctagggctcgaacctggttttcaacagctattcctgaggtatagttgatctttagtgttctatttgatgttgagttatagtcacactttttaacttgtccaggtgtaaatggtagttgctgaggcctttatataaagcaaatttactatcactgatacatgaaagaaaatcattttactgatattgtagcactgaaagttgtcaatggattatctaagatgattagaagctgtggataaattagtagtaggccaatatattttgcttgagatcatgtgtcaatatagcagcatgctccggagcagacatctataactaataatcatataaattctgctatatatgtctatagtcagtctatccacatagattttcagtcactgttacattcagtaaatagaatgtaacaatatcatgtggaaacttggttagataattctgcaagacatatcaaatggatgagtgataagaggaaaccaactgctttatgacaagctgaggtggagtgaattggtacaaggacacccagaagcacaatgtcaggtgatgaaaaggctgtgtaataatgagaggaaacagtaataggagaagaggaaataattagcaatcagaaacatcgtgattagaagagtgcataggttatgagctgatgaggctaagccctaaacaccaccactttttaataaatgtgcctacattattacccaaaaagagttctttcaaagaatttttggccacattcacccccccagcctccaagaaagagagagatagaagggagacagagagagagagagagagagagagagagagagagagagagagagaaattgttgaggggctaatgtgagccatggtggttttattcatcactataacagtagtttagagactacaggttcaggggccagacagcatggattcgaaagtgagcaatatcatttcttttgtgaccttaggcaagtgacttaaactctttatatctctgtttcctcatttgtgaaatgctgattgaaatgatatcatatttcataaggacattgtgagggttaaatggaataatgcaaagaaagcccttggcactgcctactgtgatgaaactgttccaaaaagtcagctattattttcatccccactgcctaatatgtagggtgtcagtaaccgtaaataaatgttgaggttgaatgaattcacattaccatccaagatactttcaaaaataaccaggaaaaaaggcatacatccctttagaggaagatgaagaaaaatgttattgcagcacgggagagcactgtattcttattaaggagtttatgttctggatagaacttcataggaggcatggcattgatcatcactggtcttttatcatcattatcattatagtttggtggccgttgttggcataaatcaaaatcatagaattgtagatttggatgagagtgtaaaggttatttagtgtgctttactataatacgatcatctgctataatatccgtgagcatgtcacctctggtcacgtatccacagagaataatctcattgttggctttagaaataaaataaatacctgagagtccataatggcaattttaaaaaaatgaatacattgagcataaccacaagcataaattatatggcttaattattttgacacgcacacacatacacaggcacatgtataagttttatatatagaagtatatataaatgtaatatttgccctttcttggtgctttacataatactcatgcactgtttcactaatcctttgtcttcccagaaccttagttatatttagcaatgttatttcacaatttacaaaagaaacacaacttattttgactccgacattatggacatttctggggatactgctttttggattgagttctaaagttggacataaataattagatcaacattgtggagaaaatatactataatttaaattttacgttgttatttttattaatgtgggtacaataaaataataaacatgacagcattaattaaactatgaaatagcatctcacaaaattgctaaaattataacaatcagcaaaatcctctctactccgaacctcttctcctagagtcacatgcatcttttggctcctgtttctcctctgaagaacactgcagccttacaaggtcataactgtttcacctcctttaaacttccaggcatacgcatgctcctctcttcagtcacactcacttggataaacctcagctcacaccaaatccagtccctgcctactctgtttaatcatggaggcaactaagtcaggctggagaaaaacatgcaactttgatgacttgtctcactgtgtttcacgaccattgaattaaatgggctgtttctgctgtctgggcaccatcccattcataaactccagatgtcaacacagcaattgtctcttcttttttctgtttctcgattttacctttctactctatcacttccatcgtcataataacatgctgttatttttcctttcaaataagaataaaaaaaaggaatctcgatctgacaggctagttgagttcctgcctatttctctgcacgtcttttggtagatctcctggagagttattttttatactcactgtctgtactgtttcctgctgcaattatgttttgaacacctcaagtttagcttttgtgctcactactctatcaaaatatgtcttgtcagtgttaccaatggttttcacatggctcagtccaacagtcaattcacattcctcatttatggacctatcagaaacatttaacacagttgtcctttttttctggaatacttttgcttggcctctggaaccccttccctatccacttctttactgtctcattggctggaacttcttttcctctaaaaattagagcgcctcagattttctttctcaaacttctctatgtaaatcactctttaggtgatctcactcagcatcatggctctaaatattatttatattctgaggaaaaaaatacatagatacctttactcagaactgtttcccaaactccacattttcaaatccagacttcattttctccacttcagtgatgtaaattctcaaatggagaatgcactaaatgcactaaaaatgaaaatccttccaattccccaaaagcctctttgttccagttccccatctcattaactgacaattccaaccttttagctttggtcaaaaatattggagtcagtcatttttttcccttcactccttactttccctgtcatataaaaaataactaatcaaaatatatgttgtctctgccttcaagatatgtctagaatctaattacttttgcactaccaccattgggcaagccattttctcttacctaaattattgcaataacttgctacctgttttctcttcttctgccttgaacccatgaataatctatgctcaatctactagctaaaataatcattcaatattagagacacattgtgtctcttctctactcaaagccctctaattgttttctgtcaaagccctccaattattttctgtctcactcataataaaagccacaggttatacaatgcctcctataagtctaacatggtctgggatcccgtatttcctctctgatctcattgtgttctactcttcttcttgctaggcatattctacctgtgcctagaactatccactttccttcctccttttatgtctatacctaaatatatccaccaatcaggccatttccctgatcatcttatagataaaaatctgaactccctttttccccgccgcccataattcttctcctccttatattatgctttaatgtattccagcgctcacaacacttggcttaccatcagctttttggttgcttgtgtgagccctctcacacaaagtttagatagctatagagacagagagccagaaagacgacagacagagatagatagatagatagatagatagatagatagatagatctctagttttatgtactactgcatcgtttgtgcttacaatgcctagaatataagacactaaattttttgaatgaaatacttaagaaattaattatgtactctatgcttttgatggcattctgtaaaactatgtgtaaaatgttgatttatagagatttatatttcccgttaatttccgttatgctttctgaaacatgtttctctggggagtgaaatgaccttaaacatacttaagggttagtctaacatttatctttgagagcattttctcttcggaagctggccacctagacacattaatttttcccacacaatactggttaaagaggtatttcagtggctagcgatcctcaaccattcgtaagcaacactccataatagtcagttttcaggagcaggaaaatgaaggctaatcctagggcacccatgatacctggctgtgctaagtagcaaaattacgggcattttcttttcattacaactcacgtactgcaaatatgttatctgcattttgacattaaattatattgccacataaaatatgtttaaataatcttatttttgttctcattagtacccaacttaaaaatacttacaaaatagttaataataaatactttaaaaagacgttttaaaataaataaaaataaacactttaaaatcgctcacaaagcactactttcatttccgatgcattttttctccattttttgcacacataatcatattctaaaaggtgaggtggaaagagttactggtcctaaaatatctgtttgtaatgttttgattatacttgtgctttgggtgtgtacacgtttacatatatgcatatatgtgtgtttgtatccaggcatgcgtatgtattctgtacctttttagtacttgtattgttgcatcgctgaatacacaatataatttttacttatcctttttatgacccatttgacctccatgagaaaacatgtggcatattcccttattcatctatgcatttccaaaacctagcttagtacttgacatataatagctggtcagtaaatttgctttattttatactgaaatatattgctctaagccagattttcacaaattgttatgagagatatagtaattctgcaatatgtgagtaataatattctagggtttcacatacagaataatctgaataatgaactccctcttgggatgctgtaatgttcattaacataattatactctctaagaaactaaaaattaccaacaaaaggcaatcgttttaacactgcttaagatataaacaactaattttcccatttccttttttaaatatatctcccctgatatcttaattttagaagcagattgcattatgataaatacttacagagtgactagaatattgtttggcatagatctaggttgataatgacattaatgaactttgcaaaccgagttcaattccagaaatgggtactgtacttttctgagaaattgctatctcatgtggcagataacttatatatatgaaaaagtatagtaagaaatttgaggaattttgacttaaatgtgtgaagaatttttataattgctgtgcctacagtgaaaatggctattttgtcacctaaacagtcagggagaacttggaaatgtgaaagtccttaaaattctactgcttactgtagtctcagtatgaaataatgtaattatgtttacttgtaagttatcctatggttgcagataggaagactcgatactataaatatgtcaattcttcctatatcaatccatatttatgttaatataaaagtaaaaaataagccaacagtgtgtttgaacaaaataagcttattttagagtttatatgataaaagaagtatgcaaaaaaatctgcgaaattatgttgaagaaaaacaacatgggagagctagctctataagatattaaaacatataaagtctcaataaatagaacagtatgatactggttcaaagaaacaaaacaggaatatgtgcaaatacataggaaaaattattatacataggaaatggtatgaatgcaaaaaaagtagaagaattaagttgactccatataccatttcttatacaggcaaaattccaagaaaataaaagatctaaatgaactaaagtggtagcaattagaagagtgaatataattttaaagaaagtaaaaaaaataaataaataaagattgaacccaaatggatgtacaaagcattcaaaacaagaatccacaaaaacttgtaggtaaagacaaatgttttattttgggaataatgcagaaaatggtatcaaaattgacttgagttaaataatcaatttgaagttgtggaaacctgaggatgtcatatgctcagtatgaaaactgggtttgatgttagggaaagatgtatgttaatttgcacggagacccttaagattatatgcggctatagagggaaatgtggctatgatcttaaggatgagtttttggcggcatccactgaaaagatgtaaaaagtaggagagtaacttgagtgcatagactaggcatgtcaagacctcaagggaagaggtagtttgaagaatttattaggtgatcaacagcatctaatgttgcaataggtgtttattcatacagagtaagataagagatagaaagacagcaaaggaaagaacatgcagggatattgcttctaagttttccactatgactttcaatgatcttcaatttccatttccacaaagaatgtttacttgatatttaaaaggaaattaattgtaggcatctcttatttcctttgtattttaatgagtcatcatttcaaaacttttgtcacatgtcagtgttaaatatgacataactacgttgcccttgatactagttaaaattaaattttttactgattggaaaatacacatagtgatttatttcagagggtaaaaaatattatactaaagtctattaagaatcagttgtgctaggagtctccttcaatgtgtttcaaatatttggtgtgttccaaattaagacagagtggagaacgaaaactttcaagtttgaaacaccaaagattgtataggatgggggagaccaaatactattaaaattcaccagggtcattctatcttggaggtctcttaggaatccatgttccatctcttccgttattcccagataacagcatgattttgccattgtcttcaatttccagatgcattagaagtgtggcaagatacaattagagtgtgtaacttaaatgctagtaagacctattcaagcaagcatagggctctgcacttacagaaatgtacaagtaaatctaatttactaaaatatatttagtacatgtaaatttaaaatattgcgatagctgggcgaggtggctcacgcctgtaatcccagcactttgggagaccaaggcgggcggatcatgaggtcaggagatcgagaccatcctggctaacagggtgaaaccccgtctctactaaaaatacaaaacattagccgggcgtggtggcgggcgcctgtagtcccagctactcgaaaggctgaggcaggagaatggtgtgaacccaggaggcggaacttgcagtgagccgagaccgcgccactgcactccagcctgggggacagagtgagactctgtctcaaaaaaaaaaaagatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaaccctaagccaaaagaacaaagctggaggaatcacactacctgacttcaaactatactacaaggctacagtaaccaaaacagcatggtactggtaccaaaacagagatatagatcaatggaacagaacacagccctcagaaataatgccacataactacaactatctgatctttgacaaacctgagaaaaacaagcaatggggaaaggattccctatttaataaatggtgctgggaaaactggctagccatatgtaggaagctgaaactggatccctcccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcccaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacagcagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggatgaagaaaatgtggcacatatacaccatggaatactatgcagccataaaaaatgatgagttcatgtcctttgtagggacatggatgaaattggaaatcatcattctcagtaaactatcgcagggacaaaaaaccaaacacctcatattctcactcataggtgggaattgaacaatgagatcacatggacacaggaaggggactatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaacaacaaaaaaaaaaagaaaaaaaaatactgcaatatcttcccgccttttacactgttttttaataattattttatatcctttctaaactgaaagttccatggacatagagactatgtcttgtttctttattgtattcatttcactgtatggctagaaactagggctggccattttgtgtattattgtacttgttccatatctcatattatcagatgattgatattattatcatcattgttttcattttaccaatgaggaaatggattcagagattaaacaccttgctctggatcaaacataactcttactctggaagccaaattcttagccacctcatggtgttgccctagtacctcaactgtattaatgcacttagtatagtcatgttatgcagaaaaaaggactctaagatggtggagggtctcagagccaagttatgtcactaatgaactacagatattcaatgtaaattcaggaagaaataagagaggtatgtaaactctcatgaatatttgaggtttgccatatcatggatgataataatcatgctgaagtattatttctgttagtattattattttaattattagcatttgaatccacaaaaagaagatagaatgaagtgtggtagatgtaacacattttaattcaatagtgagcatagttgaataactggcatagtgatacgactgatatgattcatctttactgctggtgactaggcagatagtagatgattatctgtctcgaatgctgttgaaaagtctaaaagtgctgagctaacttcttccaagtgttatgaatctatggaatttagtatagtgctcaacatttatcatgttgagaataagatttccattgacttgagaaaagtaaaacataatctataaggcaggaatatcagctgttgttattccctaaggtcaacttaaatgtaaacctctgatttacatagaacattaatatgtatgtatacatttttagaagcagatttgattgcagtcataaatttgctaaagtcctaaatgcattgttggcatccaaccatttactgttttggcataattattaatatacttactattattctgcctatgaatgtgaatgagtgtgatatcagaataattagaatgagtcatattataaatcctctgtccaactttgaattatattgtatgtatgcttgagcattatagatgtaaaaagtgacatgagttctacatggaatataatacaagtattacatcaagacattttcatgtagattattttagtagtcgtagaattttactacattgaaggaattgatattatgacatttttgataggcaaaccaagagtgaccctttcaaattgtacaatgtcaacttctatgaagaaagataattgaatattgttatttgttatttagaagattgaaaaatttcagtcatattgtcatagtctgttgattgattaagcctagccataagtctataacattcatttttatgttttgtctcttttgtatggttatgtggaatcgatgctattactttgacctccaatatttaattcaacaagcagaaatataaccttttcacttgacaaaacccacttattttgcttgagaaattataaaacaaaaccagcaggtgcctgagattcagtacttgaaattatcatttaaagcaaagtgtcttgtatggtttcaacattgttcactccattttctggcagctgacactcatttactctcaacaagtgaataagcagtcggtgagtgtccctgatgtcaaggagctgtcataatttccatggagttagctctgtttggcattacagaaattcactgtgatcctgctgacaactcttttgtatagtcataaagtatacagcagaacagtttgtcccagggctaaggtcaggctttttattttgctattatgagaaatcaataaatacacaatactatttatcttatttattctaaggaaggaggagaccaaggcatattttcctccttctaattcaaaatatttctaacattattattagattagtactgatgggtcagtcagtactacaggaaaacaaaatatgtagaaacagtgatagtctgtcaaagtttcgagctaatttcaaacagattgggtaacgtttgaatcttctatggaagcattccccaatgtttaatcttcaagatatctctgaatttatcttcatcagatgttggatatgtcccatgtgtccaatgatcacacttctgcttgacttccagccccagcccttgctcctctacctggagttgcttccacttcacacacgaatgggcatttaggctgccataacccaaactcaacgagcctaaaactagatgggccatcttttgtttttctttttaaaatttatgtttttattattattttttgagacagggtctttttctgtcacccagactggagtacagtggtgcaatcatggctcactgcattctcaatctcctgggctcaagcatttctcccacctaagcctgccaagtagctgggattacaggtgcatgcatcatatctcgctaattttttaaaatttttatagagttgggggtctcactatgttacctaggctggtctcgaatgcctgggctcaagcgatcctcctgcctctgccgcccaaagtgctgtgattacaaacatgagccaccgggcctggccttcaccatctttcttcttaaatcacttattaacttgggatttgtcacaattttatcatccaaacctaaaattttccctcatgtgcttccaaaatcttctgaatttacatattctcttaatattctccttcaagtttaccatgcctcagtccctttacttgctttaatggtatttattcctttcttcattttgtaaaaaggacacattcatttaaaggaagcagaaaatgcagaaagattaaaaggacataaaaaccccttgcaatgttatctatatttaagcattattaatatttggagctaaacttcatgttctccatcttttaatgttaaactaaacaaatactttataaagtatttcttgatcatggcagcaggatgcattctctttttcttgctgcctgtcaatatcacttgagtggcatatacagtcctattgaagatattcgtgcaaatatattgttcctttttccaggtttaaaactctttaaggccaaggcacatgcttatacatttctttgtttaagacagatctggtacagtgtataatgttaattcaatatttgttgaatgaatatgcttaataattcagatctatttgaattatcaccgtgaataaacaagtttaattctcttctatagaatgaaaatatgtgtgagtaagctggttaggaggaagtgaaattttttattcagttaataatgacaatacagattacatgcttcagtgaagcaaattcctttgtataaagtacaatacattgttgggttcacaattgcagagtcataagaaaatgtatttctcctcatatttctctcttacagaatgtaccattcaaaataattgatgtaagtataaagaattgtctttttgtgctactaaaatttccactacttattttcatttgtcttcccagcacttcttctgatcaattgtatatttttaaggcttttggtattcattgttgatattccatttcattttatatgttctatctctaacaatttcatcttttttgggggatgatctcccttttttctgtgtataattttaaatttcaaatttcactgtctcagcaacatgtagtgtacatacctcttactttctcctaaactagtcagattgcatcctattttttgcagaaataattcaaagtttttcctctttataaataaaattatttccaagttagggaaataaagacagaaatccagccatactaaataagtagtactatagaactgctttcccaagaccatgcatacttggagacactcaaggattatggcatttgtcagtccattttattactaggtctcaaaaatctcatttactatttcctacttcaaatgacccaagtttcttcacattgatcatctaagttttgcattctttggttagagtttcatcaaaaagcacctagtgttgcactcacatgcatcttattctgatgatcaggtggtattgttttgtcttcttctgtagtgagcattatcggtatttgcacccaccccatagctgcagtagtatttattcacatttctaattttaggattgtggaatttttttccatcacaaacaaataggattttatatttttcttccacatagtccaagggtcattctgaaaacaggatttctcatgtgtcaccccaatactgcactgttatagtattctgctgtgaatactgtgactactaattcactatatctacatttgaaaattgaaacatcagtctgtttgctgttcattttgtgacaaacttaaaacacttgagctttttgaaggtcttggtacatgaatttttatcatatacctaaaaacactcagatactactgctgagagattttgggccatggtagaggtgtttgtccaaaaatagaaaaaagtaattggttaagaaatatatacaagtaaacagaattatttctaggtaagttttattctactcaataatacaaaatgcactttgcatggcattgttgtgagatgtccattataggccttcctacatttgattagaaaaagttatcataattctagatagtataggaatcagctggagatttcttaggtctaactccagaccagtggttcacaaagcatgcttataagaccagaaacatcatcacctgagtacatggtagataagtaaataatggtctgcaccccagacacagcgaatcagaaactctgagggcagagctctgcaagctgtgattgaacaagtctcccaggtgagttccatgaacactaaaggctgaaactcggcgagaaccattgtttttaaccaattaaaatacaatcttcaggtgagtcatatacactgccaaaattgagaaagcttgagaatcaccgaataataataatcatcattttcaggtggtacttggtaaatttacaaacatgtaaacctgtgggatttgcctagccagtcacacatttattaggattattctcgtgtagtcgtctcctaggagagagcagagccctgggtgataggaaaggcttgaaacatgagcagcacccaaacagagtagttttggaagacttgacatggcaggaaaaaggtgcacatttgacaggtaaggagaacctgcatgttcggaacctaaatattactggctttgttgactttgtgtttgtgtgtgcaaatttggagtgcaatgggataatgctaaaaatgtggcaagaatgaaaatactagagcataatgtaggtagataatattaaggtcagaataaaggaaaaatatagggaattcagcattagtgaaagtagttaatttaatattctactatcatctcaaaatatgacaatattttaaatcccatttttgagacatgattgcactttcttcttaatagctcctcctctaataatcttgatttatatctatgcaaatctagacttctaatggttccggttgttttaaacatgtaatctggtctctgaactcaagtagttattctagatttagaaacagtgctagtcatctgttagcactttaacacgtaaacctatcctgaattggaatatgttttgaaaatgttccatccccagagtaattttgttcttgccttgagcccctggtgccccaatgctgtttatacattaatttagtctcttatatgcttaagaagaaagtatatgaatgcaaatgagaaagtcccaacctctgggatttgaatctgaaatttaaaacaagctaaaagagcatcagaaatggaagcaggattaccaataacatttatgatttaatgatttcaggaagcattaaaatgatagttgtgtatttataagcaaagccgtttatgtattttgcttttacttatttcatttttgagataaggcctcgctctgtcgccaaggctggggtgcagtggtgcaatcacagctcactcagcctctgcttcccttgctcagcttcctgagtagctagggctacaggcgaaccccattaggcccagctaatttttgctttatttttttgtcgatacagagtctcactatgttgcccagtctattctcaagcccctgggctcaaggaatcttcccccttcagcttcccaaagtgctgggattataggcgcgagccaccgcacctggtctattttgcttttaaagttaataaactactagtgttttagttggaaaaaaaattctctcatgttatttgtagaaatgctgtagaagaaaaaaatacataatattatataaaatttgctgccttttcacatgtgaaagtatttgaggtctaaaatcaggtatatctgagggcaaaaaggcaaagattcatggtcattgaaacaggaatcttaagagactgtatctacaaagaacatttcttgtatatgttgtagacactttagcagtaaaattttctattttgttctctgtctcttcagtgagaggtacccttattaaaactctgcaagggaatatataatttaaattacatattttggtataactttaggcaagctttatagtagtaatgcttttcacatgtattgtgccttcagactatcttgatattcaagtagatcagcttagcctggaaatccagtggaaatatggattgtccacaggccaaacagaaagtcttcttttgcaaaatcacatgcagacttttcaatattgaaaggatttgttcaaacttccagttctctgatgatatatacataacatataaaaggttatccttgtccatcgatgagtcaaggggataaatgtgtaactaacactatctacaataaaaatatttttgttacatcagattacagccccaagctttatttaaattgacaacaataggactcatgtaatagtgtcgtgaggattaaattagatttagaatctaaaaagtaaaaagagcctagaataatccctagtagatacgacaaacatttaataaaaatagttattactgttaacagatatgtgatttatattagtaatgtaaaatagcatactctctcatactcacatggaccttttttcttgttccatgcaatatgttaacagcaaaactagtttacaggtgagaatgacaagaagatgtgaaagattatttcagctttccctttctttaaaaagctagcatttcaagacataatttttttaaaaatgaaaattctaaattgttacttactttaaaagtatttaaaagagattctgccaatggtttaatataagaacaaaaaggagtatttttcaggaaatcaagccagagattatgagtatccattcttgttggcagaccttatttgcttattttaaaggcagtgagcaaaagatgtagaactccaagagacagacgttgattagaagtttttctttaagatgtcatttttattttctgaaaaagcatttatttttaaaacttggcacggattattaagacgggtacagcttaaatttcccattaaaaaatcatatgtcattcccaaacctgttcatatacacagagaaaaatacttaggtatgtactcattactttggcctttccttaatctgaaaaatttttttataaaactgagtatttttgtgatgttgctccatcagctcatttaaaaactactatatgatcttgttcaatgttgtttaatcttaggaccactttgtttcacttatagctctaacatctgtcttttttttttttttttgccacaaactcttttgtttctgtgtttagtagctatccatgctttttgtcctcccactcactaccaattgctctcaatatgatgacaatttaagagaattgtagcaagctaattgtcttccttatattttccctatctatagatttgtttactcaaggagctctatgagaagtgtcaggcatttgcagagacaaattgtcttggttgcatccaccactgttaaaacctccaatgtcacagggagacttgtctgtaatttctagagtcactactggaagtctttttatgaacacaggtcatcattgtggccacacaaaggctctggcactaaagaactctgatagacaatctataagaatgaagcttacattttggctaacagtcctttaatttcttatctccaaattttaagaaaattaagtcttcatgatttattcatcatacataacattttgttcatttgactttcatggtgatttttgattatagtaaaatccaacattcctatagaaatataattcaattaacatgtgttctaaaatattctaccatctacattattgagtaaacaaagataaatacattttatttaatccagtgtgtcgaaagagtaaaaaaagataaaattaatttattttatttaatccaaaaatatgatttttacatctgttcaatatgagaactataggtaggatgttggacatattttttaaattaacgattccagtgtgaagtgtattttatacttgcaacacagcttagtttgaactagctacatttcaaatgcttgatagtaacagtgacctatgactaccatattggacaccgtgggaatcaattccaaaataaaaagtataaattacatgatctttaagtgttctttcagcttttctttcacagttttctgttgagtgatttctatacctctaaactacgtgttccaagaaacaagtagaaagtgaatatatccttgaaatatttagcagtaaataaaaataagtaatttattatttcttatcattgactgttttgggaaggaattcactaagtagaccctttatcatattatcatcaaggaatactacttatttcttggttactactatctctttgatacatttaaatacattattaagcttttattatgacccgtgagtcctatttaatttttaagcaatgcatttgtagaattcctctggttttactagagttaaccttttattttctgctaatgacttaaaactcctcttagaaatgtatttaaatgctcacgtgtacaaaagggaaattgactaataactgattaagttatgcacaatattttatgtgtaagctttatttttataaatcgtgtttatggtcttcctaaataagcagttaaggaaatacatataaatgttagtaaactatcaattatactgatactatacatgaattagacaaagttaaaaaatttagaaaatttttcaacctggcatataacatgtgtccaccttgaatataacaaatccagagacacaagaaaaagccaaatacagagaatatgattctttggttatgagcatgaagcggtgctgcagtgtttggggaaaagggccacaatcatgtctgctggggattcaccctgtaattatatcaccatccagctgaatgcaaacctgcagggaaaatggttaaggtagtcttgtcaaatgttgtgcttgcaatctgtttctctgcatgctgacaagaaggcaataaagtcaaagacaactacacaactaatgtatactggagaagaaaactaggctcagttgcaatgtactgtaacaattttgaagttatatagtaccactaacttgagtgacctagaaaaattgaagttcaagatggtagcattatataaaccagtgaatcgtgtcattaccgtatggatacaaaagtggattatttattttaaatattctattcagttatctgcgtatatctatcctgcatatatccatatttcacagactgcaagaatacatataataaaagaaggcaaaaaaaagcttttgaaaaaagaaaatatactgggaaatgtaattttaattctgtaaattgtaaaatactaatcttggtgatttgggggaaggagagctgatggaaatgaccaacaaaagttgaccctttgctaaataatgaaattgtatcctctgcctagcttacttgatctcttttagtcagcacagctgtgtgctattaatattttctcttataaggaccctgagcctgaaaaaaattaagttgcacagtacacaatcattaaactaaaaagctagatctatctaactgcaaagctcacattgtttacaagttacttgaaagtctagaaaattcagttctgagtcttgccagttatgtccccaaacaggaatttgacccattggactcccttgtgaatcactagattaaccaatgtgcttattagagcccttcagaagggccaagacatttcttcctgtgaaataaatatggaaacaagatattaaatatcttctgtgtttcagaggaaaagtcatgctcagatattaaatacatacaaaaatgtagcaatgaaataattggttgcaggtgctgttggtgactcacccatatctcatcaacacacatcactcttgtgcattccaactggaagcacctgagactctttctgaaggcttttctggccaaggtgtctggctcaactgaagggcaaatggaaatgcatgcattcatatcacctgggagcagccctgaatcaatgactggcagctttgtggatcaatatcctagttcctttgttccttggtggggagaaacctgagacacagtatacattgcttctcaaagttgagcagtggtgttgggttccaaagatcttcatgtgctacggtggtagtctgctcaacatctcaacatcgtactgattccttgtccccttgggatcataccagtgcttcccttggaacatctctccccacataatattaatactcacgtatttgctcaagttcttctgggagaatttaatgtaatctgtaattccagtgctggaagttagaattttagtatgacaatggtaatcctttaaactttcacaaaacaccactgctccatttgtttttttcctattgcagtaaaatatagaaagagaatctagaaggaagagcacaaagtctataaaaataagaggggatgagagagaaacaggaaagagaaatgaaacgggagttgagaaaaggagggaatcacaactcgggagcagaaatgagtaaaatgtgagcaaagcaaaggatcacggtgaggggaacattttccagaggattcttttgaaacgacttgctggaaatttggaaaatgagcaacagtaatgtcaaatactatagctctttgaaagagagagatgaatgaataaataaaaaatatttatttgttcaggcggaagaatctggacaaataagtgaaatttgcagtgaggatgatgattgttcaatatgaggatggcctttctaaccgaaaccatcttctagggtaaagctacctcttcgtcacttaaccccagcttcaatgaagttgttcagatggttggtgtttctgagatttggtttattactcattatccaataaacctgtgaatttatagtcaaaaaaaagctgatggtgggcagacattgcttaatgatcagctagtatctgcatacctgcttaataccctgtaacatgattttgtctgaaaacacctagtttcccagactagcgtctcttctaatgtcaactttcccactgcactgccaacgcaggcccattcattcaaaatttaagagacatttgtagcattccttttctgtatcgggtttgctcaatctcactgagaggagtcgagatctctacacaattatctcttataatgaaacatgcattgatgagattagatacagtttattccatagaaaaaaaacctaaagttgctgtaaaatgtgtttagttattgtgaatcctttctagttggttataattacgtgattggatgtaatagaaaaagtgtgtattccaggaaacctggtttttttgtttgtttgtttgttttgagacggagtctcgctctgtcgcccaggctggagtgcagtggcgcgatctccgctcgctgcaagttctgcctcccgggttcacgccattctcctgcctcagcctcccgagtagctgggatggaaacctgtatttttgtcttatcttgaactatacctaacaggttaaccttggaaagtcatctagctctggaggaccaaagtttctttgtctataacatgagcttgaacaaaatctccaaattccactacctttggttcatgaatagactacaaagatgtgattcaaatgtgttggaactgaatgcaaaaatttgtgagcctgtgcatttttctgcgagagggaacatagttttaatcaaattctcagactgttatttgaaacattttaagaaatgctgaattgtactaccttgaagatcttactttttctgaaatactttgattcataattctatgactcattacctctttggcaatttcgaatagccatttctaggaaataaacttcttccttaaataaatatcaaagttacactgatcttaaaataatggtttatctagccatgaagtatttcacatctaaaagaaccgtttacgtttttggccaattaaaattgatacatcaaatgttagaaaaaactgaaactgtgggctgaattacacaataaaatttcaagaaatgtagaattttgaaacagtaatagtgactaaagtgaaacaaaatatttttttaaaatatctcataaaagtcaagtctgaaacgtaaaatttctcaggtcctgcataatgtaaaacggcttaataaaagcagcaaatataaaatgactatgataaaatactcaaaaaatggatgttgtcttttgtgagtgtactgcctcaattcatatgtatatgcctgatttaaaataatatatatttggattttattggtgtgatggttttatttggtttgcttttcttgtataatccttagggttaattttttaaaaaaagtaaagaaaaataaagaaaattggagtaataaaaaccctttaggaagtagtttgttagatattcatcattccttgaatcttcaaattcactgctcagcgtggggtagacatcctgcctcactgaacgttcaattactttatgggctacagctcagaaggcgaatcacctttttcataagctgcttgttgagagaagcttgaaaaggatgatattgtgtggaggttcaatacctttgaatctcatagtaaaattacaaaattattgttgatttacataagcatgttatttatctcaaactactcaccagttaagttgagactcattaattgtacattttagggtattatttcatgagattaatgaaattagcgattacaatacgttttatttttaggatgctttcaaattatttacaacctatctgtattacactacaatcatgtctaagagaggaatattgccataattttggggaagactgttcctatgatgatgaatgagtgtatttttcaaaatccaaaggacaattgactgatttctaaaattcaatcctagggtaacaaagaaactctgcacttataagcattgcatatttgttttaaattataagagcagaatgttagttcatttaatgagtatatatatttgactttaatcttgttttgttgaaaataatgcataaacgttaatggaaaataactgaaaccaaagaagggaaaggtagttgtgtcaaacaccatataaaaagataaatatggctgggcatggtggctcacgcctgtaatcccagcactttgggaggccgagacaggcggataacctgaggtcaggagttcaagaccagcctggccaacatggtgaaaccctgtccctactaaagatacaaaaattagccgggcgtggtggtgggggcctataatcccagctactcgggaggctgaggtaggagaatcgcttgaacccaggagggaggcagaggttgcagtgagccaagattgtgacattgcactccagcctggaggacaagagtgagacttcatctcaaaaaaaaaaaaaagtgaaatttctaaaataataaaaaagtcactttaaaaaatcttaaaatatgaaaatgacatgaaatttatagaagtgttgttcatttttatatgtaagcagagaatagtgtgtaatatttaaattctttccctaattttttaatattctttacaacatttgttaaatataaggtatattaaacccaaatggtgaattaaactcaaactcaagacactacatgaagaaaaatattccatcttcattatcactatccattttctgtaacattcagagtagttgaaaacttactttactaaagagaggtgggagagggttaaaatttgttattaatattaactgcctatatgagttttgtgttcctttaactttgttgaatttaattattcaagtaaaagtagtctattcaatcattaattgtatgcaattctattatgttataaactagagtatttgaattcctaattcttccctctgaaaatagtaatataagaattttatatgacataatttgataaggatctgtgactataataaattataaatccaggtgtctattcagttttagacttctgacctcaagcgtgtgaaacaagtgggtatgtaaggagagatcacatcattcacggcatttgcattttatatgtcctcaaaagttttcttctaaaactgactgttttgctaattttgtagtaattttattctagatttgttcagttttgataggttttctccattcactgccaacatccatttgagtattcgaatactatgtagatgtatttttagtaaaatatgtttcatttttataattggatccacacagtgctggagaattctacgtgttaaagatgtataaaaataaaacttatttaaaaattaaatgtaaacttacgttctcacaacagagtaactagtatttcaaaaatgttcatatagccttgcaaatagttgaaaatatatatttagaatttagacatttttattcatcttaacagttctgttcactgggatgcttttccacaatactcttaagtcattgttgtaactgaaaatgatcaagagtaatcatttagcgaagactttgagttgtctccataaaagaacttaagcagggagaatgatactccctgcatttttcctgcagatgacattgcatataaatgacacctgccgaatcatgccaagacatacaatctcatcgtgaccatggaagctcatggctaacggtgctgcctgctagttgatccaaaaagttgggttcctgccagagatgtagagcaatgcagtacattgataattactagctagctctttcacctctcttcccataaatgttaatgatagccttgaaatcccaaagcatttctttaacatttctattctttttgtgcaaaattgtgactgagggaggttaatcagtattgccaaggagactaatggtggaagtttctgctatgactcttatctccagttcataaaatacagagaatgttttttagatatataacacctttagccttttttaagtccttaaagttggatcccttatatcccacatgtattatgcaacatttagctgtgaatatgcaggagatattagacttgacataacagaaaacaatgtttgatgatccagtgagagtacatatgagagaattttgaaaatggtaggactgttcattattattaatgttgttgctatgtgtgctcaccccctccaagtcctttctgcttttttactttctttcttgtaattaaattgaataattttaaaaatattttgaaaccaagtaattctaaatatcatgtggcaagagaagaggaaataaagtgaccttttaacaattgggaattataaaatttgtaatatttatcttctccattaattatatcatcttatggttttctttcttatagagctttcctcatttagctacattgaaccgggacatatccatatatcgatctcaactttagccgaattttcttagcaaatgccgagctagagcgaaatttaagaaggcatagtgataaggaaccgtatccctacccccattttgttatatgctaacataaggtcttgctgcctcatttttaaataaacatttttattttagaatacatttagatttacagaaaagttggggagagaatatagagttcacattcccgttatcaccgacaaccagtttcccctattaactttttaccttaatgtgctaacatttgtcataattagtgagccaatatgcatatattaagcctaatgttcattgagattttcttaggttttacctttagtccttggctttcttttttggttccagaatccaatctagctcaccatattacatttggtcattatgcctccttaggattctcttggctatgactgtttctcagactttacttacttataatgactttgacagttttgaggagtactagtcaggtattttgcagaatgttcatcaactgggattgacctaatgtttttctcatgattagactggcattataggttttagagaagaagatcacagatgtgtcattctcaccacattctatctaggatacacactagcaacacgacttgtcactgttgatgttgatcttgattacctggctaaagtaggatttgttagttttctctactgcagtgcagactctttccatactgtagtattgggaaggaagtccctatgtgcagttcacatgtaaggctattatgtctgcctctttgagggcacagtgttgacataaattattctacatgggccatgtataaaattttattattcctccccatttattcaatcatttacattattatggacacatgaaatttgattttatcataatttggattatattctaatagtaccttgtttctctttttaatcaaataatttcagctctggccactggaaactctttcagttgccctgtgtcctttgacacacctgcatcactacagagtttttgaaaagcatttctttattttctggcattacaacttgcatcactgttatgtatgtgtatatatatatatacacacacgtatatatatatacacacacgtatatatatacacatatatacatatatatacacacatatacacgtgtgtgtgtatatatatatgtgtgtgtatatctatctatctatctatctatctatctatctatctatatatatatatgttttagcttgtatattttttgctccagtcttagaatcaaccttctaaggaatcctggtttttgttgttgttgggtaatggtacttaccagaaaccagtatctggatgctatgtatgctcattgatagtggaatataattgtgcaaggggatatatgtgtttctactaagccatgtatatatgcatatctataaatttctatatctgtgtcttcatatctgtttgtatgtatattcatctgtatgtatatttaacttaatgtgtgttcatattgatgtatccaactataatcaactataatcaattaccatgtcaatcattctaaccttctccccttgctatttgtaacttcccaccccaatagtaataaacgtggatcccaggctgggcgcagtggctcatgcctgtaatcctagcactttgggaggccgaggcaggcggatcacctgaggtcaggagttcgagaccagcctgaccaatatggtgaaaccctgtctctactaaaattacaaaaattagccgggcatggtggcctgtacctgtagtcccagctactcaggaggctgagacaggagaattgcttgaactcggccagcggaggttgcagtgagctgagatcatgccattgcactctagcctggacaacagagcgagactccatctcaaaaaaaaaaaagaaaaaagaaaaaagaaaaaaaaaaacctgtatcctaccattgccatcaatttaattacttgttaaattcttgttatcatgtatgggagtttcagaattgttagtggtagccccctggagaataactttgtcaaacagagaacaggatttatgtgcaatgactctagtcttgcaaactctatttccaaagttgcctaggttagcatcacccctctcccctgccaccacataagtgaggttttgttacattttcatatggttagattatttttttcacattctgccttctgacatgtgatcctgacttcctgcatacgttttaaagcgtttttcatatattaaggttttctcttctgtatagttctatgggttttgacaattgcataatatatattcaccattatggtatcatatagaatagttccaatgccctaaaaaaatgccctgtgctttgcccactcaactctctctacagaaaaccctgcaactaataggtgtaccctctctgtagttttgtctgttccagaatgtcatataaatataatgataaaatacttaactttcacagataggcttctttcacttagtaatatgtatttaacattcattcttgtctttgcatggcttttagcttatatttttaagttcattatatagttgtatcacagtttatccattcacctactgacattttggttgtttccagtttttgcaaattacaaatgaagctgttattaatgttcatgggctgtgtgtgtgtacataagttttcaattcagttgagtaaatacctagcattttaattgtgggtcttatagtgagaccatatttaactttttaagaaactgctaaattgtcttgcaaggtggttgtgggaatgcaaaacggcacagctactttataagacaaattgaatgtaagttcttgttactttgtgttctcactgagaataatattcttagttttgtggatgttcgccattctagtagttccgtagtgccaccacatagttgttttaatgtgctctaacttaatggcaaatatgttgtgtattgttaatatatgtttacttgtcatctctatatcatttttgataccgtgtctttttgattatttaataaatagcccaatttagtaattgggctattttcttaaggctgggtttcaagagttctttatttaatttggatatatgtaccttatagaatatgtcttgcaaatattttctcccaggccatgctttgtctgttaattcttttaagtgtcttttgaagagcaaatattttaaactttaataacgtccaagatcaattttttatggataaaggcttgtgtgtacctaaaaacttttctctaaatccaagagaaaatccattttattctaagtatagttttttaaattttacatttagaactatgatccattttgagttaattcttgcacaagacatatagttggtgtctgttatttttattttaatatgtgaatgctcagcattattactttttttatcaacatttcaacaaagcagaaagattatcctctcttcatttcaaatgcctttgttaaatattaattttgtttgtgtgggtttattttactggttttctactctcttccattttctattcctctgccaatccctcatagttttgatgactgtagctttatttgtcttggaatacagtagcatgagtccttcagtttgttcttttttcagtattgtagctatttcatgtctctttccttgccatataagttttagacatggtttgttaatatcagtaagatagcttgctgagagtttgattgggattgtgttgaatctataggtcagtgtagaaagaattgacatttagaagtattgagtcttccaagtcataaacctggaagatatttccaacaccctcttctttttaccctgagaaataacaaaatagtgatatttttaacatgttttcctcattaaatatgtcttataaattatgtaggtccagaagacaaaaaagaaaaataatctccatccaacaaacagcatagattaagattaaatagatatacaagtatctgggtcttgccaattaggttttcaagtgcattcatacaagaaatttactggaacacattttgatatatattaattataaggctgctttaatattatagatggcatagaaattaaaattcattgtgcagaagattgacacatatggtcagagaggaaaggagactcagggagcagcacattattaattagaagatgggggaggataaacataagactctctggagaaaaaattaaggacatgagacaagaaataacctgaatctgttttgaagggatagagatgcataaaaggactggggtattagaaaagactactttgaaaaaaatgagagttttgagttatgagaccagaaatgaatggcttagaaaggcatcctcttctacccacaaattatacttgaaaaataataatcaaaatatcatatgttttaaaaataaaacacaggcttattatttgaatctcaaaatttattttcaaattaacaaactagtatttgtctgtgagttacaaattctatacatttgaccaagttccatttacagagtgaaggcagattttcttcttaataaaagacgcattttaagaattctgaaatgtaattgaaagaaaagactggcaaagacatatgaggacacaaatattccaaacaattatttggttgttaacatgccaacaaaaggttggttttcaaaagaccatgtttttttaatttcagaaaaatacggtttcagtaattctcataagtaattcagcgatgagctatcagctaccggtaatgaattctcctacaaaggaataatttattcccagtgtactcacacaagctgggatgttaccaggaacttgaagctgtaaaagaaccctatcttattagctacaatgcctcactcataatacatacctcatgagttacatattaaatgatcagaggttatttatcttcatacactagtttggaaatggatgaatcatttctcatttcttctgaaagacatacattgtgcttttgctcaaatttcaatttcagagcttcaaacttgtgatacttatctaaatgaaggattagactcacatttgcacacacacaaagcacaaaacaagtgaactaccatatctaaaggcaatagatattacaatgaaacacattaacaataatgtttacttttctaaaaatgttcagttatatattaaagcaaaatggtatttcaccctaattctatgcaaatgtttttgttaaggcattcagttgcttaattaatggtattgaattttaaaaaatctattggtttgcaaatcaggttcttacgcttgtatctatcattctgttctgagagggttgatttatgggtacctataaataaaacagaaatctaaaaaatttagtgagtggagcccagcatgcttcaaaatggaagttgaaacaccaccgtatactatgatcaaatatgttgacttagagttactaattttactttaggcttgataagaaaggattgtgtgtaatctgaatacttactggtagtgagcatatgattgtgtgcctgtaaatacagaatatcattgataatggaaactcaatgtatccaatgcttagttatttacacaaaatacatcaactcatcatgaattaaagactagatcaaagtcataaaaagtaaaaagatacaaaagaaaaatgcatttttcttagataatatcttcattaaaataatagttaaaaattagtggggcttaaatttattgctgtgtattggggcttgtggtgttctttatgtgtacttcaccccatttaacctgaataacaacatgctagttataacctcatagctttaaaatggaggccattctgaaggcctaacttcattgggtcatctctaatataacattgcttcttttgtaattccagcctcatttttctttatttctgtattagcccattttcacatttctgataaagacatacccaagactgggaagaaaaagaggtttaatggatttacagttccagatggctggggaggcctcacaatcatgacagaaggccaggaggagcaagtcacatcttacatggatggcagcaggcaaagggagagcttgtacagggaaactcccatgttttaaaccatcagatcttgtgagactcattcactctcatgagaacagtacaggagagaccagccccataattcagtcacctcccaccatcttccttccacgacatgtgagaattgtgggagttaaaattcaagatgagatttgggtggggacacagccaaaccatatgactttcctaaactgactgcttgatatttgtatgcattatgtatgaaaatacgtattacttcatgtaaaatgaaagctgtttgattatgctaaagaaaacaattttgtactgtatctagaaaagaaaatgtttaattggtcagcattaaaagaatgagtaaaatcccaaatcaaagtttagaatatactaaatgtaataattacctccttatatcattctcttgtaatgtctagttcttcaaaaagctttataggaaatggacgtaggtactattgagagtagaattttaattttaactcagggaacttaaaacttttatgtaatgaccttcacagtatacattttgcaacctgttattttagggcattatcaatttctcagatcaaagtttgaattacagttataatattctgttcaccaacttccttatttaggtacaaaaggtttaaaagatctaaaatataaatgcatgaaaatttagaaaactgtttttctcctcaaggaagcaccaaaatggaaaaaataatgacactggttactactttcttcttttatataactcagttggttttaagtttcagcttcaattcctcagttttgttctatttggtttgggaaagtggtacattatgtatatacaaatttatgtgtgtttgccaatgagtgtgtggtcacgtatatctttgtgatttattatagtataattttacccagtttttccaaagatatatttaatagtactaaatagaaaatctatgatatccatacttgttcatatgggatatctttttccacttcctttaagcaggaagtaatttcttagactgaaatgagctttagaccattcctatcacctcagcatgcagacaatattggtccctcaagggaagataagttgctgataaatctgtagtataacattagagaactcaagagccacagtatcagattgtcccaacaaaattttagagcaccttgtttatcatatgcggaatctatgaaagctaatctaagagtagatagtagaatagtggttaccaggagctagagtagttgatcaaatgatataatattttaattaaatagagatgtttaagagatctattatacaccatggtgactatagttaacaatacattattgacaaatgctgagagtggatgtaaagtattgtcaatacaaaaataattatgtcaggtaatgcatatgttaaatagctgaatttagtcattcagaatgtttatatacttcaaaatataatgtggcatatagtaaatacatacaattttatgtcaattttaaaaaataaaaaaatgaaaaaagaaaactatgaacccttgagcactttagagagagtagaactttcctgttacattcataggatagtatttagagactgtacttcgatcaagtatatgagcacagaaggacctagtattaagagccccggagcaaaatagtcatctcacagaaactagatcaaagtgttaagaatcatttaagcagctacaaatacttcctgaaccatattttgcccacattacttgacggttattctttatgaattaatatggaaacttaaataacctactgcacactctatataacttattgtaaagaagtaagcatgtaaagtcatacgggctcaaactttcacgtacctgtgagatagtgttccactttatctaccaaaataatctttatttatgataatggttgatttcccttatcttttaggtcacaatacatgcttttgactaatgttatctgcttccatactcaacataattcagaaatgttcttcctaaaaaataacatgctgaatgtcatatgctccaaattgtgtgtaactttaaacaagttggcagagggctgcctcctacaagtctgtcccctggcagttacccctctcactcctcatcagccacacacatagaattacatactatttagaaacgggctaatgtaggcatgagaaatgtaatgtctttgtcataatatttgtcactacttttaataataacccttctaaaacttgtgcaggaagttaatacttttctttaaataaggtttattaaaatccattaaaaatgctataactttatcaaaaatatatcattttttaaaaatgtagaacagagcagttgaatagtttctctaggtgtcaaatttcaacaatatttgttattgccactatataaaatcttctaaataacagaatattttataccaaggaattatggcatatgatttcctgaaaatgaaattttccttgatgatttaacatttccaacaaccctgataatcatcatcaaatatatatttgttaggttattactagttactagaactataaactaggccgtatatttaaaaaacaattttcttcttgcagattatatgttacatggaaaatcccaaaactttatggcacactgtgcatgagtaataacaacaagaagaaactggaggcttatgttttgagactggttcacacagaaactgcaaataatagttaacatagggaatacggtgatgatgagttcattagggagaaataaatattgtattgcattagccttcatattttaggatggggtatacactggatagttaagaaattttattttataaaataaatttgaccatataatgcatagaatatggtgttcttttttttttaagttctggggtacatgtgcagaatgtgcagctttgttacctaggtggtttgctgcacctatcaacccgtcatctaggttttaagccctgtgtgcattaggtatttgtcctaatgctctccctcccctagcccctcattcctagacaggccccagcatatgatgttcccctacctgtgtccatgtgttctcattgttcaactcccactaatgagtgagaacatgtggtgtttggttttctgttcctgtgttagttttctgagaatgatggcttccagcttcatccatgtccctgcaaaggacatgaactcatccttttttacggctgcatagtattccatggtgcatatgtgccaccttttctttatccagtctatcattgatgggaatttgggttggttccaagtctttgctattgcaaatagcgctgtgataaacatgtgtgtgcatgtgtctttatagtagaatgatttataatcctttgggtatatacccagttatgatgctggaacaaatggtatttctggttttagattttgaggaatcaccacactgtcttccacaatggttgaactgatttacacccccactaacatggtaaaagcgttcctgtttctccacagcctcaacaacatctgttttttcctgactttttaataattgccattctgactggcatgagatcgtatctcactgtggtattaattttcatttctctaatgaccagtgatgatgagcaaaaatcacaagcattcccatgtaccaacaatagacaagcagagagccaaatcatgagtgatcacaattgctacaaagagaataaaatacctaggaatacaacttaaaagggatgtgaaagacctcttcaaggagtattacaaaccactgctcaaggaaataagagagaacacaaacaaatggaaaaaaaatccatgctcatagataggaagaatcaatattgtgaaaatggccatactgcccaaagtaatttacaggttcaatgttattcccatcaagctaccattgacttttttcacagaattagaaaaaaaactactttaaatttcatatggacaaaaaaagagcccatgtacccaagacaatcctaagcaaaaagaacaaagctggaggcatcatgctacctgacttcaaactacactacaaggctacagcaaccaatacagcatggtactggtaccaaaacagaaatatagaccaatggaacaggactgtgttcttaaaatatgaatttttcgactgcatttgaaaggaaaacaaatatttgaaatggtcaattgaaatcgaccacattgaaataatttaaagagggtgaaattaatatattcaaaaataaattctgccagaatcatagatgtttgggacccatttcatgtctgggcacctgttattatgggcatgcctcctacactgaactaaaatttacatccctgaaactccaaggctttcggttctgtcccaaggtaaatctacatcctcttccatgtgagagccttctgagtatttgatgaataccagtaagacaaatgaccccaggttcttcacttgttctttacaagagaagttttctggtctcttctgaattctggttagtcttctctaggttgcaaagatctttcgtaaagcaagagttctgaaaagatcaaattttatgtgtgataaaatggcacgctattggaccatactgagtctgctgtttaattttcaaccaattcttaaattatttccacagtgaactacatactggctggtatttttttaagaatctctcacttacatacaaactcactttaccaatctccaagttttaatgtcagtcaatactctcttttgttgttgttctcccaaatacaaatgttcaaaatcttactaatgtaactttcttcagtgcctgctcaaaggctcagaaatcactttttaaaatttactttttaagataaaaattgattaaaagtatatcatttactccaaccattcatatgatgtaattactatgtgttagagactttattagcaagagcatattctgcaaacaaggtagtctgggctttggtctcacaggagtgatgatggacatgtcactatgcgtctgtatgctttagtttcatcaaatgaaaatttagagagtttggttgtgtgaggaggaatgggtttgactgaatcaggaaaccttagtggattcttagtgattgtatttttcattggtaaattcccatgacctattcccaaagctattccagggattttaggatttgatataaaaaactacaattttcatttcatgtgaatatatttttgttattttacagtaagaaaatgttcatgttaaaactatatgagcaacataggacagcaaatgaatttttagtactaaatataaaatgcctcaaatatactggcatccaataataagattttaaaatatcagattttaaaatcgatttagacttaagtaacattggccatgtgttcaaaagatgggattttaatatacagactattgagatctaatacactatgaatatccaatgaatattttcaagttaattattcaaaaatcaacattttctgaacaaaaaaatgaaaaagataagttcttaaccataacgtagagtaacatttacaatccaaaaccttttgatctgaaatatcaaagattataaaaaatattagcctatatttgtagaggacataaactttttaaatataatttaagaatataaatttataaacaatcatgtagtcataaggaatttaaaattataatctatgaatactcatcaaaaatcacattagaatttataaagatcctgaatttatagtaaaagatttattgcttccatgaattagcaatttggctgagctaatttgtaaatgatgtggtcgcttgaaagactatacacaaaagaaaattggtaagcaaaaaaaaaaatacaaaatatcggaagaattactgaattgagagaatgaatgctctccacaatcaatgtcattaaaaaagcaactttctgaaataaaagagaactgtctacttttttctttgtcccttttttagtaagcagtttgcctctggtttaacaatatgaacatacttcctttcccagctggaggcatccgatcctgggaatattgatgtatgtacaccccgtagattatacttttcagactagatggatttctaaattcaagatctaccaaatacttccacaattctaattaaaataagaagtttgggagtcagaaaccttttgccctagaggcttgccccaccatgtattaattttcaccattattccatttaactggggttactcatttttatttcctaaaaaattctatatctggaaagaggtaccattctacagcatttctggcaaatcataaattaacctacagtaaatgacattaaggagatagctttgttctgtaaatggataggataccatatggctttgatgttagtgtgaagttaatcacaagctccataacaggccatgacatcatttcataataaattgcatgaacaaatgctgccgttatctgaacagcatgtgaattttggtacctataatctttagggaaaaatgaatataaaatattgagttaaaaaatagatataaggatggtaccatagcgtctccactaaaaatacaaaaaactagccgggcatgatggtgggcgcctgtagtcccagctacctcgggaggctgaggcaggagaatggcgtgaacccgggagacggagtctgcagtgagcttagatcgtgccactgcactccagcctgggcaacagagcgagactgcatctagagaaaaaaaaaaaaaaaaaaaaaaaacagaaacgtctaagttgcaggaagtcagtaggtgtacttttggagtcatcttaaaaagagacgatagacatttcttccatttctccctttgctgccatctggcaggcagcctacaatgtgattgatccagtaggaagagtaccctatgggccaatctatgagccctgctagctaccctggaaagaggctgaggtgccttttttcaagaccccaacactagctccacaccacccaaccacatcgtttaaatttcagttattttctggtacacactggtacacatttgccaattatgtacaaagactgtcaatgaaatcagctgttcactatgagattacagtgtggctattcttttgtaacaaagtacttgattatctagagtattttacttcaaaatatttctgaaaaccatacttccctgtgccgaatcctcagtcagaagagagctgacaatcaatacagaagtaacatattgttggaaagaataattagaacattaatgaaaactgatctcattcatttttcttaaaaatggaggaaataatgttttctgatttctctccatcattccaagtgcaaggtaccacgtaatttatatgtaattcaaacatcaatagagagattttttttatattgattgctcccactttagtagtgctctataaacaaataaagaaattaactgattttacccctgatcagatgatctttctttggagatgtgacatttaatctgattattcatgaatatgttaatgagagagttatcacatgccagtcattagacactgaatattaaaatgcaaccagtcatgcagtgttgatgacaagcttccttttccaatttgcaaggaaagaataagcaaacaagatgagtctaatctctgggttttgttactttttgtaaaatcttcagtggcacttatatgtgtcaagaaaaaaataatttcttaaaatcgcaaactcagggactgcaatgttttttgtcactcattccaattaaaccaatggcacttaaatttaacaggaatgagactttaataattaatagagtacagttgtgtgtttctaatatgcaagcaattccaagttgataaacagctttggattaccaaagtttactggtaaagctactgttaggaacttaaactagtcatgtattttctgtaagaaattactttgcaaagaatggtaggaaatcagagatttaatctcactccaccaagaccctctgagggcaaagaaaatgtgcgtccaggaataagcacaaggcctcaaacatagcacacacaaaataaagattagatgaaggaagaaaggaatgaaaaatacctggatgtgctatactagtagtgtataaaaatctaatcattatttaaactttgtttctatgtgaaaacttaatggaagattccatattggctctaagaaacacagcagctctcttcctacctgtctgccttagtaaccagcagtgagtgacacttttctcttacaaccagccagtggcctcaggatgctatgctagtaacaggagagcatgaaactcctgaagtgtcaggggctgtcatggctttgtgtggacattcttaggtgaggtacagcgatgacacatcgtagagaagaggaggtggggtagtcaatcgcctcagacactaaaccataaaacatctctgaaagtgtaaagcaaagaagaaaattgtattcatcagaattcttcttaaaagagaatactgggtgtattacaaggacctcttggttaagctgcatggggtagactgtaagaggcttttgtctgttccactcacagcaaagcccgtatgctccaggaattgttagtaattgctgtgtttgtttggtgaagtggatgatataagaagcagggagtgctgccttccggagtcctccttttctgcctttgttctcatccaggtgccaggactcatctctaaaaaaaaaaacagttgagaaaatatttagagtatcagtttgaaggggtttcaaattactctgctaagagcaccgaaatgcctgtctctagccaggagtcaataaatggggcaggaaaaaggagggactgttccagtggcaagtgaatggagccgcctaaagtattgcttgctcactttagcaaactgccttatagtattaaacagtacattatgagactgttttcaccaaacatcttgaacaacagacaggtgcatttttcctgttattaaaatgtgggtcataaaggcaaagctacagagacggaaaacagatcagtgaattccaggacacaaaagtaggggagaggtggactacagcggtgcccacaggaattctgggcagggcaggggggcggggggtgatgggattgtgctttatcttgaatgtgctggtgattaccaaacatatgcatttgtcaaaacttatggaactgtatgctaatcacagtgaattttatggcatgtaagttatattttaacttacgaatttttaaaaggcattatattattactctgaagattcagataaacatacacacacatatgaaattcaggaggtgttactagaaaaaaagcccagtttctccttatctaaaaaaattgccgaaatgggctatgattttttcaatatcttttccaatttttgcctcttataattctgtgtttaaataactaaagaaatctgaaattacttagcaactttgtactagcaatggtcattattttacaacctatgctcagatactaattaccttctcataattgtccagtatgcaactgagaaggtcaaccactaaaatcattttaatttcccttcagcttcactgattatttgtagagagcatttcgtttctaggtcaaatcgtcttaatacacacagatcactctggttgagccaaaccagattttcttcaaaagctctgacattgagaccctgctctggcatttcatttgtttgtatagaaaatgttaggcgtctctttgccaagtctaagctgtgattccaaaatcccctcataaccttgcttttcaactgtattccaaacatatataaaactgaaattgaccctacagtcattgccagaggcatacatagagagaaatgtacaatcacagtgtcattggacacacgcatataaattgcgtatctctaaacttcgcaaatctaatatggtattcacaatttgggcaataatgtcagcaacaaatttaattaaataaaaaccttgagagaaatagtggtttatttctgaaaaccaaatattgaaattttgctgagtggcttactttaaatgatcagaggaatgcttcataaattcttgcagtagcatcgtaagactttatgaccatagattctctgatacatttattgggacaccttgtaaaatagtgaagttgcagaaacacaaaggcatagtttttaatttcacatttttcaatacatattacacatgaaaactaaagttttaattaaacaaaggaagtcttaagtttgcattttatacattgattgacaagatatctcttaacataacatgcatagccaagttccttgtgtcacttgctttgcttttttcattcttccttaatttttactaggattttattttctatttctttttcaacaggaagctctgaagccaccacctagttcacttcaatagttatgtgcttttctacgtttcaccacaattttctcagtagttcagacgtatcactcttgctcgatattgattgagttatataatcactattagcaaatgctctttgatttgatcctttctaatgtgtattttctcagggacaggaccagttttgaagttgaacacacactggtgtgtaatgtgcatgtacagagtgcctctgaactatgcagagtaggaattgattcctaaaccccacataaatgtaactcagactggtttagaaaggctattggatttgaaatggcaaaatactaagatatgggaaaaaataagataccagtttaattttaaaatcagtattaatcatgtttaccttattcttgattttttaaaggaacaaaaaccaacatatatgttatttgatttgtacaaatttgtattattctatataacatccatatatattgtccataaccatgtgatcacatagtgtgtctataaggaccttgtatctagtcatatgtgcacctgttgcagtaacccatgctgtgtaggcaggttctatgacaattcaaatcagttctagtgataaatcaaacctgttggttgcttttattgaatgttgttctatttctgtctgtaagcgtatagccaggttaagagaaactgactgaactaaaggggcgcttatgactattccctaatgatatcacatccaaaacaatgaactgacagtgacttaaattattaagcattaggagaaatccctgtatccctgcagtgttcagttccttgaggctctgacaaatgacctccagtttgttggacaaagtaggcgggatatgaaggcagctcttatacacatactttattttggctggggcaagtatcactggatatctcatttggtagcatattaaaatatgcagatcttcatggatcagacaatattattaaaacagtttaatacagtcaggtgtttcttttttttttttttttttttttctttgagatggagtctcactctgttgcccaggctggagtacagtggttcgatttcggctcactgcaagttcctcctcccgggttcacgccattctcctgcctcagcctcccgagtagctgggactacaggcacccgccaccacacctggctaatttttttgtatttttagtagagacggggtttcaccgtgttagccaggatggtcttgatctcctgacctcgtgatccacccgcctcggcctcccaaagtgttgggattacaggcttgagccaccgcgcccggccaggtgtttcttaacgatgggaatgttgtgagaaatgtgattctaggtgattttgtcattgtacaaaaatcacagagtgtaattccaaaacctagatggcggatcctactatacacctaaggctgtatggtataacctatggttccaaggctacaaacctatataacatacagctgtactaatgctgtaggcaattgtaacactatggtaagtatttgtgtgtcaaaacttatctaaaatagaaaaggtacagtaaaaatatggtaggattatcttatgaaaccaccattgcatatgtgaagcatagttgactgaaacatcattaggcagcgtaggctgtatgcctcaggtgccaattatgtgattccatctgatagcaactatatgaatattatatatttgagactaaaaggctaacataccaatttattttgtatgcagcttttaaaattcatgctatttttacttgtaaaagttctgttcactactttaaaagctgaagcacattaccggaaaaagcatgatgtgacatcgttctctactataaagaaaacacctgataaccaataactttcaaggaacacacaccccatgccacatcctatgcattctaaccattttacaagcattatctcatctcatggaatccccacaagtatcatgtaagatagattctctgattattcccattttatgggggaggaaaccgtacttcagaaggttaaataaaacttgcttgagtgtaaaatatattttcttacctctcactaccatttactatgatacatttactaaggatttattaccctctgaacaggagccttgtgatctcacatttcccaacccctcctccagggagtggagttgatctgagtattcagaagtaaaaatgacagtagttagcaattgctgagaattgtccatgtgccaggcactgtggtcaacacttacaggtattatctcatataataatcagaatctatcaaagacataggtcaattattatcacagttttagtagacaaggacactgaaacttataaaggttaaaagtctttgtccacatcacagctaagaagtggcagagtccgaagaagagggaaggcagtctgactgcatggcctgttctagtaactattatgaaatagccaacggcacccaagacttagtagcttttgaagcttcaccattgaggatgtgcatttttaaagatggggtcagagtataaggaagtcttcctggtcctccttaagttccacggcagggtgcctgcctgtgtactctacctacctgttctaattctggggattatcaggagaagaaacaagaaagctataaaagccttagcttctcatgaaatatcttagcaaaacatttttatgtgaaaaatgtatgccaccttttatgtttatggccttgttttattattttcttcttttggaatatttctttctggagtttacaaaggaattatactgaacgctgatgtgaatcccaaaggaaagatacgtttcttctctaatgttctcaaatgtcaggaaatcatttagagagtgaatgtctttggtggctggttctaatttgcactgttgtttgataatgtgcacactggagatcaattgtctgaagatctccttagggctagaaggtcatctttggtgaattagcctgatgcctcattaaagatatgtcaattctcctttttccttgcaatgtgtagagtatgctctctaagtggagtggcaaaatgtacatgaggagggaaatttagcaaattagtttaatgagaattattgtgtttatttggagacttcgatttgattgaaagaggattttactattgggcttcctttttggcgaaggttatccgtagcacctactgtaattgcttcctgtaaaagagtcagtatccatgcagttgcactaatgtgctcttgtttggtgcatttttctcttctttaatataaagcatcttgactgcgaaaattttaaactccagtgtttgaaggatgaattgatgttgattttctgcaaaggaaaataataaatagacttggagaaaggaaaaggaaacaaatctcactgttagaggtaatgtggaaagaataataaacaaatgtaaggaagacaacatctgcgaacagggtctatctattaatgcttgttagggagaaaatgcctaaaatgtgaataagtaaaagcctaacaagaaataaggtatagcagccttccaatagtttgcaattgaaaagagacaaacttgtccaggcacggtggctcgtgcctataatcccagcactttgggaggctgaggtgggcggatcacaaggtcaggagatcgaggccatcctggctaacactgtgaaaccccgtctttactaaaaatacaaaaaaattagccaggcatggtggcgggggcctgtagtcccagctacttgggaggctgaggcaggagaatggcgtgaacccagaggcggagcttgcagtgagccgagatcgcaccactgcactccagcctgaggaacagagcgagactccgtctcaaaaaaataaataaaaatacataaataaattaaaaagagacgaacttcttccagaagcagaaaatcaaatacttgggcaggtttctaataatttataagagaagaacatattttatgttaattataatgtaggccatattttataagaagtagctggacagttaattctgtttcagttctttttcctctttggatttctttgcttctaatttatttttctgtttctatgattatttctctcagcttcaatctttagctctttctactctttaatctctggttatgtggggtaatggaaggcaggtgctggtgtgacagtggcccagtatcatgacattctgatagattgtattccctttgatctctacttaagagtttcatgcaggtgtttcggaggagagagaaaaaaatgtttttcctgacatttttgtcactgcagagagaattacagttttacaactatcatagagattcagaacagatgaatatatgtctatcagtgagcatattaaaacctaatattttgtgggtttgttgttattatttgcaaacttggcacagtaattgtgaagacaaaaattgttcttcaggctttgtgagtcagattaaaaaaagttttaaaattagcactagtttgtaaatgagaacattcaagaaaagaacatgaaacaaaatatatgaccttaaattatgtataattgaagagaacttttaggttggtgaagctatacttactgttttttaaagaaaaaagcttatcataacttatttaaaagacaaattttgttttgttttgttttggttttttatttttttattttttatttttattttttaattttattattatactttaagttttagggtacatgtgcacaatgtgcaggttagttacatatgtatacatgtgccatgctggtgcactgcacccattaactcatcatttagcattaggtatatctcctaaagctatccctcccccctccccccaccccacaacagtccacagagtgtgatgttccccttcctgtgtccatgtgttctcattcttcaattcccacctatgagtgagaatatgcagtgtttggttttttgttcttgcgatagtttactgagaatgatgatttccaatttcatccatgtccctacaaaggacatgaactcatcatttcttatggctgcatggtattccatggtgtatacgtgccacattttcttcatccagtctatcattgttggacatttgggttggttccaagtctttgctattgtgaatagtgccgcaataaacatacgtgtgcatgtgtctttataacagcatgatttatagtcctttgggtatatacccagtaatgggatggctgggtcaaatggtatttctagttctagatctctgaggaattgccacactgacttccacaatggttgaactagtttgcagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgaagagcattgtttcatgtgttttttggctgcataaatgtcttcttttgagaagtgtctgttcatgtcctttgcccactttttgatggggttttttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtcttgaatccatcttgaattaatttttgtataaggtgtaaggaagggatccagtttcagctttctacatatggctagccagttttcccagcaccatttattaaatagggaatcctttccccattgtttgtttttctcaggtttgtcaaagatcagatagttgtagatatgcagcgttatttctgagggctgtgttctgttccattgatctatatctctgttttggtaccagtaccatgctgttttggttactgtagccttgtagtatagtttgaagtcaggtagcgtgatgcctccagctttgttcttttggcttagggttgacttggcgatgcaggctctttttttggttccatatgaactttaaaatagttttttccaattctgtgaagaaagtcattggtagcttgatggggatggcattgaatctataaattaccttgggcagtatggccattttcatgatattgattcttcctacccatgagtatggaatgttcttccatttgtttgtatcctcttttatttccttgagcagtggtttgtagttctccttgaagaggtccttcacgtctcttgtaagttggattcctaggtattttattctctttgaagcaattgtgaatgggagttcactcatgatttagctctctgttggtctgttattggtgtataagaaagcttgtgatttttgtagattgattttgtatcctgagactttgctgaagttgcttatcagtttaaggagattttgggctgaaacaatggggttttctagatatacaatcatgtcgtctgcaaacagggacaattcgacttcctcttttcctaattgaataccctttatttccttctcctgcctaattgccctggccagaacactatgttgaataggagtggtgagagagggcatccctgtcttgtgcccgttttcaaagggaatgcttccagtttttgcccattcagtatgatattggctgtgggtttgtcatagacagctcttattattttgagatatgtcccatcaatacctaatttatggagagtttttagcatgaagggttgttgaattttgtcaaaggcctgttctgcatctattgagataatcatgtggtttttgtctttggttctgtttatatgctggattacatttattgatttgcgtatgttgaaccagccttgcatcccagggatgaagccctcttgatcatggtggataaggtttttgatgtgctgctggattcggtttgccagtattttattgaggatttttgcatcaatattcatcaaggatattggtctaaaattcgcaaatagacgcaataaaaaatgataaaggagatatcaccaccgatcccacagaaatacaaactaccatcagagaatactacaaacacctctacacaaataaactagaaaatctagaagaaatggataaattcctcgacacatacaccctcccaagactaaaccaggaagaagttgactctctgaatagaccaagaacaggctctgaaattgtggcaataatcagtagcttaccaaccaaaacgagtccaggaccagatggattcacagccgaattctaccagaggtacaaggaggaactggtaccattccttctgaaactattccagtcagtagaaaaagagggaatcctccctcagtcattttatgaggccagcatcatcctgataccaaagccgggcagagacacaaccaaaaaagagaattttagagcagaaatttttttaaaaagaaattcaaaaaaatcatttattaaaataggcaagtacttctaaaagcagggcttgaaggatgcactgatatgtactttgataatgtaagccccaaagatcaggacaggtgtctgtcttatttgctcttctatctcatttacaattccctgaatgaataatgaatgaatgtgtgtatcacaagaaaaaaatcatggctatggttgccattcgaaagaggcacagagttataacactagtcataggtagtgcagatagaagcaagatcattgcatgggggctggagggaacttaaataactagtagattacatataataacctcgattctcatccctcattctatgtcaggcttagagggtctgcataccccctggccacagtgccagtggagaagggtttctatcccgtcatgttctataatatgtatctacgaaaaatgagatcagggaacatccctgtgggtatgaaacaacaaaaactttttgaggaagtgaggaggtatcttgttggagatgggggtgaggggcacttggcatctaatgactgcataactgtattctttttaacagcttgactgagatatatttattcacataccatataggtgacccattgaaactgtgaaattcaatggcttttagtgtatccacagagttatatgttcttaagtcagatctgtggagtcaggtctcaactaagctacccagtgtgtgtgtgtgtgtatgtgtgtgaatttgtatatgtttatgtgggtgtttgtggttagggtggggaactcaagctgcactgacttccagatctgtctgtcttcaatagtgttggtaatatacttcaaaatgagcaatttcttttttcctgtgagctctctgaactatattttatctaaagatactgtctgaaatttcatattaagctatgggaaaagtcacatatgtcactgttacaggtgacgaattactatgttaaaacttctagtgaaaaggtttccaacattaaattcacattaatgatttatagtcttgtattcacactttacaagtgctttgccatggttaagtaagtctcacccattcttgtaaaagtgaaaacatatctgcttaaaagcctggcaaaatgaagcttagaaaaatcctccttttagaaaatcacataatgtagttcatgaacatgttcgagaagggagcttgaacatgttcattgtctgtttctgtgcttaaataccatagctttgtgaaatatatgtgaatgctcactagtttgtgtgtgtgtgcacgtgcacatgtgtatttatgtgtatataaattagaacaagccattatttttaattatttacattaaaattttcagagggttcaggtataaataaatctgtataagtagtataatatatagtaacagtaatgtataacatataagctgtaaattacataacataaatatacattataggtaaaagtatatatacacacagtagttaaatatgtgtattttaaaattataattgaggaagctaattcatccttaagtacatttccggaagttcctctgttggtggacatattctcaaattttctggcataaataatgtttcagtttctgattaaaaccattcttgttatccacactaaatagacttgcctggccagtatctaattttatggtggagtcttgagtcatcagttctacaaagatatttaacctgttcatgataatcacatgcaagagaagctggtcttctgtgacctgcagccagtgtgccagaaagaaggtgtcaagacaagagtcgcctagtgaaacagtgctggtgaatggggaaaaagagcaaaaattaaatggaatccaagccagtttgacacaggacaaattataaagaaaatcctagaacaccctggagagaaacaatgggcaatgattcttcaaccaaaaaggctctgaggcagggcacaatatcaatggtcacaagaggacagggactcccggccatatgccctatgcccttgtctcatcggaggcttgactgagggcagagtctgtagtgccaatgggtgaagggataacaagaggcaggtaaatcccaggagctgtttctacctccagagaaggaggaatccagcaatgctacagcatctcagtccaaattggctccctcgctgtttgacagcaacctttagggctccattctggactttatctcgagctcctttcctcaccccatttcctttaaagaatggccagaaaatctgagcatgatatccttctgttaagaaggagaagaaaaaaataatcttatattagtccatgatgtacactgaaagaaagaaaagttcagtatctttataagaaccttgtctgagggattatgttaaaaaaacaaataactgaaaacataatataatattcaaacttctcttgtttgtttcttggttgttactaggccattaaaaatcttataaaacattaattgtttaatcttggaacaaaatgtatttaaaaaggtttaaaattctgccttattcctcatgagcagtgataaagagaaatcactgggaagcaacaagtgttggcagactggttcagcatggtggctgcgaaaagaaaaacataaggtcttacttgataaacagtgcagcacaggaaatccaaggctcaaactccgttttgaccttcttgatcccaacagttagaagcaatcattctctcctgtcagctttcatatctctttacctattcttttgattagagatttttaaaagaaatcttttactctactaatctatagtcatcctaagaagggttcccgtgtataaagaacatgttttatatttacatgccacagttacattagcagttccatgaatttatggagacttaagtgcagctttgactcttcagcctcagctcccaacctttccaactcatcacccaatgtaccacaattcttatcccatcagaccctggatctggctatagtcatttcctcacctgacctggagccaggactgcacatgaaaatgaggcttccgtatcacaggttggacaaacctctctcataaaatgcttttgtatttctctacttcatgggtacacagaccacttcagggacttaaatgtaacccttaataccttttataaggtagatgttgtgttttaaataagttattttcaagtgatcctttggaacaaactttatgcctttacatttctattttccaagcatatagggggtgagaaaacatgaatattttccccatgggaaagaagtgaacgttttcaaactttataaggaaatgacttttctctttgtagttataatcaggaaaaaaataataaagcccatagcttggggtcatttttaattagaaaaactttttacctgcaaagcaaaaagtctacaaaccagatttttatgctgtgaaaattttttattatgcaatacttctttaaatgttttttaaaaaactaatattttcttatcttataaatgtatgaagattttgagtctaagagaccaaatagatttatgttaaaacttctctgggcctagatgaaattctcagatattttgtaagcaatgaaaaattaattttaaagtgtttttccccaatgtgtaatgcatatttataacctacagaacaaaaaacacaatcatattttggatctttaagacctgacatagcaaaaagataatttgctttgaggccctttgatgcatttaatttaatttattggaagcaaattaatgtgaaatgataaaattattattaaaatggaaatagaagaataggaatgactcaaatcaacagaggagagaagtggctgattaccatacttcataggataattcccaatttaatcatattaaatctaattgttggcggacagatgatgggaaataccgctcttgctttgtagtagacagaagaagacagaaaaaaattttaaaaagcaattcagaatgtcactaggataaaccaaaaagtaaactgaaaatgaagaccaaagtggatttcttaaggaaacattgcctctttacattgccaaatgaaaatttggtagatgaatattctatggttttagataatcatttgtaacttgaaagggatttatatacaacttaataaatatatattgaatgactgctattttcaagatattgtgctgctgatctgtcttctagctgataaatttagctgaatacctggagcaataatagaaccaagttttattgatcaacagcaatctctattaaaatggtaatgaacagcttctgcagtatatcttgatatattttctttttactgggtgtgatgaatgtgtaaagtagtagaacttatgatacatgtgacatgatgtaagttcatgataaatgctagaggattaatttcatatagctacatattgtcattatttcaaacttcagtgaaatgaaaacatgagtttttcactgctgtttttaaatttttgtgatttttcccctcagtggcaattccaaaataaatggaggaaactggaaattattctgaatattgtgtatgaataaccatcttattaaatagactcatttaaaacattttcaaaaatttacatctttctcaataggaaatgggtcctttaattctgctcatttctctccatttttagtgatgttattttagtctaaatttccataatctttattctgggctattatagtaatattccaacaggctttttctcttcctatttcttgggatattcctatttatttcccaaaccatagtcttaaacatcttaaagagaaatatacagaatctgaaaagacacttctcaaaagaagacgtttatgcggccaataaacatatgaaaaaaaagtcaccatcagtggtcattagagaaatgcaaatcaaaaccacagtggggtaccatctcatgccagttagaatggtgatcatcaaaatgtcaggaaacaaaagatgctggagaggatgtggagaaataggaacacttttacactgctggtgggagtgttatttagttacaccattgttggtgggagtgtaatttgtcttacaccattgtggaagacagtgtggtgattcctcaaggatctagaaccagaaataccatttgacccagcaatcccattactgggtatatacccaaaggattataaatcattctactataaagacacatgtacacatatgtttattgcagcactattcacaatagcaaagacttggaccaacccaaattcctatcaatgatagactggataaagaaaatgtggcatatataccctatggaatactatacagccataaaaaatatgagttcatgtcctttgcagggacacgggtgaagctggaaagcatcattctcagcaaactaatacaagaacagaaaaccaaacaccacatgttctcacttataagtgggagttgaacaatgagaacacatggacacagggagggggacatcacacactggggcctgttgcggggtggggggctaggaggaatagcattaggagaaatacctaatgtagatgacgagttgatgggtgcagcaaaccaccacgcagttgtatacctatgtaacaaacctacaggttctgcacatgtatcctagaacttaaagtataataaagaaatatataaaatctgattatttcaccccctcgatataatggaaagagtacattgtaagtcatacatctgaattaaatggaaaaataaaatgatatagtgctaataatcagatatacagaattgtagctttacaaagtataggagataagttactctgaagattcctttcattagaaaacagccagatggactggtaggcacctgtatcgcaactattcaggaggctgaggtgtgagaattgcttgagcccaggagttcaaagctgcagtgagatatgatcacgctggtggatagtgactgcactccagcctgggcaacatagtgaatttttttttttttaaagaacaactagattctccataaaacagactatcacactctaatacataactgagatcacaggaaatcagggagaattctaaaccctcttaactcattctctgagctcatgacagagtgggtagtaagtgaaaaactgaaaaattgcgtatttttttagagcagcttagtggacagacagtattttagaataccagaaagcacaagaaatgtgtgtgttgttatgcagaattcataaacaactcttttgactcaaggaggaaaaacataggatcataataaacaaacccttaacaggttggaaacaagaatagcctgtaacatatgaagggtcactcaaccttgttagtaattaggacaacctaactaaaatgtataaatgctatttcacataacaagactgaccaagggttgtgatgatacgcaataataggaacttacgtactttgttattgatagtataaactggtatggacatgtggggaaaaaacttgctcttgtcttacaatgttgaacattgaattactaacaactcagaaatttcacattttatgaagttcttcttagtgttgtttatattatgagatagaaactgttatctgtatagtacaccaagataagaataaggcagttcctgagtggaaacaacattatgatattctcttattgctgtcactcccttccttagacactggctacaaaaaccaatgaactaattcatctgggcataaattgcaaggttgagatagtgtgtcaccaatgctatatattattctgaaatttgtatgtgggttttcatgcaaaaccattgtctgtcacagtaaagtatcttttgtcatcactaagtaaaaaccttttcaagtaacagactcagaccacgtgcacacaatggatgggcttatattatgataggctggctatcctaataaaatattttaaaaagcataaatggtgggaagagcaatagaaataaagtatgtgaagaaggatactttaaaggtgaaaaagtataacaattagaaataacgataaattgaacaacaatgcaaaaggaaattcccaaaatgcttccaaaacaaggacagaaaagaaaaaagttaaattcagttattaaaaaattaaccccattttaaagccacttgcatttattagtgttaattacttgtgttaattttaacacaagaaaatggcaaactggtaatgccttcctactgtaatataaagttacttcaaagaggaacattttctgaatgacacaatgaatttatcaaggacatggggcttttgggaaatagacctacgactgttggttctctgattatctcactgtgggctacttctgttttcattatttatttgcgatgtgggcacattaccaaactgctttcagaattgcttaatgtgtaaattcctctgaaactttgaacaagagatttttgacaggtatgattagtaagtaggatttcaagacatttgacttcactgaaaaattttactgtcatgacccctttaacaatctttttacttctggagatgtgtttccaatttgggttattattaatgactgatgtattcttaaaggaagagaaatagaatattatagacttatttcacagtaagacaagtcattaaaaataactttgaacttcaagaagtagtagaaatgggaatttgaattttcagaccaaatagatcatgacagaaatcaaagtgtagaattacaataaagtaaagagactggatcatttcagtctattttgatttgacattataattttgtggttgggaggaaaaagaaggcaactgtatttcatcagctttgaagacttcgttgtcgtgaagaaggctggataacttccttatgttgtcactatcttgcttccatccagagactgtggagtctttctggaaccaatatggttgaaaaagcctttcctttttagtcagcagggcttagtattcacagcctctgttttaaatacaatgtaacttgctttattacaaggcatactgtgacttataaagctagaaattctgttcaggtgattacagatgaaaaaaatgatgaaaattgagaggttgccagctcacgttcttttctttctcactaaagagtctgcttctattttggtccattttaaagtttccttaactcctcgagtcacagagaaagtagtcattcttcagtgttgccagctcctgattccagatgagctaatgattccacagagctatctctttggttcttaactctgcacctttactgatagtcattgtagtttaatttttattatcaatgtttatagggcctttgcggtgtgtcaaattttaggcaccccaaaatataatagcgaacaagacattcatggtcactgccttcatggagcttctcggctagactgtgtataaattttcaatctacagagaatgtctctatgtttaataacaatagaacatttgtattgactcttaccaatacatgtaaactactctttgaaaagtacactaaatcccaaagtgtcttttggaaaaggaatgttacatttttaaaattagacctgatagtccatagttgaatgctaatatgatggtcaatgactaggaaaaatgttccaattcaaaacaatttcaaagttttcttcagtacccttgtatcatcatgacttgggaaaatcatcttaggaagtattggatgttatcttggaagttaatttatagaaacatgggtggggcattgtagatcatttagtccttaaatacatttttggctgaaaggaaatctctcattaaaagggaaagaaacagaagaagagaaggaagaagcaaggtaaggtatttgctaggatcacataactggttagtggcagaagtagaaatcatttccttggactctttagtgctttattactgccctcttgtaagtttgttgcttttccactgactgttgggtaagaaattataatcccagaacagttctttgtatattaaaaaaaaatcctttacatattccatagaaactgggcttggtttgtaaagctgaggcccaggagaagctctttttcttacccatttggtctttaatgttgcttgcgaatgcatgggggtagaactctaataacaatgatggacacgatgtccttgcacataaacatttggctcctcacagcatgagatgtctggtcagccacagaggataaaataatggcgtaaagatttactgtcagggagctgggccagtctcagcaggacagcggctccaagcagatagatggcctggtatgcgtaggtcacctgtgtttacactgatgaatgtgtgtggtttccctagtctgcatcattatattgagttgtgtggtgttggtagcacttgttactcaccctagaatgtgcctttctattgaaagacaagtagactaatagcttggcttcccagaaataaatgagacaattcacatgaaagcaattgcagttagacaaaatgacataaatattaaagattaagaataatattatttgtatctgtaatatacagaaatagtcaaaaaatacttggggctgcataatttgtggttgtagcagttgctgaatttagtcccatatagtgatttggttgcataatttaatgtttatgttgtatttgtttaatacatcactttcctgaatgaaatgattgtggtatgaagttataagaaataatgtctttggcttgttatagaaacagttattttagggattttttgtacttttgaagcagtttcaattacaagtcatttttcatgagttctgaagtaagttttaggcatttgttatgagatcatattattagcagcttagatgaaaatccaaaatgcatttatggatattttaattggaaaattaagtggatcttttataaaattaaatactctgctataatctcttagaaaaaataaatcccttttacctaataggcaagttcatgagaaatctgtaatgatatctctcaacatagcatgttaacttatagattatataattataaatttataagcctagtttatactaagtatattcaagttataagtcacaatacgtgaaatgaacataattctctgaatatgtcacattttttaaagatatctgtaatcccagcactttgggaggctgaggcaggtggatcacctgaggtcaggagttcaagaccagcccaaccaacatggcaaaaccctgtctctactaaaaatacaaaaaattagccaggtatggtggtgcacacctgtagtcccagctactcagaaggctgaggcaagacaatcacttgaactcgggagacagaggttgcagtgagtcgcgatggcaccactgcactccagccttggagacagagtgagactctgtctcaaaaaaaaaaaaaaaaaaaaagaaagaaaaatatatctttattttcaatattactgtcagtgcctgaaatcatgccttgttttgctttgtctacaaatatattctttcaaaaatcatccataatgaatatattttccattctaaggtgtacttcatttttggaaacagaaaaatgccaattatcatccatgcttgtgaatacagtaaataattgatctccctacatgttacctttttaaaataaattgaacatgaataatgagtctaatatagtacaacaggtgtttctgacaaatagtattggaaaatgtattgctatttgattttctatttatctgtgaagtccttttaaagatatccatgaaaactctctcttatgaatgtatggctaattgtaaagtagaatcctcataagaccagtattctatgatttcctcttgattaaataaaataaaatttaatgtgacaatggtttgtgtacttttctttccttgtcttctctgagcatctctctagaaataggaaaaaaaaatgggataggttttgtttgggtgatttccactgaagcatagcaaggtcatgcttttgtattgtctattatcagttataatttctcaaaaacagacagcaaacaggcagtgttcaaaaatttgtaatttactatcccgtgctaaagacaaaccacagagtaaaaccgcaacccggttaaccaccaaaacaaccttcaatcattctgactggttctgcatgtttcaacgtttatggtcttttggctgaaggccaaagttcatctcttattaccctttcttttccatctgtgaagatcattgcacacacactcgttctgcattccaaacaatttcacctggcaaaggaactaagtaaaactgtctctcatcttcattactattcatttcatctttcaaatcactgaatcgtgaaaattagaagtaacaaaaaaaagaaatcaggtgtattaaaaacaaaaatttgaaacagtatatctgtgaaaccgctcagtgttagaaattgtcactgatccatgtcaaattcagcaaacaaaactgaggcaatttactttcacattttactaaatggccacttgtaagcatacggatgagattttgtctttccccaggctggatcagtctgttggtttcccaaacagacaggggctgagtggcttaacaggtgtgccaatgtgagaaagaaacacaaaagcagctgttgttaaaggcgttaggtaggctttgccaagactttacctctcagatctcttctgtgaattgatgactaaagtatgtcaactttggaaaaatattcttgaaatattttccttgatttctgacttcaaaaggcaaattataaacaccttaatcaattaatatttactactagaatgattgcccaaaagactgaactaatcaagatagaaaacaaaagtattatggcttattatgtcaatctcctatttaaaaagcctcaacattttctcatagcctttagaagaaacaattttttgtacattgagatcccaattcaatgcctctttttgtccatatctcattgcaactttgactcatatgatatcactttgctgcaaacagattaagctactaatgaagacatgcaattatctttttgtcatctctctctctctgtagctctctctgtgtgtgtgaatacatgtatacttgctcaactaaaatgatcctcacagcctcacatattaagatctcatttattctcaatttgggcttgacttctaacaaaaactgttccttaactaatccaccaatagatggcatattcttctcctgagctttcatcctgtttatcatttacttggtattccaacctacctctatggcattgctttacagatctttaatgtggtctcgcattgatatggaaagtttgcttttgtagatttaacttatcatgtgagtcaatcaaagatttccaaatagttgatgaactttatgagagaaaaggcctgggttttctttctttgcctcccttcaggtacctggtggaggatgctatttctagtagctacttcaaaaaacaagttttctgagttgctctcttatttctttaaccacattgtctctgtcgttctctgtctctctgtttctctctttctctctctattcttttgcatggacaccaaattttgtctcttagattttgaccctcttatctttgaatactggttttgttctctaaactactagttttttgccataactgttttttctttgggattttggactgtatttcttagatctaaggtacagacctcctgcagggacttccatgaaccatatatccattgtagcaatgatcttcattgtcaaaaagagtctaattttaaaagcaaagatttgtcaaagaaaccttttagaatgcaaaatagctaggaattttaattctattaaatatcaacaataacaaaaaagtggtaactatgattattttctttttgacaaaataagttcatcattaaaaaaaccaataatgccaaatcctaaaaataaatttcagcctgtaaaacatacattcaagcatgtataaatatatgcatgtacaataaatatatttaaaataatttttaaatttctagactgttgactagtgagaaactagtgaaactatcgagagttgggaacattccgtgtaagggggtaatgaagttgagagtgataatggtacctctaacttatggctcagactgaggctagattcaccaactttgcatagcgtcctctgcatttagattttctattcaacattcttgcaatatcttgaatgaaggcatagaatggcagcacattaaatttacaaacggtaaagatcaaagaaggaataactgaaattattttgagagtgtggaattctgagctaagttatagtgctggtgtttgaacggagttttaatatgagttttgcctgttaggtgatttctgccaaaaaaaaaaaaaatacgaagtttgcattaatgaaagcagagtattcagctaaaaggaatattcatccttttcattttgaagtttgttattataccatatctggaatgttttgtttacttctgcatggacattttaaaaaaacattgaaacaggagacaatggcatgaaaaggatgatcagaaagatgaaacatttggaattgatgctttatgagggacattgaatatactggaagtatgtagtctaaagcagagaaggctaaagggagatatgatgcaaattcatgagaaatgttcatacctaatatttatgagtcaaatgctaagtataattctcatgactgatccagtgatgaggtaagtgtgtggacacagaaaactgtcacaatgcacagtgtgaaaagaataacagtagttcttacgtcagggtacaagtcgagaaaacgaatgcctctatggattacaggtggagagaaatgtgatctagggaaaaggggaaaggtggtattaggcagagattagaaggtgctgtagtttttgagctggagcctagaaccccacactctctcagcctctgagctgcagccacctcccctgcagctactggagacaccgcagccactaaggctgcaggacctcctgctactgaccgtgggtacttctggtggctgctgccagaaacccaatcccttgtttattctctgggtttcaattttacccccaaacctgatgaaataccgttggcaagggagtcttagaaattttagttttcttattctcagtgattaaagaaaagggcgcagagaagattatgggaatgttagaaggttagttagttaccatctagcacaaatgggattaagtgttagaggtctaggcaggatatatagagataaccaatttaaatggtcaaggaaggttaatatctataagtactttcaggcctgcctttggaaaggcagagtggagttctgtgttgctccagagagcaatagatgatagaagttattaggagatgaaatttaggtatttgtgaaaaataacttcctcataactagagctcatggcaaaaatgtcctgctattttaatatgttgggtgtttgagcaaaagtttaattctatttttttcagggattctctagaagagcttctcatagtaggcagtagatggtttagttggcagctaatgttccttaaaaatttacaattttatgattcccaaaccactcatctaaaaataacaaaatgtgtttaaagagtagattagttaatcacaaaacataaaaggtaactagccaaaagaattaaatatattcatcacgtcttaataactttgaggaaaatgagtacatgaggtgggaaacgaacattaaaggagtttcttatcagcccttttcaggattccaaacttttcttataaatatccatcagtgctccaattaagcctttggagtgatatgcaagaactccatagtggggagggaaaagtgcctccttccacacagatgttggcacagtgctgaaggatggcggctggccagcctgctttacaagtgagggccaggagcagcatctgcatatgagagcagattatcccattggcaaactccattaacactgccaagggcacggttatgctgttagtgactaagaagtcatccctttcacctgaacatacctctggtaatttagggtaataaagaggatgcctttcttttatatgcaagagaaataaagacttgaatggtaataagggagggcaatacatattcatttattatgtaagtaagaaaattcactggtaaataatctcataatatctaatgattggatgatatctaagcagtatgtcgatgatatctagtttatccaccattgaatcccttataaaacagaccagtcagctggtacccagtggtcttacatacagtcaaagatgggaagctcaggatccccacatgcagccaactggaagatgggatagcaaagtcagaaagacctgagttcaaatcttcactatgttggtcattaactatataaacttaagtattttatatcatcgagctaaatttcagtgtgtatacctttaagatagtaatgtgtacttcaaattgttgttacaaaattaaaagaggtaatgtgtataacagctatctcaataaatagcagatgttttaattccaatgtgcctacttcacactgttgttacaaaattaaaagagataatgcgtataacactatctcaataaatgggaggtgttattctatctttcagatgtctctaatggttagaaacgctttatattaaactgatttttttctctataatttaagcctgctaatcctcattatgacttaagggcttcttaaaacaaatgttatatcttttatcttttactgaaagtctttcacatatttgaaaataagaatcgttaacttcactcatcatttcttttatggactgaacacacccagtccctcaacctttccttgtattccgtggctcttagccacctcaccatagcaagaagtgaggcggggaatgtggaaggattgtgattaagtggttgaagtgcagagataaggatgggaaatgcagggtaaaaagcactggaacaggcccagctttgttttttggccaaaagattcagcagctctgatcggcttactgatattcacacggtgctgaggttggcatttttccagaggcattaagcatcattccactcacggttgacagtttccagaaaggtttctcccaaaaacacactctcctttgatttcttcctgaaaatcatgtatctggtactttatcattttagctcatatatccacaggcagccctgggtgaaaccacactttcactaattttaatcatctatacttaagggcttttaggttttttttttaattgggttcattaaatcatactttaatgcattgaaattcaccattttcatgtgtacggttctacgaattttggcaaaggtatgcagtcatgtaaccactgcccccaaaaggacccccatgctccgatgtaatcaatattctcccccaatccttaacccctggtcaccactgttttgctttctgtctctgtagttggaccttttctagaatgtcacataaatgaaactatatagtttgtacccatgctatttctgcttctttcatttaatatgatgctcttgagactgtaagttgtatagcatgtatcagtagttcccttttttgcagagaatttttccattgtatcataatttatgtatgtgccagagttgtttgcttatccactcactaggggatgaacattggagagtttttctttttctttctttctttctttcttttttttttttaaataaagctgcaataagcttccatgtacagatcattgtgtaggcacatgtattcattattgttgggtaacaatgttggagtaaatggctgggtaggatggtatatgttcatttttgtatgtttaattttatgagaaaataacaaacatggttataccattttgcatttctagccaaaaaatataaaagttttagctgctttgcatatttgtcagcaattggtattgtctcttttaaatacagccattttcataggtgtagtgtttttttaatgtagttttaaactgtaattcactcatggtcaatgatgccgaacatttttcatgtgtgtgtttgccatccttatctgccatccttatcttttctttggggaagacagttcagttcgttttctctccttttttttttttagacggagtcttgctctttgtcacccgggctggagtgcaatggcacgacctgggctcattgaaacctccacctcccgggttcaagcgattctcttgccttcgccacccgagtagctggaattataggcgcccgccaccacgcctggctagtttttctatttttagcagagatgaggttttaccatattggccaggctggcctccactccggacctcagttgatccgcccacctcggcctcccaaagtgttcagattgcaggcgtcagccactgcacccagcccagtttgttttgttttgttttgtttattggtttgttttctattattgagttcattatattcattatacataatttgcacaccagtccttaattatataggtttttttgcaaatattttccccacactgtggtttattttttatattttaacagggtctttcaaatagaatgttttaatttttatttatcagtgtttttcctgaccagtttgtattttttatgccatataaaatatctttgtgtaaaagatgtcacaaatattttctcctccattttctttgataatttttgtagttacatattttacatttaggtctatgattcattttaagttggttgagtctttttctgcatatgcatatgtaattgaacatttttttaaataccatattttctccttttaattgccttagtgccttcatgagaaatcaactgaccttatatttgcgagtctgtatccagacactctagtctattatttcctttgtctatatttatgtccttttgcaaacaccaaattgtcttcattgcataacattagaataactacagaaatcagagccgggtgcagtggcttatgcctggaattccagcactttggaaggctaaggcgggcggatcacctgaggtcaggagttcgagaccagcctggccaatatggtgaaatcccatctttaataaaaatacaaataatagccggctgtggtggtgcatgcctgtaaccacagctacttgggtggctgaggcaggagaatcacttaaacccgggaggcagaggttgcagtgagccaagatcagccattgcacctcagcctgggcaacaagagtgaaactccatctcaaaaaaaaaaaaaaaaaaaaagaaagaaagaaaaagaaaggaaaaaaaaagaaatcagttaatgtgagtcctccttagttgtttcactttctcattttttttttaattccattctagatcccttgcttttccatataacctttagaatagctggatcatatttgagattgcattgaatgtataattcagtttggaggataattgacaatctaacaatattgagtcttcccaaatatcggtctattatatagctccatttatttaggccttttaaatttatctcttttatgttttgcatttttaagcccacatattttgtatatattttcttcgctttaatttttgtttgtattttaaactgtactttttccctcatttgatcatgaattgttatttctaatataaagaaacataatggaatactttttgtatcctatgaccttggtatactcactagttttagcagcttttctgtaaagtgtttgggattttctatatacgccaccatgtctactgtgaataaagaaaattttatgtttgctcctttccaatctatatgccccaattttttatttattcatttatttatttatttttgtagagttattacattgattaggacctctaggtgaatgtggtaaaagcaagcctccctgctttcttcccagtcttaggggaaaaacgttcagtcttttcccagtaagtatgttacctgcaggcttttgtagatactgtttatcaggttgaagaagttcttttctattaccagtttgctagggtttttattataagtgactattgaattctgttaaatcatttttatcatgcgtaaagatgagcatatactttctcttcttagtttgttgttacaataaattccttttttttttttttttttttttttggcacagtctcactctgtcgcccaggttggtgtgcagtggcatgatctcgggtcactgcaacctccgcctccggagttcaagtgattctcgtgcctcatcttcccgagcagctaggactacaggcacgtgccaccatgccgggctaattttgtattttcagtagggatgggtttttgccatgttggccagactggtctcaatctcctgaccttaaacaatctgcccatctcagcctcccaaagtgctgggattaccggcgtgacccaccatgcccagccccatggattggtttttgaatataaaatcaacactgcattccggacaaaactccacttggtatgatacactaaatgttttatatattgctggatgtgatatgtaaggatttttgtattcatattcatgaaatatattgatctgtagttttctttaacataatttctccacaaggttttctatgtactaatggtggctcataaaatgaattggaaattctttttctttattgttagcaagattgtttagaggtagtaatatttcttccttcagtgttggaaaaaattcactattgaagtcatttgaacctcaagtttacttttttgcaagaagttaaaccaataatttatttttttaaatagatataggactatttaggctgtttcttcttcagtaaatattagtttgtatctttgcatgtgtcgacttcatccaagttgttgaatttggggagcataaattggttaatagtactctcttgttatcctttttgttttgttttgttttgtttgagatggagtcttgctctcgcccagctggagtgcagtggtcagatgttggctcactgcaacttctacctcccaggttcaagcgcttctcgtgccttagccttccgagtagctgggattacaggcacccaccacaatacccggctgatttttggatttttagtagcgacggggtttcaccatgtgggccaggctggtcttgaactcctgacctcaggtgatctgcccatcttggcctcccaaaatgttgggattacaggcgtgagccaccgcgcccggcgtcttgctatcctgacatttatcattcctttctctctctttctgtcagtaatctggataacgatttattactattattgattgttacaaagaatcagctttaagtttcacttattttctctattattttaatctgttttcaagttataatttccctgtgactatgtctttgacccttgggtaatttagaagtctgttctgtaattttttgttttgtttgtttttcatgtttggggtttttaagatacatttcggctgggtgcagtggctcatgcctgtaatcccagcactttgggaggctgaggcgggtggatcacctgaggtctggagttcaggaccagtctggccaacatggtgaaaccccatctctactaaaaatacaaaattagccaaatgtggtggcgcatgcctgtagtcccagctactcgggaggctgagacaggagaatcgcttaaacccaggaggcggaggtggcagtgagccgagactgtgccattgcactccagcctgggctatggagtgagactctgtctcattaaaaaaaaaaaaaaatacattttgtaactgatttctatttttaattttataacacttttaaaattatattgtcttaaactgacataaaaatatttatgtataatatgtaaattattacaaagtgatgcttcagtacatatactgtatattaatcagaatgggataattagcatacccatcatctcaaacctttgtcattacattatgttgggaacattcaatatcccccttttagctatttgaaactataaagtatatgattattaactataatcatcctaaagtggtatagaacactagaacttattcttctcatctagcagtaatattgtatcctttgataaatctctccctctctctccctgttccctaccctttccagcctctagtgtcttctattatactttttacttttatgaggtcggctatttttagcatccatatttgagtgagaatatgtagtgtttaaggatcctgttcctggcttatgtcacttaacatagtatctattagttctatatacgttgccacaaatgacagaatttcactgtttgtttatggctaaatagtattctgttgtgtatatacaccacattttctttatccattcttctcttattggacgcctaagttgattccgtatcttggccattgtgaatagtgctgcaatagacatagagatgcagatgtctttttgatatactcatttcatctcctttgggtaaatgccaagtagtgggattgctggatcatattatagttctatttgtaatttttgaggaacctctatactcttctccactttggctgaactagtttacattcccaccaacagtgtatatgagttctgttttctccacatcctttcaagcattggttacgttttgtctttttgataatagccatcctaactggggtcagatgctatcacattgtggttttaatttgtatttccctgaggactagtggtgttgagcatttttcatttgttgcatatacatgtcttcttttgagaaacatcagttcagatcatttgcccattttttaatcaagttgttttgctgtttagatgtttgagttttttgtgtattctagatgtgaatcccttgtcagatgtagagtttgcaaatattttatctcattctgtaggttgtctttcagtctgattgtttcttttgctgtgcagaagctttttagtttgatatgataccatttgtttatttttgcttttgttgttgtacttttgaggaactttttgttactcataaaatattttccagaccagtgtcttgaagaatttatgctctttgcctccagagatcttataatttcaggtcttatatcttggtctttgttctattttgagttgagctttgtatgtggtgagaggtgggggattagttactttctgcaggagatactcagttatcccagtaccatttattgaagagcctgtcctttcctcaattagtgttttcagtacatttgtcaaaaaatcaattggctgtagatacacagattagtttttgcattctgtattttgttccattagcctatagatgtttctatgccagtaccatgctgttttggttactatggctttgtagtatatttttaaatctggtaatatgatgcttccatatttattttgttcaggatttatttggctatttgggtcttttgtggtttcatacaaattttaggattttttttctatttctgtggagtgtcgtttgtatttttatagagaaggcattcactccacagattcttttcgatagtatggccattttaacaatgttaattcttctgatacatgagtatgatgtatctttctgttcatttgtatcctcttcagttttttcatcagtgttttgcagttttccttttaaaggttttgtacctccttggataaattcacttttaggtttcctctttttttttttgtacactattataaattggactgtcttcttgatctcttttttttagtttgttgcttgtgtatagaaatgctatggattttcgtgtgtcgattttttattctgcaattttactgaattggtttatcagctctaagagtttttcagtagaatctttaggtttttctatatataggatcatgtcatctgcagacaggaacaatttcacttcattcatttgaatgtggatgccctttaattttcatttcccaattgctctggctgggacttctagttctatattgagtgcaagtggtgagtgttagcatctttgtcttttttccagttctgagaggaaaagattttagcttttgcttctttggtgtgatgttaattgtgtgtttgtaatatgtgccttttattattttgaggtaatttccttctacacctattttattgagatttttaatataatggcatattacattgtattaaatgttttttctgaatctatcaaaatgattgtatttttgtctttaattatattgatttaatgtatgatgtttattgatttgtgtatattaaaccatcctcacattcctggcataaatgccacttgattatgttgtattatctttgtgatctgtgctggatttagcttgctagtattttcttgaagattttgcatctgtatttgtcagaggtattggcctgtaattttcctgtgtgtgtgtgtgtgtgtgtgtgtgtgtgtgtgtgtgtgtgtgtccttatctggttttgttattagatttagactgggcttgcagaatgagtttggaagaattccctcggcttcaattttttgaaatagtttgagaatgatttgtattaattctccttcatagattgaatagaatccagtgatgaagccatccagttaagtacttttcttttttgtgagactttttattactgattcaatcatgttacttattattggtctattcaggttttctccttcttcctggtccaatcttggtaagttatgtgtctaagaatttatccacatcctctaggttttcaactaggttttcagttggtgtatagttgttcatagtagtctctagtgatcctttgtattatgtggtatttgttatgatgcctcctttttcatttatgatttttatttgggttttctttctcactttattgctagttagcccatattgtatgatttcaatcattttaattcttttcaaattcattttttgtctcagaatatggtctatgttgttaaatatttcatgtgtacctgaaagtatatttttctgttcctgcatattctataaatatcaaataaatggatacaataatactttcctgataatatattttgaatgattcaggaaaacttaagaaacgtaagggttaattatgccactaattaaaaaattcagaaactttatgacaactttcatctctcatagccactttgactgcacagtggctttgttctcaaagccttgaaattgagttattgggatgtagtagaagcagtttgaagaacaggcagtaagcccaccttctccattagtatgttctatttactttgacatggagattttgcagtagtttgacacaaatctgaatagaaacctatttaatttcagacttctttacccactcttagaatttttcttttgatagcagataaggattaagtaatatacacaggagacagtctaagaagcatatttatttaaatataactttgttataacatcaattgcgtgtaaccaatctcatgccaaaaacaaatgcaaaaattctgttgcttaggattttactttatgtgttttaagtatatattgaaatgtacttcagaacatgtgctttttaaaatttatccaactttggtaattttggtttttgaacatcccgtagatacctaaaggactcctttggagcagcagtgctatatggatcacacttcaaaagtgtaattctggggcagcaatatgaaggtcaaaacatctccctccaactaggaactggatatttaaaagaggttaaggaaatttgatgcactgtattaaaaattgtttcaacctttttttaaactttagtgtaagtactacaacattttactaagcaaatttggagttctaatttaaccgttttttcatgttctttatcttagattctgaggacaaaaagcaatgaacacagctttttagtagctatttcctttcaaactctctggagagcaatcaaattttgtaatctgtaaaagaacatacattaatgttttgttcaaagagaattcaatctataataggccttttaaagaaatatgtataaaggcccgctgtctgtcctttttgatattttagtgtatgtatttgttcagtgtagttttgtttctttttaagaagctaatattttaggaagaaccagatactactaggccaagtacattctttttgtgtaactagaaatttcaggtcttttagttttccccaggcaacatctgctaagaacatagcattagttacatactgcttggaccaaccccatctttgaatatcacttgtagacatagtcacctaaagaagcaactaaacgttgacctaggggtccactttggcaattttgcctgcacctcattccagcgtatgccatggactttttttctgtttatgaagaacgtagccagagatagtcctaaaatagaagctaagggaaaaaaacaaaactctcacttctagatgtgcgaactctagcaaaaaaaaagttttaaaattctgccctgtttatagtcttatagacagactcggattaaaaaatatactttaactgctttatttcataataaaacagagacttttccacaaacttgggaagtgaatagaagcaatccactttaatgtattcctcagaatgagtatattctcacgtctcaacttaacaggatattccacatgtctatgttgatcccatcactctcaattacacaaggagaccagtactgccacaattccaagccagagggagcagtccatctttcacagccaagggaaggactggagtgagaggaccattctcactatagtcatagctagccactcccacactggcaactgaggctttgctccgcccagtctggtagactacacttttctattcctaagatccctgtcttattcatgtacaagagttttgagagaaggcaaccccattcccttaatattaagtttaattatacagtttccacctgttcacttcaatagtggtaattcttaggacctagcactcccagtttataaacacaacgaacttcaaaggtgccatccagctcctcaaattcttgaccaggacagcttatctcagagttagaaaactcccaacccttctctctagaaatgtcttcattacattaagagacttttcttcttaaactgtaaaaacaaaacaaaagtaactgattagtatcctctttctctagacagtgaagtcattagtctactcctggaggccaccatgagttacataggaggtttcccaagacccatcacctgtgtgaaggtctatatacctagactttggaaaggaatgaaaataagaggcaagctacttttagtctctgtctttgctatcatactcttcctttaaactatttctctctatcccacctctgtctctttctttttctgtctccctgtttctctctttttttgtcactcacacacacacacacacacacacggacacacatatacaaaagcaaccctgtaaaaatcactgcttgtgtaaagcctaaaccataattggggttagaatttggagctccactagttacgcagagaatgatttctgtgggttcttaactttctaagcttcaaatttcccatacataaaagtgatagtctaataattgtgaactcaaaaattttgtgataaataagttaaataattcctatacagccttcaggacaatgcctaaaccagaataaaaataaagataatgataatttagccttatatttctccttccattttagtcaaaatatttttaccaatccacagatacagtattctctttcttttcttttcttttttttattttgtttttatttttatttttttttgatggagtctaactctgtcacccagactgaagtgcaatgttgtgatctcagatcactgcaacctccgccgcctgggttcaagcgattctcctgcttcagcctcccgagtagttgggattacaggtgcctgccactgcacccaaataatttttgtatttttagtagagacggggtttcaccatcttggccaggctggtcttgaactcctgacctcatgatctacccacctcggcctcccaaagtgctgggattacaggcatgagccactacacccggctagtagtattctcattttatctgaggttatctccacattgcacacacccatcagagatgctctctctcatcctggtgaaacataaccattccaaaacgcagtgaccgttcactcttcagcaaatctttcttagttgaaatagccctcactgcttccctttttctcttattcttacacacatctcaaaatcagttctctattagttccaggagttgtttccttgtccttcgagtaattctacatagacaatcatgttatctgtgaacaaagacacagctccaagggtgagaacgggagctttaaaatttcttaaagctcatgcctatagaagtcattcagtgccatctctgcatctgcatgcattctcttggccaaaacaagtcataggaccagtgtagattaaagatgtgagactgcgggagaggagaaacacggcaaagtcacatcacaaaaaaccacttggaatgggaacacgggttatcctcctttttgaaaacaaactgtgtcactaatattgtcagtcttattattacactcaaatggattacaagatccctaagagtaaaaagccatagttttagtatttctcaaataggtacaatgcactgtaatgttggaatgtgtctttagaaagataaaataaccaaacaatcataacacattattctcaaaacttattttatatttttgttttaatgtgtacaattgcaatctcatatttgtgttagaatcatttgtttttgtgtcttcatgtttctataagataggaccaatattctttattgggctttgattttattttgtaacttaaatgtattaaggcaataaatgtaattttccacttaaaactatcattatagatttggttactacctactgctcagcaattttttttcttatcaaaattcttcctggttggtttacttctcattttttttccattaaatgatataaattttaagatagtagtttttcttgttacattagttcagaatcatagattcatgcataatagctttgatattcaaataaccttcattggtcttgatacttttataattttcatttcagaatcccttattgccttccattgaattcttctggtttgtgttataacatttcctgtaatttgtaagcaatccattctgttttcaaaatcacttgtgtgtaaatttttctcattaccatgttcatttcagttttaactaaagttcactcataatatgtcatacataaagaaacacttaaaatatattagaactatttacattctatatataatagttatgccagaaacgaaacagaaatgttgaattaagtttagcctaaagatgctgtcttatgtgttttaagtttggcctaaaggtttttccatacatagtgaactgtaacctaactggatgtgtaaacagagtatagcctactcttgtaacaagtagccaagtctcatcccattacgacaaccatacttcaatcacacacagggtccacctgttcaaactgtgtttgaataagccagacaccagctgtaaccaatctggctgtttctgtgcctcacttccgttttctctatgtagctttcctttgtccatacatcctttccaaacctgcagtggagcaccatgctcagctaattcttaatttttttttctagagatagaggtcttgctgatttgcccaggctggtctcaaagtagtggcttcaagagatcttcccaccccagcctcccaaagtgctggggttataggcatgagccattgcacctgctggagcactaatttctaaacaaacaaacccaagatcaaattagccagtcagagtgtgtcctacttacattctgtacataaccctactaaaacctttatgtacttactgttatgaatacttttagttcgtccctggcagaggtgctaaatttcattccctgatatttagcatgatgtcaccaaatcgtagttgtttaataaacatttgcgtaatgaaagactgactgaatgaatgcatgaagtaactatcagctacaactactaaactaacatgaccaagattcaaaggaaactttctaaaatcttcaaaaatctaagttctagtgctctttcaagacctcagaactgccttagagagtttaatggaaataacatacataggagtatggggaaaagtgctatttacttagcaactatgtgtcagacattttataagtagtgtcttacgtactttcttagtaatattttgaagtattagtagatagcatttatctaattttagaaataagaaaatggaggtgggctaataagttgtttaagattccaaacattctgtagtaaaaccagtattgatcctaatttgatggactttaaacctgctgagcctctgtctggtggaggaaaaaaaaaattaaaaaaaaaagcatttttcttccttcttaggttcagtggctgaggcctgtgaattatactgacaaaagagagattatcaagaataaatatttatttgatgtgtaggggctggggaggaacaggggcagctcacataaaagcaaggaataccccaaagaggcagttggacccgggccctgtatcccattttaacaaagtgtgataaagtgtggggaagagactagataaagaaaaggagggtttaatccctgggtggccggagtaggttgtgggaaaatgactaggaaatgtgtagtaaataagggctatttagtaaggtttgttatgcaaccttaaggcatctcaggtggtgacttattcacttctccctgatataagaaagtaggacacctttacaggtataagtttcctttacaaccagaaaattcatgccttgctgaagacagttcatcttgtgtttgctatttctaattgccttcagcttaaaatactccttatgctaaagtggcatattttggggtagcatattctgatctctttcaccccaaccaacaagactgtggctgttggcaggcaaacattacatcttatttatttacacttctctgatgtctgtaacagtgcatagcacagagtaggtatccagtagatgtttgagaaaaaaaaaataataaatgggataattaacatttttggcttctaggagattattttcattccaaattggccttctcccgctgttttttcccctcatactggtgacataccctcctgtttggtcagaaagaattctgatcttggatcatctgaaatacatttactaaaaaaacctgatatgtatttacatattgaaagcacatctgacttaacatttaggagcatgggctagcaatcttactagtttcaagccttggctccaccaagtgacttgctctatgaccttaggtttcatagcctcttaagtctcagctattttattttaaatgatgggcaaggctttttgctgtttggtttacttataagtcctgagtgcctgaaacaaaataagtattcagtatgtttggttgaataagtgaatgccatgtagtacctattttggttgtcattggctttaaagaggtgaatatactttaagtggttcaagagctcccacaccataggagcttaataaatgttagccattttattatgtaagtataacccttcacacactttcactagtcatttgttataacattgactttttcaaaagttctgtggaaatgagttataagactatccattgttgaaggcaatgttcttagttgtattcattgttatcaatttagtcattaaaaaacatttgctttccttatcaatacatatgcttcattttattagtaagtagaatttcataacccatcctgttttccatttctcttgcatactaggaaacacaaagtgaaatttggttctcgagctagttcagtcacataatgttgttggtaaaattatctataacatttggattcttttggatataaatttgcccttgataggctaagctatattatattttctataatcttgtgttctataatattctaaaatatcgttctgtaattattttatgagaaacattcttcataaatatgaaatgtatatcataaatcagtttgtttatgatatacatgtttttcatgtaatttaatgatttaattgtaattatcaataaatatgcgaaatctaaacattcattggcaaatatagtagaaactataatgaattggctatagtgtttctcatgttagacattgttgacctaaaaagaagaaactgaggtgaaattaatggagtgtttatctgggcaaagcttgaagattacaacctgggagcattgattcaagttttcctaaatgtacactccaatttgtggcagctacaagtgtttgtgttcttttttttaataatttcaactttcattttagataccgggagtatatgtgcgggtttgtaaacatgtgtatattaagtgatgtggaggtttggggtacagatcccatcacacaggtagtaagcatagcacctgtagtagtctgttttcatgctgctaataaagacgtacctgagaatgggtatttataaagaaaaagagatttaatggactctcagttctacatggctagggaagcctcacaataatggaagaaagcaaaaggctcatcttacatggtggcaggcaagagagaatgagagccaagcaaaagaggaaatcctttataaaaccatcagatctcatgagactttttcactaccatgagaacagtatgggggaaactgcccccatgattcaattatctcctactgggtccctcccacaacacatgggaattatgggagctacagttcaagatgagatttgggtgggtcacagccaaaccatattggcacttctacactaaaaagtatccaagacaagtctcaatcaatttagaggtttattttgcaaggttaaggacatgcccatcacacaacctcaggaggtcctgagaacatgtgcccaaggtggttgggctacaacttggttttatacatttagggagacatgagacatcaatcaatatgtattaggtatatagtggttcagtctgaaaaggtgaagtgagggacttccatgttatacgtggaactggaagtgggggaagtgggaggcttccaaactggaagtggggttcttccaggttataggtggatacaaaggttttctgattggcaattggttattatctaaagacctggaatgcatagaaaggaatatcttgtttgtgataaggggttatagagaccaaggtttgatcatgcagacaaaacctcaaggtagcaggattcagagagaatagattgtaaatgtttcttatggaacttaaagagtcacttctattggtcttgaggtctgcattggtggtaacaaggcatattttcaggttaccttcggaatgcccttggctgagaagaggggtctattcagatgactgggggccttagaattttatttttggtttacatatccaataggtagcctttcagcccacagtgccctccctctctctgtcctctagcagttcacagtgtctgttgttccgaggagtgcccaatgtttagctccttgttataagtgagaacatgctatagttggtgattttttttttttaggagaaagaggcagttcctgaattgtttactaagaatttacataaaaatagcttaagctattgattagctatacgttgttctctatatcagaaattccagaaacaagaggataaggggtgaagcagctaatcaggaacaaaatgaattgaaataattgcccccagacgtgggtgcaggggttgggatgtggagtgttggagggtgaaggcatgactgatgtcccacgctcatatctctctgggcctgcatacctcgcatagttcatgctattctgagctattttacttttctcaacatttagatatttgactatagaaatgcttataaatataatttatacacatataaatggcatgtttgttatttatttagtttgagctggagacttgctctgtcacccaggctggagtaggagtacagtggcacaaatcttggctcactgcaacctctgcctcccaggttcaagcaattctcctgcctcagcctcctgagtagctgggattttaggcgaccaccgccacacctagctaatttttgtatttttagtaaatatggggtctcaccacgttggccgggctggtttagtctcaagctcctgccctcaagtgatccaccaacctcagcctccaaaagtgctggaattacaggcatcagctaccacacccagccataatgtcatatttattaccttaattatgatatttataattttcaaatgcagtcttttaaagcaaaatcaagagatattcaaggacctttgaaaatgcaaaacaattatttatatttttaatgtgccttagaaatagctcaatttacactgtcgaaaatttgcatatataatttagtaaggaataattccacagtactcagtaggacctattaggtttcactagaataatttatattagtaagtcacaaattaatgcttatggacttttcaaaagtttatgtgtttcaagagaaagctaactttgcaaaaagggtttatgaaatcatctaattaattcatacattataaaaaccacattaacaatctctcaattttctttcctccttttgtatagacaattaatatagaacattttaaaatagactatttgaatattgaaaatccaattacaggtaaagtaggtggagtaatttgaaattgcattctaatacttataataaataatttgttttcagatcataaattgcttactataaagcttttctaacacttataaaatttatggcaacttgagtatttgactcatcatgtcacttttcaggattgtctttctttttcaggaatattaggtgttctttgttttaacttttaagttcaggagtacaagtgcaactttgttacataggtaaacttgtgtcttggaggcctgttgtatagattatttcatcacctaaatattaagcctagtacccattagttattatttctgatcctcttcctcctcccaccctcagccttctgataggccctagtgtgtattgttccctttatgtgcccatgtgttcccatcatttagcttccacttacaagtgagaacagaggcagtgtttggttttctgttcttgtattagtttgctaaggattatggcctctagctccatccatatccatgcaaaggacatgatcttgtttcttttttttttttttttttttggagacagagtctcacattgtcctgttgccaaggctggagtgcagtggctcgatctcggctcactgcaacttccacctcccaggttcaagcaattctcctgcctcagcctcctgagtggctgggattacaggcgcccgccaacacgcccagctaattttttgtatttttagtagagatggggtttcactatgttggccaggctggtctcgaacgcctgacctcatgatccgcctgccttggcctcccaaagtgctaggattacaggcgtgagccaccgtgcccggctgatcttgtttctttctctcccttccttcctcctttcctttctctgtcttcattctgcatttatctttccctcttttctctgttaatctctttcccttcgtttcttctttcttttctcttttgcctgtattcccaattatagcggtaacattacttgacttcaattgatgggacttttacagtttaaatctttatacttatttatattccaaattaattataagacattcttttttttaagacattctaaactactttttgccttgaaatgtcagtaagaataatatctaagaaatgtgtcctattttagtcatataaaacaaatgtatcaatttacatttatattttcatttaaaaatacatatgtagaacatgttatgtgtcagaaaccatccttagaagcacttctaaaatgtagcggatttaattgtcatcattaaattattaaataagcataccttattcatttcagttaggtattattattatgaccactttatacatgaggacttaaggctcaatgaattaggtgattttgtcaagggcagttcgtttgtgagcaatagaatcaagattcaaacctagacttttggattatgtaaccacatgttatgtgtggagggaaatttaaaaaacaaaacaaaaactccagacaccaaaaagcaaacaaaacccctaaacaaaagctaaaagctgaattctgttctttagactatgtctaaatattatctgtcagtttttacacctcttttttcttaacagatgactggagggagtgttgtattatagtataatggaaaaccttcataaccttgattacagcagctgaagaactcttgagagagaaaaaaggaagatagagttttgcctcattctctccttatttagtgttctcagaagtcattcttaatcttttacctcaattatccttagttcatttatgaaaaaatacaaaccattcaaaccctctgtcatatcatagcgtatgtgtgacttgactttatgagtgaaggctttctgtacgtgtgttctgaaataaaagcttaatgaaaacatctatttccttttctgcagtgtgcagatgataataacgaagcatgtggcaatgctacagcagttatagtcacatggatccgggacatactagaaagaaacatgtcactgatccatgggcctgtaagtgacacaagcaaaggcattcttacataggttcactgcatctattatttatctgatagaacatgtgtgaaggtgttacaagagtgctggacttaatatggattactgtggaacttcctatcaaagctgatgagatgaatactaaaaaaaggttaatcaaagtttgacactggcccttacagaagccagagctactaatttccaaatgctacaacttttgaatactctaaaataatcctagtggcagtgtcaacagagtgctatgggaaaagaaagtgcggaggatcagtgttggcttaggggcctcagaaagcgtcacagaaaaaatgattgtttattgcagagaaaggagagaaatcaaacagggtgcaacaagtgctaagtcatggcttgtccagaatactttagaacttcctgtatagttgagtcttgccttttgggagacaggaggggttgggaaagctaggattacaaataaaattggtgatattcagattatagttgctttgagaatatgcagttatttgggggtgtttagaaatggtgttattcatggacacatagagggaaacaagacacacagggtcctgtgggtggggggtggagggtggagggtggcagggtggcggggggagagggtagagggtggaaggtggcagggagaagggtggggagtgggagggtgggaggggtgggagggtggtgggggagggagatgggagggtggggggaggtggagagtgaaagggtggtgggggatgggagggggtgggaaaggggagagtgggagggtggagattgggagaaaagagaggaatgggaaaaataactaaaagtaattgggtactaggcttaatacctggatgatgatataatctgtacaacaaacctccatggcacaagtttacctatgtaagaaacctgtacccctgaacataaaataaaggtttgaaagattaagtgccttgctaaaagttagagaatatgttaatgtgttatattcagaaagtaagagcttctaatgctttctactcccttccccacaataattatgctagttttctattcatcatctctatctaagtattccacatagtatttcaggttaatgaatatttttatatctcctatttccagataaaaccatataaagttctctcaggtcagacgcacagaaacacatgtataagctacatcatcatatatcatcactttggtgttttaagtcatagaaccattgctcactgtagaacaagacagcaaaaatgatgctttatgaaaacagaaagtaaatttcacatctatcattcatcttataaattctttgtatcaaaattttaattaattagagtgacctagtttcctcactgtggaagaacaatatatgtatatacgtatgtatatgtatatatatatatttttaatgtaagtactctctcatccaggaaatgttccctgttgagtgataagcctagtgtgagaacataacgttcagccagcaaaggttatattacattaatctttgtacactgctcaatagttaagaggtttggaaccgtttatagtaaggaccatgctatcaggttttatcagtggcttattacataggtgacaatcaaaacattattgccaaacttcatgttagttcacagatttaatatctaatatacattttacagttatttgaggcaagttaccttcatttctgggttgcacacgtatcactgggagaaaatgcaaagtacataccagagaagaggtgagttccctttttcaagcagtgcaaaccacagaaaaacatcaagcaaaagatctaatgtaactctgttgtgaaaagagttgtacaagttgtactagtaactaaaatacacctagaagaaaaaagatttttggtcaacagacatttcagggcaaagatatttgcattgctaagcagaaatacattatgcataatcggttaatagataaggaagaaaaattcaatattaaagaccttcttttgtacccaatgtattataatctgagctagatgtgttccatgcactggattgtttcatcctggtagtaatttataggtgggcattatcgtctcagttattatgaatacatactactgacatggcagaactgctattctgtcaccctcacattaatctctctctacttcctgtgtttgtatacatatataacattgtatataaagtctttttcttttttttgagacagagtctctctctgacactgaggctggagtgcagtggcaggatctcagctcactgcaacccccgcctcccaggttcaaatgattctcttgcctcagctttgccagtagctgggattacaggcacctgccaccatgccagctgatttttgtatttttaatacagatggggttacaccatgttggccaggctggtctcaacctcctgacctcaggtgatatgcctgcctcggtctcccaaagtgctgggattacaggcatgagccaccatgcacggccaagtcgttacctaaaatatttcagtgatttggcggggagtgggaatccttgttgcttaatattttcctcaataaaagtgtcaaatggttaatctctttatagattatcttccttttgatatttataataattatatttgaaactctcagaagaccagatgaactcaaactacagtgccacaagagacattggaaattctgtgtgtcataccggacattaattatatttcaaataacaggaattcctttaaacaggctgaaacaataaacatacaaagagtttactcagcatttattgtgtgttgtgcatttgtatgtttgttcaatgagtcacttaccccataggagaagtttagtcacaggatttttcagaaagcctaagagggtcatgaatgaaaatatcctcctattaagatattaagcctatcacatgtggcatataagtgatgtgaaattcatgctcttaagtgatgtatttcaaaggacagcctgtttcaaggtatggtaaaatgatatatgtacaaatattgccctgtgggtgtgtagaactgaggctcttaatgacactttgacgatttgtgagactcttgccatcctgtaaatagtcatagcagctacacctttcactggaaacagggaattttcccaagatctgtctctcaccttctggttcaaaaattcttgctctcctttgacaagcccgtctcttgggttacggctctctctctagcaaatcctccagaggataacaggagagtctgtgcactgactttcagaggttcccttgatccattgcttttgagctgaatctaatgccatagtgcagaaccttacactggacctgttgccccatgattttgattcccagaagtggagatgttggctaccataccatattccaaaatataagatgagttcacaaaccagctgaagaactcacgaggaagtgtcagggcaaaggcaactttaagaactgctgttttcgatgagctaagtgagaataaaacaaaaattcccctatttatgtatcaatagctatgcactgacagtttttacaagtgtaattatacacaagcaaatggaggtaaaaaatcaaaatatcctccagaaccagatattcttgaatttaaagacttatttgactactctaaatctctgaaaacacttctagtattcaaaaatgtggcataacttatgtgggccaactaaactagaaaatggtgagttttaatatttatatgatgacaagatcaccatgacagaatagaatgttcccaaaacagcttcgagcaataatagatccagcgcaaaaaaaaaaaaaaaaaaaagctggaggatttagctctgccagttattgactatgtgacctggtgcaattactattattacctatttgacattttcaaatcacatgacttacttcacaagtaagaacaccaatgtccctaccgaggtttgttttcaaagaatcaggaaacccaactccagaaagtgctattcatactgttttcatgaatggtgctccgtgaccttgataacatatgtccctagagctgtaagccatggatttggctttcagatggtgtcaattaaataatgtaagctaaagagccacagattttaaaatgttacataaatcttactgagaaagtgattaaaaataatcatcttcaagctcacaccaaatgacagttaatacagagtattttagtcctcataaataataaaaacaagaatgatgcacaggtaccattattttcaacattgttctaaagatgaagaaattaaggtatagggattacacatctagatagtggaggagtgaattttgaaacccaaacgagttgacataaaagaatgacaaccttttaactgccaagctgtatccactatcatgccgatttcaaaggatagcatggtattgtgccgctttattttttgtaaaagaaccaacaatacatgcaacttgaaacattcctatagatagatgattttatgattgccagggtgtttgagatgacacacaaacaacatgcatctcagattactgaatagaacagagaattgcatggacatatatgaacattatgtatcattagggttttggttcatctttcaagtcaagctggtacaggctggttgacatttcctggtaaaagggtgggagaaccaaaaaaatacatcctttctcagatatgacttttgtgactatcttgagaagaagaatccatgcccgatttatctctgcatttctgttttcacacagaacaaataagtgctgaataaagtttatttgaatgaaaaacaagcctacgtagtaataacaatgtggaaaggagtaattattctgtcctgaggtgcaaaagatggtttaaaaaggtttctaggtgaattagaaaaaaaaaatgcttttgacatctaagacatgtgtatatccattttccttactgatatattttctattaaacttagaaataattatctgcctaatggaaagaactgtttataattgatgtatgtgaaaatgagctgaaagaggaaaacattcagtctatatctctacagttatgtgttcaatggtagtattgatactagcaaatgtatttggttcttctactttgtttaatctatttaataacacttagtgtaatattgaccttgggattcagaaaaaaatattccaggtgaggcatgatggctcacacctgtaatcccagcactttgggaggctgacactggaggatctgttgagttcaggagtttaagatcatcctgggcaacatactgagacactgtctttacaaaataattttttaaaaaattacccaggagtggtggcatgtacctgtattaccttgggaagctgaggcaggaagatcccttgaacccaggaggtgaaggctgttgtgagctgtgattgcacactgcactccagcctgagtgacagagtgagaccctgtctcaagggaaaaaaaaaatcaaacaatttttgaagtcagaatagagtagcagtgcgattgtacgtagcctgtatgtgttgcgtgtgcagaatgcaacatatttccatggctacttccgaaatttcaatcatcctcttccagaatttccttctccagttaccaacaaatatttattagggaataaatatgtgctagccactgagatacaaatacagacttatgtactcctctcctagggactgtattctaccatggaactagatcttctgtaagatcgaggcacagatcatcggcaagtctaaaaggaaattaaaagataatttttaaggagttctaattttccttcattgttgatgacttttcacagtattacttccttgttggtatatgagaacaaaatgctggcttgtcacatggttcttagaaagactgtctagtcataagaaacattacttgacttacttaattctctggcagttttataatggcatatacaatttctatacactactttaaaatggagtcaatgtaattttcagcaaagctttggaacagattcagccaatgtttgtcgtaacatagggatgcatgctggaaatggttctctctgcttctgtggctgggtgctcctggagccaatgctatactgcaaaaatgaagcactatgttgatgatatttctttaatcaattattctgccaataaggtgcgttagtttatatgcctaactagcattcttcttctgagcgaggtgcatgaggtacctgagagatcactattattgtgtcattgaatcatagttctattattttcagagaaaattttcatttctcaacggttaaatgtctctacaattcagtatgtctcatgcctagctctctaaagccacagaacttatcaaaactagtcttaatatctgtaaatactgactgttggttaaaagtctaggccctgtggttaaactgcctggaatgaaatcttggcttagatactaactaaatatgtgatcttgagcaacataatttctctctgactgagtttcctaatacacagaaagagaaaagtcacaccagctatatagggtcattgtgaggtttaaatgagatagtacatggacaaaaatgtcttgccaaagtaagcacgtaacggatattagctacagtcctcatcattgtctgtgcccctttttgtcgtgtatcaccatagaaaagaagggaacgactcgacttaaaagttttctggtagttcttatctaaatgatgcaaatagatgaatttttaatacatggatgtggatttgtgatatttttaggcttttgtgtttgcacagataattatggctttttaaagaatcaagttatcagatcatttcattttcagatattaaaaaataatgaaaatggaaaagtacattgaaaatgtgatcattgagggaatatatttagcaataaggagatgacaatgcaaccaggaggggcgaagagagagacagagatataaatgagcaaaactttctttgcttttgcaagatctgttgtttataggataagcccagttgttttgcagtctagcactgatgctttccatgggaagagcacaggctgtgtatgtgcatgtgtgtgtgagttcaagtggttttacattactaatgaaacacagacttttcccaagataatcaactggggattataatttacagcaaagaaggtgtaggtgcagaaacttaatttctgtggctaaaaacagctggaagtaaagatgtcgctgaaaagacattgttggtccctaagctagtattgaccccacatggagagggaatcccacagcattaaataggcgtctgtagacacaaactgccatgaagtgattcatttataaggaaggtactaattttaaataatactcaaatcattgttaatttctgtactatttaatagtattaatcagagtgaactcatctgatacagcaataatcataagaactgttctataagtttcatttcaaattctgcaataatcattgtgtcatcatgttatcacatactgttatgcgcatccatgtgaagcgaccaccacacaggctttgtgtgagcaataaagctttttaatcacctgggtgcaggccaactgactctgaaaaaggagtcagcaaagggagataggggtggggcagttttatagaatttgggtaggtagtagaaaattattacagttaaagggggttgttctcttgtgggcaggggcaggggtcacaaggtgctcctgagattcattgtccaggagaaggagtgtcacaaggtaaattgatcagttgaggtgggacacgagcaaatcacaatggtggaatgtcatcagttaagacaggaactggctatttttcacttttgtcgttcttcagttgcttcaggccatctggatgtatacgtgcaggtcacgggatatgatggcttagcttgggctcagaggcctgacacataccaattggagaatgttgccatgaaatgacataaaaacaaagactattaatgactatcctaattatactaggaagtaaatcaaaactcttcatcagttagctaccattcttgttagctgattacagcatgcatgtaaaaaatgtctggtaaaaattatagtatgtaaaactaagatatttagctatgaaaactttctatgttcatcttttattatacagcttacatgatgcttcaaaaaataattataaatgttggcatttttaaaacactttttcacgaatgtatttgaaaagtctcttcatatcagaatttaggaggcatacacatatgctgttatatacagttatatatactttactaaaaattgtttccttttgacttgccctctgatgagtaacatttcacaaggttactcgggtaaccttgagtaaattactccatttggctaatccttagtttcttctctatgagtggtgatcaaaatgcctaccctgtcttttgaaagccaaattaagataggggttatcaagcagtgaattgccataaaatgtattatgcatattttatcacatttgtattgttattataaatatgtgtttatatgtatatcctccttagtgaccatgagatcatccagggtaggagctctctggaaatttagaaaacaaaggaaaaaaaaaattgaggaagtggaaaatacaaaggaattttctcagtggtgtttgttctataagctctaaacagtaggccaccaacgtccttgagaatctttcatttatctgtctgtacctcataattatatctgtcactctcgttttattatcagaagatttgcacagttcattttaaagtctaacttgtcctttgtgctgactgccacgcatgtctgatgaaatataacaaattgaacagaggtgccattattaaagcaatctgataaaaagctgcagttgtgaggtacactgaagaatatatttggtttcttcagggaatcaaaagcatttcacatttaagttattttctggaaacttttatgtgaatatactacattttatcatgcagaaatactgtgtatcttttctttcttttgtaaaagagagcaaacaggatggatatatcaatgagttactactaaggtttcagtttttctcatatgacagaccccctgtaggaagaggaatggtgtttccatcaaaatttgattatttttatattaatatttttattaatttttttcaaatttatatatatctatttaaatcttaagataattttgcaaatagccacacacacaatttttctaaatttgatgagtcttccatttcacataattacaggaaattttctcttcatgtgattcctatctgcaagaattccatttactggaatcgatttaaataataccagtcttccaacaacagttcaatttcaatccacagcgtactaaccataattgcataaattacaaactttgctgctaggccttcagtccacaattcactacataaagaggagacatacgtcatgatcagtaaccaatcatgacacttctttcaaagtctccagtgattggtcactgcacatgtataatttgtataattcagtttatgcagagacagggacttcattcccctgtgttctgaccagttggagctcccaaaatgcctgtggctacagtttgctcacagtggtcacaagtctattgaaacatgaatcttattaataggtttttgtttctccagattaaagtcacaattaccaaagatttaaataaatgttttgtatatgtgaaaactctttaatggcctcatttgcaagttgttttatgcgtatgatagctagaatctgctctcgaccagtagaaggtagtagcatttgccagaaattttgtaatggttcacagacaattctatgcaaacaaggtaatatttcctatgtttttatgtataaattatttaggaaaggggaaaatacatcatgataatttttgaaagaaaaaagcctttaaaatttttctgtttctctttttctaatttctaatacagtttattttgagtgaaaaggaggaaagggaacttaatttgtgaagcaactgtttcattttgtcagtcctctgggctaaaaatatatagaatgattggaaagaacatgaaaaactgtcatctggaacagttcctaaagtgaatgtgcagtcacacctttactattctctgattatgctgtgattctggaaaataaacaaggtgtgcatttctcattgaaatatgtcttggaatcttctccaaattaatacctgcatgttatatgatgcatatccatatgtgtacctatagctgtttatgtgcaaatgataactactttaaccaaacaatttccgccattttcttaatatttccattgggtaatcaccttctttaggaaaatgctgagtcataatgataaatataaagccactaatttggatctgtttcttttctctaagcaatatgttcaatgagaaaaacatgtaaagatgctcctcgatttacaatggagtcacaactcaataaacccattgtatgttgaaagcaatgtaagttgaaaatgcgtttaatacctagcatgcatcacagcttagccaagcttactgtaaacattctcagaacacttacattagtctacagttgagcaaaattatctaacacaagttctattatataataaagcattgagtagctcaggtaattcattgaacactgtactaaaagtaaaacgcagagttgtatgggcactcaaagtatgattctactcaatactcatttgcttttgcaccatcataaagctgaaaatttgtaaggcaaataatcgtaagtcagggagggtttgtagtttcctttttaacaaaatggcagaggattctttatgtgtttccaatgtttctttactgaatgttagagccaggttcgtaattctacccatactaccaaccccgaaactctcctcccccttttgcattcactctcatctcaaatctctatgtcttgcaatggtcaagttggcatgaattaaattgtttaacctgtaaattcaacagtgttcagagatgtataaaatgggcaaattcagtgactactttgaacaatggaaacatggcttttcaatggtaacgtcttggattggattcaaatcaggcccctaaaaatttaaggtcctaaaacccattacgaatgttctgagacatccaatgatgcacaagggtccttctagaactgctagctttaaaatgtgtaaaattggtcagagatgacagtctaactagcaaaaaaggaatgtgtctttcaggttcctggaaataatgggcacatttatgtttttcatctctagttactgtcatctctgcagtcttacgtagtcttctacatttccttttgtcttgtaaaaatgcttttctgttagagtttatgctttcatacaataaacatttacatagagacctgtcacagtggtgagcatgtaaaatgcatttaggaaatgccgtttgatgttgtatttgaattgacattttccctacataaaaacctttaaaacttataccagtaaaggccaactttttaaaaggtagtctccttttatgcatactaagagttatcctgttggaaactgcataagcatctaatcagtgcttgctaattgtgggtgctttcagccagagcatgaaattgggcacacaattagcaaactgaagaaatgtttaattgcaagtgcaattttaacctattgtcaagagggaaaatagaaaggatgaaaatgaccattttgattgtggttaacaaagaattaaaatagataaagagtttggacccttgaggagcaaatctcagttccaatatttatttgtctaactttggacaatcccttgatcactgtaagcatcagtttttgttgttttttcatgtgtaaatggggatcataatgttttaattgcaaagtttctgtagctatctgagatagaagcttgaaaccacctaacatggtgtaaattatgtatgtgatagccactcaggaagtgattgctattatgactattattttgaatattaatactactgatgctacaataaagcaaaccaaaatgtcatccattttttccctgcagttcgtcagccaccatggtatgaaactgccatgaaatacactatccattatgctcttaagtattccttaccttgaactatagtatacggtaaaagggcactggacttgagatgaaggaagtgagttttaattctgattgtgtcatttacttgagtaatcttgaagaaatcacttgatatctctgaaattcaggcttgttagctataaaatggagacgatacctacttcaaaagatccaagagagaatagtaacaaagatagcattgtgcttgacatattagctgtgtaataatcttccattaagtttaataaaatggctctgcatatagtgagtgcttctagaaatttatgctaagaattaagtttattttcactttcatgtattttcttatgctgatgttatgaattagatgtcttattttttgacattatgtaccaaaaaaaaatctgcaagcagaaacaaataatttattcaatcaaaattttataactccattaactttgtttcttcttactctctatatgtgttttgaggttttttctttgattttcttattgtacatgtgttgttattattgaaaatttttgagacattaatagtaaaataagctaggctccaggatacttagaatagggaaaaatattataagatataagtttaattcttattctgccagaatattataccttgacaagtaatctcccctccctgggttctgtttcctcatctattaaattgcaatgttactgacattagtatttttatcagtgccaaatgaaatactgagcaacaaagtatattttaagattgaaaagcagtgtaattattgatttttattttaagttctggggtacatgtacaggatgtgcaggtttgttgcgtatgtaaacgtgtgccatggtggtttgtagcacctatcaacccaacacctaggtattaagcatagcatgcattagctatttttcctaatgctctccctccccatgaccccatcccccgaccagccccagtgtgtgttgttcccctccctgtgcccatgcgttttcattgttcagctcctaattttaagtgagaacaaaaaagcagtgtaattattttaaaattccagattaaaaaaaatcatttcacataaagtatgaatatttgcttcctggttttatgaagctaaaaataatatttttgttcagagaaaaatcatacattgtttaagaatataattggaaaataagaaaggtaagtgatgaactgagagaagcaaggaatataattaaaactcagcatctagagagctaaggaagagagctgctgttgtaaagaatagacaaagggctaaatagaaaataatttggggttatgtgtaaacaatacttttcattttgtgaaaggtgtaagttccatttatagatttacacttttccacgtggatatccacttgttccagcatcatttgttgaaaagactactttttccattgacttgcctttgctcctttgtcaaagaactattgattatatttgtgtgggtctatttctggactgtctattctgttacattgatgtatttgcctattctttcaatgatgctacccagtcttgatcactatggcctaatataaggtcttgaaattgggtagggtaggtcctctttctcatccttcagtattgtttggccatgctgggtcttttgcctttccagataaactttagaatcagtgtgtcaatatttacaaaataatttactggaattttcgttgagattgcattcagtctatagattaatttgggaagaattcaggttttaacaatattgagtctttctattcatgatcatatctttacatttattcaaatcatctttgatttaatgtagttaacattttgcaacttttctcatgtagatcttatacatattttgtcggccttatatctaagtgtttgataatttttgtgctaatgtgaatgattttatatttttaattttaaattctgagtgttcattgctggtatataggaaaacaacttttgcacattaaccttgaatcctacaacattactataattagttaattgttcctggaacttctttgttgattctttggaattttctacataggtaatcatgacatttgcatactaaggtagttttaattctttctccccagcctgtataaattgatttccttttctaattgcataagctagtactttcatgacaatgttgaataggagtggtgagaccagacacccttgtcttgttctctctcttagggggaaagcatccagtttcacactgtttgctatgatattaactacaaaaactacgtttttgtagatatctattatcaagtagaagttgttcccctttatgcctaatttgttcagagtttttatgagaaatgtgtgttggattttgtcaaatgccttttcagcattatagatatgattgtatgatatttcttccttagcctattgtgataaattacattgatttttaaattacattgatttttaaattaattaattattttttttgagacagggtctcactctgtcacccaggctggaatgcagtggcatggccacagctcactgcagcctctacctccctggctcaggtgattctcccacctcagcctcccatgcagaactataggcccacactaccatgcccaactatttgtttttgattgtttttcatattttttttgtagagaaggggtttcctcgtgttgcctagtctggtcttgaactcatgagctcaagcaattcacctgcctcagcctcccaaagtgctaagattacaggcgtgaaccattatgccaggccaattaatgtttaatttacaaataagcatatatttagcatgtacaacatgatgttttaaatatgcatattttgttgaatggctaaatagctaattaacatatatattacctcacatggttatttatcaggttttgaatttgaaccaaccattgtatctggaataaagcccacttagtcatggtgtataattctttttatacattggatttgatttgctaaaattgtcttgaagatttttgcatttatgttcatgagagatattagtaattttcatttcttaacagatcttagtctggatgtggtgttggagtattgctggcctcctagaatgagttaggaagtattccctgtgtttatattttctgtaaaagtttgaaaaaaattgacttaaattcttccttgggagtttggtagattcaccagtggaaacatctgggactgatgctttctcttttgaaaagtaactaattgtcaattaaatttattaaacctattcaggttatttatttctccctgtgtgcaatttttatattgcgccttctgtggaatcagtccgtttcatctaggttatcaaatctgtaagcatgaaattgtttaaaatgcttacgcctaatttcttaatgtctatgaagtcaatgttaattactctttttcatttctgatcttagtgatttgtatgttttctctgttttctggttagcttggttagaggattaacaattttattgaacttttcaaagaacactagcttttggtttcattgatttactctactaatttcctgttttcaatttcatttctttctgccctaatttgtattatagatttgcttctgcttacttcagatttattttgctgttatttttctcactttctaaagcagaaacttttatttattttagatctttcttttctaatacatgcattcagtgctacaaatttctctctcatcactggttttgtcgcatcccacacattttgaaaagttgtattttaattttcacttcaaactatttttattttttcttcagacttcttctttgactcatgtaatccttaaaatttattgtattctgcaaatattttggaattttcagcttctttttatttttgactttgactttaatttcattctggtgtaacagtatactttaaataacttcaatagtttaaattcattaagctgtgttttgtgacctagaatgtggtatatcctggtgaatgtgccaggtaggcttaagaagaatatatattttgtgttgtcagatggtgtaattaaaaccagttaattgttggtgctgttctgattaactatgtcttatttggtgtgtgttgactctgtcaattgctaatagaggggtatcatagtcttcaaccataatagtgggtttacttatttccctttgcagttatatcagtttttatctcatgtattttgacactccattaggcacagacacaataaggattattctgtttcatcagagagttaatacctttttaaatttatttatttatttatttattttgagacagggtcttgctctgttgcccaggctggagtgctgtggcgcaatcttggctcactgcaacctctgtctcctgggctcaaacaattctccctgctcagcctcctgagtagctggaactacaggcatgtgccaccacaccgggttaatttttgtgttttttgctagagacagggcttcatcatgttggccaggctggtctcaaactcttgacctcaagtgatcttcccttctcagcctcccaaagtgcggggatcataggcgtgagccaccacgcttggcccttattttaaatgcctcataattttccttactcacaagtctgctttgtctgaaatttatatatttactctagatgtttttggttaatgttagcattgctgtatctttctccatcccttcatcttaatttatatgtgtctttatatttaaagtgaatttcttgtagccaacccatagtaggttcttgtttttaatccaccgtgataagctcttttgattggtatattcagatcattcacatttaaagtgattaatgatatatttatattaatgcctaccataatttataactgctttctagccattgtccttgtttttgtttttacattttgttttgttttacatactttcctgccttcttcagtttgaagtgcgcatttgatattttctactttctcttatctcttttttacttctattttacctgtttttagagattaccttagcgtttgcaatatacatttgcaatatacatttgcaataatccaagtccactttcaaataactctaccttacttcacaggcgtcacaggtacattaacgtattcccaattccccctatgtcatcacatgtaacattgctcattcatttctcatttatctgtaagctagaaccatccaaaatattgctgctattattaattagaacaaattttatgttgtatcctctaagaaccaaaaaaaattattttaccttcatttattttttcttaaatactctttctttatgtagatccaattttctaatctgagtcatttttttctctgagtaatttcttttaatattttttaaaagggaggcttgctaccgaaaatattacttcaagtttcatttttctgagaaagtcattatttcccttcaaagaatttcacttgatacagagttctaggctgtacttttatttgtttttatttaaatatttaaaattttataccactctcttcttgcttacatgattctatacagtgttggcttcctccaccccttcttggcttctttgaagattttcttcttgtttgattttctgcagttggaatattatgccaggaaggagatttttaactgtttatcagagagtttggcactctctgagtttcctagaactgtgatttgttgtctgtctttgaattcgaaaaagcatcagcattatttcttgggctcttccttctgttcctttctctctctctttctctctctcctccatatattatttgcgttatgcacattacacatttcgtaacactcatacatgtgtagaatgtgctcttccatatttttcatttttttactctttacattgtaatttagaaagttcctattgacatatcttcaaacacattatttccttgactgtgtccagcctactaatgaacccatccaaagcagtctttatttttatcttttttttctttctttctagcacttcctttcaattctttcttggagttctcatctctatgcctgcattacctatgtattctttcatgttgtttgtttttatcatttgaggttttaatatactcatgatagttattttaaattcccagttcaataattgcaaagtttctgctgtatctaagtaggttatgatgtttgttttgtctctttaatctgtgttctctgactttaacttgccttgtaaaatatgatgcatgagggaaaataaaacacatagtgccttagcctgaggttttatgttagtctgcccaggatttaagctgtgtctactatttgctgtagctatatgtgacagagactaaaatgtttttgtctcccctgttgttattgggttgccacagagaacttatcttaaataagatctgagacatgaaggcttttcacttgtattccctcattattatgcaggagttctgctgatgtggtgatagggtgtgagggaggataggcattctacagtctcataattaggtctcagtgttttagtgagcctgggcccctgggttgtgaccatcacaagggtttctcggctttttatccacttatgtgatacaagaaggctagagggagctggggttaggtatttctcttctttaagattaattcagctctggtaaaacctcagtccattgggctgtagtaaactagttttctttgagggtaggcctttgttaagaacaggatttctaggctgggcatgttgacccatgcctgtaatcccagcactttgggaggccgaggtgggaggatcatctgaaatcaggaattcgagaccagcctggccaacacagcgaaaccccgtctctactaaaaatacaaaaattagctgggtgtgatgatacatattcataatttcagcgactcggaaggctgaggcacaagaatctcttgaacctgggaagcggaggctgcagtgagcagagattgtgccactacactccagcctcagtgacagagtgagactttgtctcaagaaaaaagaaaaagaaggaaatattcagggggtatttcacaatctgggctttcccctttccctgataaaagaacaaggggatttttctcccacctttaactgaagaacttggtagacctcttggatgtaaaatgaataagagtgtagccccttccaagactggacctcaaagggttttcatccctcaaactagtcaacacccggtgtccagtcattagtcaattatcccttcagttttctggttgttggatctagtgttgacttcttttggtgtgctgtgactcattctgtgtgttcacctgtccttctggttttcaaagggggcagtggtttgccctgtgatcctgattatctgaaggatctaagaaaaattactaattttcagtttagtcagcatttttcttattgtgaggaccagagtgatgatttctaaactctttaaaagtcagataagactaatcttgttttttaaattaaaaaaataagtatgtagtaactagataacttcagtaatctgaaagtctgaccttcaggaagctcaattatacctaaaggcattgtacatgtatgtttataaaaactacctgtgacaatgaaaaagtaggctctaggcagtgaaaatatactgtgtgggggcattcaaaggaagttatatcagaataagaaatcaaaaatatttgcatctttgtattattttactatgtatttgattatgccagtatgtttctagagaagagaagagaaacaataaaatcccagtcattgtttatttcaaaatgtccttagttagctctgcgtgcaggcaggccaccataaatgtgcatccacaaatccaagtccacggtccagggggagtttcctgtaacacaatgcaaaactgagatataatccatcaaatactgcagactcaatatatatttgcaagccaacaaaggataagaatcccaaggtcctctgagtaaaagttgaaagagcacataaaattatgctagccttaggaaagaaattggagaacaggacaaatgtttaggttctatttaatattatttgcctgaataatatggagtcaaggctctgaaaaaaaaaagtagatcaaacaaggatgatttttccaagtgattttatcaccattttttcctttagtagaaaaaataaataaaaccaactgcttatctgttggcgggaaagatatttttcagttaaacaattgcacaaggccgatgttctgctggcctgcttcagtaaggctctaaacattattaaaatatttcttttcagcttgttggtaaagccactgcccttagacctccagatgcccctcatcatgaaacccttcccgagagtcttagagcacctggcctttgtgcaacacggtggatagtatttgcagtagcagaggtccagcagaatcctattagcatgtttgttctgggccaatgcccatactctactggttgctaaatatttggaatagcatcctttaaatcatgaacaaagcaaactatgatgtctggttgtattttaaaaatatatattcttccagtctttcaaaattactttttgatgtaacttatagacaggggtattatttagagtttaatacttgatagaggagatatcatcaataatttcaatcctacaggcatttaaatacaaagttatatcattcaatgtgattgttaaatttttgtatatacacacacacacacacatagaattgtatctgaagaattaatagtatgacatctactttgacatcatccttgaaaatatattatactctgatattgagaaatttgcagattttgaagtaagcccttctcaaaatattcttaccaagaagtctttcagcataaaagagacagtctttcatattcaatcaatacacaatgcaataaacttctgtggacaaaacataggctatgcttgtgattcaattagaaaagtaatatttctgttgaattttgtgtcaaaacaaaaggaagttacaacaatgaggaaggagaggggtgtgcttcgctggagagtgaaataattaattttgaagacatgcagctatattgtactttatttgaaagcaagcaaatgcaaatctttttcttcatcattgtgagaaaagaacagatgtttctatttgacatcaaatattttttcctgaaagcaagtcttagggacagcactaaagttggtatccatttaatcctacatctatgtacttaactatagctgaagcactgtataaaataggtgaacagaaattagaaaaaattaagtagttttattctattaaacgggtatagaattgtgaaattctttagaaaagcattctatagaaaaaaattaagtattctattaaaagggcagagaattgtgaaattatttagaaaagcgttctatagaaaaaattaagtatttttattctattaaaagggcagagaattgtgaaatactttagaaaagcattctatctagaaatgtttttaaatactctgagtcagagctgtctaatcgaacattttgtgatggtggaaatggtctgtgcctgcattgttgagtacagttgccattagccacatgtggccagtgaggactagaaatgtggccaatgtaagatataacctgattttttaaatttcattcatttttaattatcttaaattgaggtttcagtagccatgtgtgcctaatatactttattagatggcacagcccaaaatatttaaacttcaattatctggaaactcatttaggtggaatgtctcaattctgaatgattattaatagtggcataatttctgtatttgtgtttttaatcaaaaattaatgttgtgtgctttcagatgcttgctctaacgacctttaacatgttaaagatcatatataaacaatactgaaaactgcaaaattaagacaagttcatttccaaccaaatcatatatgcattgacaacaatggtagcaaacatcaggaaagctttgttgttgatcttatatgcatattgagagtttctctttttacgtgagacaaatccccaagggatccttaaaaacaaatatttttttcttctcacaaagcaagttatccttccaataaattcttaacccattaaagttacaaaagaaaaagccaagtcagcagatgtatctatgcttgtaaggtattcttgacctattgtgtactcacattcaatcaactagtaggagctttggtaacactattattttcagctctactgacaaatcagtatcctaaactgaaataaaccatgtggtctcagcatggtgaaatagctacaatagccatttctctggaggggtctctatgagggttggtcaagtgtatgtctcatgatatgacttttctatttggtaatgtgtacgaaaaaatgcagaaatcaaactgtggaaaatatttttagagataaataactctgtcatgcttaatgttgaacaaaatcaaacatcagaatattaattagtctccaaactcattttttaagtattttttctagcatttactttatgtcttagtctgtttgggctgctataacaacatatcataaactgggtggcttataaacaacaaacgtgtttctcatggttctggaggccaggaagtccaagatcaaggtttaagcagatctggggcctggtgagggcttgttccctataagaagcaatttcttgccatgttctcatgtggtagaagaggaaaacgagctccctcaggtctcttttataagggcactaatcccattcatgaaggttccgttctcatgacctgatcacctcccaaaggtcccaccttttaataacatcacattggggattaggcttcaacctgtgcattctgcaggggacacaaacttttgaaccatagcacttcattcctgaaatttgttccatttgtctttccatttctctctcccttctttgttccaagtcttctttattttaatttttttctctgacaaactcctttcatctgtgctttctcttatttcctcttcaaatattttaagtgggagacttttataggtcatatgtctactttgattgttacctgtgttgtatttttaaatagactctgaacaaattaatataaaaaatgcagctctaagagaaaagaacaaaatgtcaaatagtaaatacattttgtaaattgcaatcatggagagacaaccttttttgcattgacacacatggtcagttttcaagtatgtcattgccactcattgtaaaaattacttaatgatgccacacagcacacagtctccagtatgctacatgcgttataagctcagcctcattgcccagtcccagcaattttactaaattatagtctagtagtgagatacagagaaggagaataagagaaagttttagttagtatgacctggaagccagaacagacaaaatagatactaatttgttacataagtctatagaatttttgcagttagaggcaatcttagaaaccatcattagacagatgaagctaatctaaagatgggccaagtgactcacgcgaagtcaggaaatagttaatggcaaagtttgactacttaaatttcaggtcctgtgtctatgttcccatcacactcttacaaatgatatacacttaaatgtaatctgggccctatgtttgccaataagattagaaaatactcactagcctaatgtgaggtcaattggttaaccaaatagtttaggaaacactagcctcatagaagggtaaatattctccatatcctacataggtcaggttggcttaaaaactgaacacgtgaaaaaattctaattctatattaggatgttaggataaaaatagtctcaaacctcatctagtcatcttcttctattgactatatctgcattgtgggcaagacccaagcatacctatgggctctaaaaatggtggttagaggacatcacctaaattttctttcctgtcaactttccttgaagagaatatttcttttagctagatggtcagatccctgaaatttctggcacatcaaatgatgacagtgtctctcagctgagagaagcggcctctttgctaaaaggatttgactacctgtttgggaggcacccttgtcccctaggtcatttaatgattttcagatgctcagacaaatatttcccttgctaatgccgtgatgagagcttttggctaaaaagtgtttaggatgagatgttgaccagtgcctcagtatattaacttgcatcatcagtttgaatagggcagactcttagtccttccaggctgtgatcacaaaacccgtaaactgggtggcttataaacaacgaatatgtatttctcacaatcctgataggtgagaagtccaagatcaagatgcaggaagattcagtgtggtaagtatttgtttcctggttcatagatggtaacttttttctgtgttctcgcatggtggggagggcaagacagctctctggggtatcttttaaaaaggcactaatgacactgatgagaagtctctacccttatgacctatcaccccgcaaaatgctccacctcctaatacaatcttcttggtacaacgtattagtctgttctcacgctgctaataaaaatatacctgagactggataatttataacgaaaagaggcttaatggactcacagtccacatggctgggagacctcacaatcatggcggaagacaaaggaagagcaaagagacgtcttacatggtggcaggcaagagagctgtgcaggggaactcctatttataaaaccatcagatctcatgagacttatttaccaccatgaggaaagtatgggggaagctgccctaatgattcaattatctccacctggcctcgcacttgacacatagggattattacaattcaaggtgatatttgggtggggacacagccaagctatatcatatggtatccaactcattcttaggattaggattttaggttaggatttccacgtatgcattttgaagagacacaaacattcaaaccatagcagacagagtttctcaagagataccttatggacatcttgggccaaataactttgttgtggtggatgtcttgtgcattgtaggaagattgcccacatgcgtggactctagatgccagtaacacccctaccagtcatgacaataaaaaatgtctccagacatagccaaatgttccctgagagtcagaatctttctagttgggaaccactgtggtagggaaatggagatgaagtaacctttttctctaccattgtgtttcgtgtgttctcatggattctcattggttctagcgatatttgagcaaactgaacagaaatgggtcccaccctcagcaactttatagcccaatgagacagttaggcattaagaaagtaagtgaatataattctagattgtgataagaaaatgctatgaagaaaaattaaaaaagaaagagattcatggagatcttctcagcctggatagccagggaagagctatctgtcaaagtgttacaatctgaataatgaatgtgatttatctaaatgaatagtataccatgctaataaattattccaagtgaacaggcggccgctgaatgtccaaagtttggatgtttaatactctgcagccataaaaaaggatgagattatatcctttgcagggacatagatggacctggaggccattatccttagcaaactaacacagaaacagaaaaccaaataccgcatgttctcacttataagtgggagctcaatgatgagaacacatggacacataaaggggaacaacacctactgggtcctttcagagagtggacggtgggagcagggagaggatcaggaaaaataactaataggtactaggtttaatacctgggcaatgaaatctgtacaacaatccccatgacacaagtttacctatgtaaaaaacctgcacatgtacccctgaacttaaaagttaaaaaaaaaaaaaaaaagattcaaaggcactggactctactatttgaagtacagacttgcaaaaattctacattagtgcttggcaatagcccagcaaaatgcactttggcagtgaaaattagccacgtcgtaaaatctgcaattcgaatgtatttacattcacaacattcaatcattattctgtactatctattggggcagaggcaacacttttcatgaccattctgggtggccattgctgctttttctatcacagccatttcaagaggctgggacctgaagccccagtgtgtgcctgaagtctttggaagtgtttctaagtcaccacaatactagcacagactcccacttctattcacggccacctcttatgcctggcccagatcctcttcatttgtgatgggcatggggcctcactccattgtcttcagtataaccttcattataatacagtgccttactggaaggaggccttcaatgactacatgttgaacacattatttaacatataaaaatgatctcaacagaatcaataaggtaaccacttgttagaaatttctttctttttgttgggattttttttgtggttctctcttagaaactcttgccacagctcttcttcattcatgattctccaggcctgggctgcactccactgccagagtcaggttgaccctgtgactctgacaccatctccatctctcagaagggccttgctctttaaatttttagttcaacatgacctttgaaatggtcaagctttcctctgtctatttcctattccttatttccttttaagtctgttaataggttccatgttcaactaatggaaactctagaaaagaaagttttaagcattatacatttgtgtcattatcaaaataagaatgtgcatctgtaatccttcaaaggttaactctttggtttcagccataaaatgcaacttgagtcttgataactgatggagaagtatgtagggtaggcatagcacttttttttaatgcatggagtaggaaattcaaagcgacatttttgattatgtatgcatcagcaactgtgatttatggtacctgtttgtgtctgttacatgagtgatgggttcttacgccaaaaataaagttactatattcacacctgaggcctgagaagtaacagttcagtaaaagaagacaagactctataaaaaataccaaagaaataaatacaatgaacacttatagcctgtcttcttacctaagaacttattactttctaccttgtattattaattttgacaactgtgcttctgctcacaaacctgtaaattgctgggctctgcttgcagtgaagctactaccttcattataatacaggaccttaccggaaggaggccttcaatgatacatgtttaacaaattacttagtatatataaatgatctcaacataatcaataaggtaaccacttgttagaaatttctttctttttgttggcatttttttgtggttctctcttaggagacttttgctgaagcttaaatgctttaaaataatttttaaataattaattactacaaataaatgagctatttagcctgaaatattaaagtgctatttccagaacttatatttctgtaattaaaatgccagttttgttctctccgggctctgtttaagaaaaaaaaaaaaagtgattttttttttttttttttttttttttgagatggagtctcactgtgttgccctggctggagtgtggtggcgtgatctcatctcactgcaacctctgcctcctgggttcaagtattctcctgccccagcctcctgagtagctggaactacaagtgtgcaccaccacacatggctaatttttgtattttttgtggttttgccttgttagccaggctggtctcgaactcctgacttcaggtgatccacctgccttggcctcccaaagtgctgggattacaggcgtgaaccactgcgcctggccaaaaaaaagtgattcttaaatgcagatgccttggtcaatttatgtatgtttgagatataaattataattcagaagtatgaaggtgccaagatcactatgggaattaaatatgatattttaagagattttgagaggcttattttctatatatgaatggataaagtcaaccacagttagaaacatcatttatctgggtaacataattgtgatttcatctgtaaagtcaaatacaaggcagcattatgtggattaacatttttttccatattatagaaacagtgttaaggaggaatcttagtcaaattccatttttttaagagacaaaacaaaataaaactgtgattgagagttcaaagtccttaactcactagtagcagaactgggtcgtgtttatgaacttttctcttcactgtactcaccaccatgcattctaaccatgaaagcaattgtagttctacagcaccacaatccatgctagtgctgatacgagaaacctaaaatgaaagggaaatcatatgtaacattgtgttgattgattgaaatgtgtgactagattcagaagtacaagccagaagtttggggaaccttacttctgagaatgggccagttctgactctcagtcaagcctaaagtttgttgctcagttggaaacaaaagcatggatatgattgtccggagaaccctgttgctgaataacaaagaggcataagcagaaaggagaattcagaagcacaacataatctaaatttgatttatggcagtgtgcagtctggatgtctccagcttgtggtttcagcttctacttctcaagtagagaagctggatggtggtaaaatacagcaggctgaggagggccagactggagttgagattttctggactatgaactctgggtgtggggtgtatcttgagaggcatactggccacaaagggcggccggagggaaaaacaagttttgcatgcccatgctctgttcagagtccaagaactaacatctgtttagttttggaaacacaggctggctctgagtatggggatttagaacagcagaaaggtcaacattgtataggagagactcaatgttttcacaatcgattaggagcttagaagaattggggtggcaagactaagaagtgagctgcaaggatctgaatgaaaagggctgtcaggccaaggcccatcagcgaaggcagagaggaactggccagagaccagggcaggaagtgtggctcacaattggaaagcagtgtcagaggagtaagagatgaatgaaacatggattaggattaggattaggagctaacgggtacagaaccaggacacaaacacaaaatctaagaactaccagtcaatcctggaatatgaaaacaaatgtcatggggatcagaattttgtctcaagggaactgtagtgttgctgcttagaagtgcaactgatcccataagtggggaaaatgagacacacacagaaaagtataggacaagaggcctgactgtttcctattctcatcccttcattcttgttgacacagattttgattgaggtttgaagtttaccatcagaaccatatctttcctagaaacagagaaactacccaataagtaaaatcaactacagtatcctccttgtagttttgtcattatttctcattagttttatttcacttatttaagtagcaatgaagggataggcagtagatgacaaagttactactataggagcactctgaggcattatccttcctcaccactaatgcacttctgatttttttcctctgttctcctctcttatttagtcttttacatataatttgggttttacaggcaatgtctcacagagtcagtggccactgtgactgcttcttatcctcattagagcaatcactaatttaaaatcagtcaccatttgaaaacttttaaaattatgtcacaagactgtaggatatttcaagataaggggctagtactcctcactcatatatatccggtcttggcattgggaatcattagccaagttaggagctctccagctggcccattgcaaagcaatgcagacagagggaaagttgaggcacctgcctggttcactgggtttgattgcttactaatccttcacttaacttggaacctccttgctcaacctcttggctcaggtgctggggagaacacaggttggcaagatgcaagttctgccttgcaagcatttttctcctgtatatgcacacacacacacagacacacacacacatatatgtgtgtatatacaggagaaaatgcttgcaaggcagaatttgcacacatatgtatgtatacatacacacacatacacatatattttatatatacatatacatatatattttatatatacatataaatatataatatataatagaaaacataaacatacatatatgtatatattatatgtgtataatatatgtacatatatgtaaaatatatatgtataatatacatatatatccatgagaatgccagaaacaatatatgtataatatatactatgtaatatataatatatactatataggtatatatgttcatatttataatatatatgaacatatttattcactgcttaaatttccactgttaccatgtgcctggaacagcttagacataactatttgcttttgagtagactgaccctagaaacaccatactgtattcaaaacaactagtttctaatcatggaattaagacactaaggtggaaccatttcagactggaagtcattttgaggttcacactgaagctatttcgtatatatctcattatatatacatatcttatgtatacatatatagtatacacatcttatgtatacatatatagtatacacatcttatgtatacatatatagtatacacatcttatgtatacatatatagtatacacatcttatgtatacaatatagtatacacatcttatgtatacaatatagtatacacatcttatgtatacaatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacatatcttatgtatacatatatgtatacatatcttatgtatactatatagtatacatatcttatgtatacaaatatgtatacatatcttatgtatacaaatatgtatacatatcttatgtatacaaatatgtatacatatcttatgtatacaaatatgtatacatatcttatgtatacatatatgtatacatatcttatgtatactatatagtatacatatcttatgtatactatatagtatacatatcttatgtatactatatagtatacatatcttatgtatactatatatataaataaaataaaaaacaggaaattgcttggtgccaaagcacagaagaggaagataataattttgaggtatttgaactggactttgaagaatagaaagtttttttttttccctaaagcagtgaaaacagttgaaaggccagaatgatttatttcaagtgttacctttaaaagaatattaatacttgacagtctcttcacatatatgcctgtttcttttctttcaaaaaaactaaccccatgactagaattttgatctacttttgcctttttttttcttttttagtttaagataaaataaatagtctaacatctgtaacatatcatggctgaatttggttatacacaacatgcttcattttcatatcatatcttacttgagtttaaacctgcttttcatattttactcctttctgttactcaattcaaaagtatttgccatgaatgacttcataaccatacattttagatggtctgcttgggatttttttttgccttatatttttctattggcttattttcctttattttaatatacacacattcccttaatgttgatttcttcacgctgacctgtacccctcccttaaaatttattgccagagatgaaatgcccttgataatcttcaccttaagattcactcccctctctgaattacttcatttggttttcaaaactaaaacttataagaaatctcagactcgcaggaccctaaatataacattagtaatgcaagagagataaaacatataaaagcaggcatactcaaaaagatacagtacaaaatactgaaagaattaacagaatgagaaaaggaagcattaaattcacatcaaagaaagctttgaacattaaagcaaatgaaagtgaggggaagaaatctatatggaagccaaacaatcactgcttcctgacagctgcagttattaattagtgttccatcatttgcactaaatggtcaatcaatacttttgcttctctggaaggccatttgctttgtagcttgcttcttaatgggaaatgattcagcttgtccccttctttgtcattctgtccataactaccagcttggcagagagttcgtaagctgtgctggctctagataagggtaagaattttgtctccagatttcagttctctcctgcccaaccacctcacctgcaatctattgtttatattgttgctatgtatctctattctttctgcatcaaataatgaatagctcattttgtgttgccttcaagtatgacaaattcctttccaaatgtgattccagacagtatatccaaacatgtctttcttttcccattcctgatcatcctacatgtcaagcactgccaacgtttactcaagaaagcttggttagaacccagcctctagaagcagtagattcctactcattcctgactcttttagccacttgtcgtatggcatgagcaggtgtcttaacttctctatttatgtcatcacctcctgtttcctatccacagagctaatacctagctcagagcattattgtaaaaataaaatgaactagcatatgtatataaaaagtaaggtggttacctggggattggaagacacttccatcatatttgttaagtgaatggcatagagcaaataaaaaaaaattgactcattattcttattattcttttatatgattactgctctctcctggagtgcacttctctgcctgactcaccctttaagatacatctcatatagaaactccacatgaaagccttccgtgacgcatgatcatggctattcactcctctattctgtcacagtcctttgtgcatttctcttcatagctctcacacttcatttcaccatactgcacatctgattgctttactagactctgagaatcactgttgctagaacgtatttgttcactgcttacatttccactgttaccatgtgcctggaacagcttagacataactatttgcctttgagtagaccaaccctagaaacaccatactatatttaaaacaactagtttctaatcatggaagtaagacactaaggtggaaccatttcagactgggagtcattttgaggttcacagtgaagctatttcatatctaaacctcaggtgagatgatatttttttgtaaacttagggttaacaaacctatttataattattgtgttaacacaatgcttcatgtactactgatttttcttgaagtgtatacctataggaaatagaaatgtccatggtcataggaacatagaatcagacaaaagttttcgagttaagataactaattggaaatcatatggacataagaattaaataaaaatgggttatttctagagatatatatgtaactaagaaaaaacaaagataaacagatacttgatggcacattactgaatttcaacaatattccttcaaaataagtgacaagagatagtatagtcactgtgatatatggtcctgtccagtgacgttctgggccctaggtctagacccattatttgggttaccagaggttaggcgcttaacctctttctttgctagttttttcatctgcaaaacaggattgaataacactcttacctactcaggtaattcctaccctatgagaagggaaagagataaagcaagtacaagtatttttatactctaaaactctatagaggccgggcgtgatggctcacacctgtaatcccagcactttgggagactgaggcgggcagttcacctgaggtcacgagttcgagagtagcttggccaacatggtgaaaccccgtctctactaaaaatacaaaaattacccggttgtggtggtgggcacctataattcccaactactcaggagactgaggctggagtattgcttgaacccaggagggggacattgcagtgagcagagatcgtgccattgcgctctagcctgagcaacaagagcgaaactccatctcaagaaaacaaacaaacaaaactctatggagtcaaagatactgtgaaatacagcaagtccctgggcctttggtgactctgtatattaacagagggctctcattcaagaccttatctattgtccagcattatttgtctactatgatattcatcttttcaggacctaatccagctggacctctacttttttaatggttctagttttgatttgtatacagtttcagcagcaaactccctacaggccatacactagattcacgtccatttggcactgaggaacaaaagaaaatcaccctacctaaagtgatggggagcaaaatattgcttttgatgaatcactaatatagttttatctagctacagttttgtcaaaaagagactattgttgcaaaccaagttaaatagttttttaaaatattttttattgtagcctaatgaagattacttaattgcctgtttaaaggacttggtggaaaaatatgtgaaccacagctttagaggcccatgagctttgggcagtctatgtcatgttcatctccttatccccattgttggctccaaaactctgttagagtgttcagcaagtgttaaactgctcctaataatgcctaagtcacagtgttggatctcaggtggtgcagacttacctatcccaacttgagagaagaatgagcagccgccataggtcattaacatgccgcctgcatcattcacttacccactaaattgaggtacaaccagatggaaagaacatgggtttttggcacatgggactggatacctgaagtatggaactcattcctaaacaatggctggaagctttgggtagattccctgacctgagaattgtatggcgcattgttaggaaagctaagtctgcaggaaaaaaaaaaaaaaaaaaaggcatgttttggggtcctggctgtgctgtaagcaggacaaattcttaggatttctggtgctaattgagtgaccttatacataccatttcccctcctggggctaaaagaagatcagagaggatcaaagaaatcagtggtttaaaaaaactcaaaacaaaacaacttgagaccctaaaacagtatttggcctttggaggtttttgtttaataagtttaaattgtccccaaagtgtttctaaaaggcaggttgtgctttgctgcaatacaaacacctttgtttctgatgccacacagcaggcttgagagaagcattggtgttgtatttgccctttgtacccatctatgtttgacactcattgaccaaataggttaacattttaggagtctatcattctataaaccacctgagtgacctagaacaagtaactgaatgtctccaagccccagatttctcatttctcccttggagatggccattataatatctgcctacctatgtcagtggttattatgatcaaaggagatcaatatgtgagcatgctttgcaatctttaagcaggaagaaatgttcattagtgaggaaggataaagcttaagcgggagcttggactagataactgctagacaaggtcatacctctattatgcagttacagtatttgataataaaatgtctttaataatcaggaaaattaaaataaatgggggcctcaattatatctagaaagatattcaagaagacagactctcattagaggagaagtctgtggcaagaggcaaacaactccaagattggtttcttaactggttgtgaaattgcctccgtttatcccataagcagacctccccctgagtggatttccttaagagaggttatataggtgaaagatccttatgcctggcagcatattatttagaaatagtccactttaaattgccatggagagaaccaccaaaagatgcagagagctgtttgtgtcacaaatgttaagctataatctcactttcagatttaacctagttttctttgggaggccgaggcgggtggatcacctgaggtcaggagttcaagaccagcctggccaacatggcaaaactctgtctctactaaaaaattaaaaaaaaaaaaaaaaaagccatgtgtggtggtgggtgcctgtaatcccagctgctcaggaggctgaggcatggagaattgcttgaacctgggaggtggaggttgcagtgagccaagatcacgccactgcactccagcttgggcaacagagtgagactctatcataatgttattaaacatgtaaaagaagcatctgacaataatttcaaataagctgcttaattttacaaaggcattccattcctgttttggcactgccattggtcatccatgtgactttgagaaaactactaacacaaataaaaaataacaaatttaacttagttttatttaactcaccttggttttattcattgagtagtgatgatgatggcaagactggggaaatggtagaaacttatattaattgaggtttttttttgtgccagggacgccacacagctctttagcatttcataaagtatcccaatgatcctggaagttgagtaatgcattatccctaccttacagatgattcatccgaggcacatttgtgttagcattttgttcaaagtcacacggatgaccaatggcagtgccaaaacaggaatgggatgcctttataaaattaagcagcttatttgaaattattgtcagatgcttcttttacacctttaataacattatgatggtatgaaaacacattttaggcagcagccaataaacttcaatataataacaattaccatcctgatttgatacagaagcctccaacttcaggtgttcttttaatattctatatgctagtcgattttgtttaccatacgcatagttataaacagtcagtgcacatgttgttgactgacctaaatatttacactgtcacatattattaaaatctcagtgcttttctccaattctgtaagattaattgtctactaaccaatgaaataatttgaatttctacttttcttcttataagcttaggctaatttctatcaaagagaagtttctcaaaaatgaggactggaataaaagcttctgtggcttgttcacagcctcattgactggaagaattgtgtctcttggtgggtaactgtgcatggggtgctaaggactgcttggagtctaagtgggaaaatggcattctgtgactgggaacctctgttccttaaaccttttctgtttaattagaaggaaggatgtcccattttatcctcacttaaagagcaatgaaatgattaaaaatagtgttttaatttcacaacttaggagcaataaataattttgagtctctggctgtcactatcagttatcgctcaacttaatattgttgaagtttagataaggacagatggttctctcttctcagtattagttctgttgcttggcagttaattacctgctactgtgactccctctcccatcaccaagaaatcataaaaacagaaaaagtaacggtatctttctccaagaagtttgctttgtctcatggattggttcctttgacagttttttatttgagagggctcctcttcgtgttcctaatatgccaaagttaagcatgcaacctcggtcttcatgttcacaagttgaaatgggcgtgtgcttcttttacaattatgtccaatacgctaactgaaagtagaacatgcctttctcctaggggttttcaaattcataggatggtttacatttattagcttctgaagtaaggaagatttctcttacaaaaataaatcactctattttttgttaaattgaatctactttgttccccacccaatgttgatgcaataaggagaattttatttgttctatgacttttcaattcttgcacctgatttggaatatcacatcattctgtctgccccttcggtcttgttttatttgaatctttcagcccaacagtcagctttgctgaggctacaaagaaatgcagtgccaccaaaatatgagagaataactaagctggacatttcacaaggctgctgatgtgagaaaatacaattttagcaagttttaatctatgtccctaaacaatcttaagttgaaaatattgagagaagtataacagtaggagacaatgttttgcctaattttttcagacttcaaattagtgaatcgaaatcatgttaaaaatttgcaatttcagttcacaggcagatttctagattttaatatataacagacaaaccacttcagcaattacttttgcttgcactgtggtttttgagaacattggagttttttccatattttccattatctctgagtttttcactgaattttgctatctttacatattctttctaattgaaaagggataatttgttcgtccttgaattcagttttcaaagacatctgaatatttgaaattcacttctctttctccattttttttttgatgttatcctctctgtgttttctttttaaggaaaggtaaccttttgattttgttgtttattttttgaaaactattgtttcaattatgaaacagagataggaaataataatccgataaatgtccaaaactatcattatatagcatgacattcagtaaatacccagtaggagtgctggcttacattgcagaaagacctgcagagacccaaatgttgaagcattgaaagagctgaatacattggactgaatacatagaattcttccctaaaaaacaagggaggcaagtactgtttttttggtttgtttgttttttctcagttttcaccactaatttgcttataaaggaaagaaaatttgagtttctgtggactcttgttttattacattcatacaaaacttttttttttccagttatttcacaagaaagaaggtgtttagttgtccacaaaggactatgcctctggtttggtgcaatttctggttttagtagttcttatccctattgtctactccaaaatgctgtcagcacagtttctccagccccatttatcatcctgtagagtagtacctctttactggctcactttcaaatacctgagtttgctaatgttgcagctttccacgttacaaaagaccctggtagcctccctagagaaggcaattatctattatgcttaggggacacaaaagtagctcacggagggaagtgcctacatactctgctcatgctgaggctgacctaaatcaatttcagatgcctataagtaaaaattgagctctgtatataaggttaaagctgccacatttttattaaagaattatccttctaggataactgcaaatgttgaataattttcatggtgattacaatgttcaaaggaactccaaaataaaaaatagaaatgacacctattttggagtatcttacttccatttccattcactgtctgttacgttttcactctttattatagattgtatgtctgtctttggtttggttctttcagtcttatgatgtgttaataaactattatagactatgtagaggatgtaatcattaaatacagaatacaaacaaaactaatcttttgaaagctattatttagagaaagagctagaacctatgtaaacatatatatattctatatatatactctctatatatattctatatatatactctctatatattctatatatatactttctctatatattctatatatatacagtatatatatagactatatatactgtatatatatagtctatatatatactctatatattatatatactctatatattctatatatatactctatattctatatatatactctatatatatactgtctatatatattctctatatatattctctctatatatcctatatatattctctttatatattctatatatatattctctctatatattccatatatatattctctatatatattctctgtatatattctctatatatattctctatatactctctctatattctctatatactctctatatattctatatatattctatatatattctatatatgtattctatatatattctatatatacattctatatacattctatatatacattctatatacattctatatatacattctatatacattctatatacattctatatatattctatatatacattctatatatattctatatatacattctatatacattttatatacattctatatatattctatatacattctatatatattctatatatacattctatatatattctatatacattctatatatattctatatacattctatatatattctatatacattctatatatatattctatatacattctatatatatattctatatacattctatatatattctatatatattctatatacattctatatatatactatatacattctatatatatattctatatacattctatatatattctaaatacattatatattctatatatatattctatatatagtctacatatatattctatatatagtctacatatatagactatatatagtctatatatgtagactatatatagtctatatatatattctacatttatatgtgtgtgtgtgtgtgtatatatatatatatttttttttttttttttgagatggaacctggctctgtagcccaggctggagtgcagtggcacgacttcagctcactgcaacctccacctcctaggttcaagcaattctcctgtctcagcctctgagaagctgggattacaggtgccggctaccatgcctggctagtttttttgtatttttagtagagacaggttttcaccatgttggccaggctggttttgaactcctgatgtcaggtgatccacctaccttggcctcccaaagtgctgggattacaggtgtgagccagcatgcccagccctcctgtgtaaacatattaaacgataaggtgctcactattttctgagctgtacaacaggaacaattgctgaaaagaatggtacctgaaccctgtattgggtgaccattggccttttgtgtcctgtgatgggtagggcttggcctaggacttccagacactaataccctggggtagaatgcaggcaattagtaattaattgcactgatgtgtctaacatgttgtagtagtggcgattattgctccatttaattcgatgagtaatttagacattaatgcaaagttttagaagtagcagcaatcatttatattatcctttctcaatacattaatagtttaggaattttcattctgtggctggttggtgagatgagatgaggccaatgaaaactccttggcccaggggattggagatttgaaatatttactatgtaagtgacattgttagaaaacactaggcattatgccaaaattacaattatgggttagtgttatggactgaattgcgtccacacacacacaaaatatatatatatatatacacgttggcgaggtgcagtcgctcacgcctgtaatcccagcactttgggaggccgaggcggatggattacgaggtcaggagttcgagaccagcttgtccaacatgatgaaacactatctctactaaaaatacaaaaattagctgggcatagtggtgggcatctctaagcccagctacttgggaggctgaggaaggagaattgcttgaacctgggaggcagagtttgcagtgagccaagattgtgccactgcactccagcctgggtgacataacaagactccatctcaaaaaaattttcttaataaacatatatgttgaagtcctaaaccctactccctgtgaatgtaaggttatttgcagatagggtcctagcagatgtaatcaaggcaagatgggtgttggggtaggcactaatttaagttgactggtgtccttacaagaacagaaaacaccatctggcaatggagatacagtgagaagatggcaatgggaagatagaggcagaggtgggagtgctgcagccacgagacaagaaacaactggggccaccagaagctagaaggggacaggaaggatctgagagctcatggtccagccaacatcttgagttagattttagacttctaaactccacaattctgaaccagtaaacttctactgttctaactcacccgatttgtggtacattactatagcagccctagggaactaaaggagttagaaaccttttcatacttatttagacttactaaaattatacctatcacaaaatattcacaaattggttcaaagaagttgatcagaatgatgatatatatagccaacggttacattcaattaataaactacaaatgagaattattgttactaatgactcacctgggaagaactattaaggtaatttaaagaacacactttatatttagagaaattagctaaatggtcaatgcagttcaatcagtagttttcttatatttactatttcccaggaactgtagcaaaaacaaggatacaaagataaataagagaagacattatgaaagttggttctctatgaaataataaccaggtattttcttttagaattcttgtgtgaaacttcagaattctctataggctattgcattttgttcccaatgctcaggtcttatagtagtgtgcttgccagataaaatatggaggtccccgctgaatttaatttattgaggcttttttgttttgttttgttttgttttgtagtaatatgtcctgtgcactcgttgggacatacttatgctaaaaaagttgttttctggaattcaaacgttactacctgccccacattttcatttgctagatgttgcagcctgggtagtagtgaaagtcatatgcaagatatcaaaggtgagaaactgaagaatcaacacttggaagtggctacattcctacaatctcacttattgccaatttgctatctcaaggggcttataacaattttcagtcatctgtagtacttaagtcttaggaatattttggtgattaaatgaagtagtacattgtaagtgttagaacagttactgttgaatagttagggccctgtaactgttcgtttttatttttttttcccaaatcagtgtaatgcatagtagagcattttcctgtattttgaatgaggatacaagagatggccacatgtgtacatttgctaacaatgtctaatctatttgtcaatactgaaagacacatctttgaaaaaagatgggtcttgttccgtttggttttaatcactttgtaagattccagttcagtgcctgatgagcctctgactttagaagcatgctgttaaatctaaacttttttttttttttttttttttttttttgagacagagtctcgctctgtcgccaggctggagtgcaatggtgagatctctgctcaccgcaacctccgactccgtggttcaagcaattctcctgtctcagcctcctgagtagctgggattacaggcgcaggccaccatgcccagctaatttttgtatttttagtagcgacagcgtttcactgtgttagccagaatggtttcaatctcctgacctcgtgatgcacctgccttggcctcccaaagtggtgggattacaggcgtgagccaccatgcctggcctaaatctaaacttttatgtgtccagtgtattagttcttagggctgctgaaacaaaaccacagattgggtcacttaaaacaacagaaatgtattctctcacagtgtggaggttaaagtctgcaacccagatgttggcagggttgttttttctggaggttctgagtgactctgttcccggcctttctcctggctactggcggttgctgttagtccttcgtggaccttcacttgcaggcttatcactccagtctcggcctccatgctcactcacatggtggtctcctcattgtgtatatctgtgtctcttcttacaaggacactggtcatataggattagggtctgcccgaatccagtattacctcatttagcttcatttcatctacaaagaccctatttccacactaggtttcattcacagatgctgacaactagtaaaacaacctttgcagacattataacagtgagaaaattatggcagtgaaagagatctgatgtaatcaacctccattttgcctttagccttcaaactgcccttaattattcctgggtttgggacaagctaatttggggaaatatttagtttatagttaaatgataatagcccttctcaaccacctttgtaaagctaatgagagaccaccaggtttaaaggatgagaggaacttaaattctgctacggtgtagacataaaggattacccaccattatttcaaaggtcacaagatacacaacttctctaattactcctgcagataacatcactatttgtagaaccaaagattggcctttccagatgtcttttcaggtttttttgcatgcacatctgatgatggatggctccacctggacccactaatcactccagtgaccccaccccgagggactcagcatgcgggaggaacatcttccattcccctgggattgcacccccaaccaattagcaagctcccattgccaggtcaccccctttcttccaccaaattatccttgaaaaaccctagcctctgaatctgggggaagactgatttgagtaataataaaatttctgtctcccgttcagccagctctgcatgaattaagctctttatttcaattcccctgtcttgataaattggctctatttgggcagcagtcaaaatgaacccattggtcagttatactaggctttcaacatactttgggtggacacaataaggaccagtggctatacttcaggggtattttgaaaacctcaacgattacattttatattaataggcatcttttttaacatttaaggtattctctacagtgtatcattggtatagagaaacaaaggttttctttcaaaaagtgttttcctcaatatttctagaacatacatttaggaactatttagggaacaatatctaggtaacaatacatgaatattatatttaaacactttatgatttgattgtaaaacaaatttcacagtctagaattcccaatgctttgagaagtaaataatgggggtaaataaaataaaattggtaagagaactattttttttcttttagcttcccttattttggggccttcatctctgcattccaaattacttcattatttttaaagtgccattcaattttcaattgtataacaagtgtttgctaagcaattacgtaaattttcttgtttaggtgggcaattagatgaactgaatgctaagatattttaagctaatattcttgcatgaaaatctaaattttctcattttccagagaaatgttaataaattttactcagccatgcaattaaataaatgccaacacttagattattactattcttaacaattaacaaatttcacaaatacttccaaaattagagtggtgtaaagagtagtcttggattgtgaatgacctcattttacagtttactaatctataaatgaacattaagtacctaataataatgccattgtcatgtttaaatactttatattagtaaagaagctataacagattttccatagcatatattcaaaatatattatttctcttttcctctccatttttaaaaataaaccacacagtcatgcccattaaatataaccagatatatttacttgcttggttttccttttgttttttcttgtcggggaattatagggataaggaagagattgatttttgcttttttttctgctgaagttataaatgcttgaatttggaattattttgtaattctagttgaaatgtgaaggagcatttactataggaaacatatggtcctataaaccagtatcagcagttttcaggtaatcaataaaataaatacgagatatccccatgataccgctattgtccaataaacgattacctgttacacagtgtcctttgcattgtgtaggataaaatgacagattatgtacaccgattttggtaatttccaggaaacaactgactcacagaagcttaggtggtgtacttggaatataaatgcacatactaatggagctgattttatcattcttaaagcataatcaaagtcagtagtttactaccactgaggagaatgatgctttagatcccagggcacttaccacaggaaggatacagggatgaggccatttgtaagccacatccagaagatggtgagatgacctctgtgttcctcacataagaaatttaacaccagcacttacccacacacactaaaaccaaataatttggatagcctcgttgtgattcacgtacatgtttcccaattgccggcaattttcactgtcaggctgactaaatgcagatcattaacttacagggtcatgtttttcaggccgttttggtattatgtaagaacattctcaaatctataatagcaagctctacccagtaatatttatagaagcgtatgtgtaattgttagtaggagaaatatctgaagacgattttattcgctctgtaaatatgtaggtcagggtcttaagaaaatgctcattgtaaacatttcttttttggacagggagatgtccctgatgttccccctagatgtccattgaagtactactcatgggagattttatttaggccacctagcattttgctgagcattctggttgtcagaaaaagataaagcacctgctgttatgttgttgctcactaagtagagaaggggtccaatggctaaaccgacgatttcaactcacggtggcaaagagcatcacgagcatgctcaggaagcacgctgaggaggcgggcacccaaccgaacctgcagagacggaggacatctttctggggagacaatacctagactgagttgtacaagatgaatacgatttagttgtgtggcgtgatgtttcaggtaaagcgttcatcttgagaaaatgcatagaataataataataataggggtctgaagaagaagataagagtggtatggtctgaccaggtctgtcaagataagtagctgtaatgagggagtggggaggtcacggaaagcttgtatgacttgcaagtgagtttcacccttatcagatatgcaatggagagcccttgatgtttattgcaaataatgcgagccagttttgtcattggcacttactggttttttgcttgtttgttagatatctgtatcttccagaagttactgaagataatggctacaggtgtgtcaattggcttgcttgtggtaatcatttcacaatgtatacctgaatcaaaacatcaggttgtacaccgtaaatctatacaatttaatatacacaatttttaggctgcaaaaaaaaaaaaaacgaaacaacagcctttgtcctaattccattacacattaaaacatgtattaactagtagaaaaaaagcacagtctgttcttcgagttgaataaaatcctcagctttctgtccttttagacaatctaccatgatcttaaatgaaaggcttaagttcaaatgtggcagtgttccagaagtagtactgtgctgcatatcaggtcagaaccaggcagggtgtaggctgtttaccatagaaggggatggcctcttagtgccaggtcgtcgttctcagtggaaatatatttagcatagatcaactggctttggtttcttcttaaactctgttcagaaaaaactctgagaggtggctacttgatattttaaacttgaccacaagtgttgaataccattcatttcaactatgaaaaaccatttccattatgaagtagaaaattaaaccctctggggctgatccacgcggagctcagttgaagtattacactttctcatctcaggaaggtgggcttctgatgagtctttccattgctgactaagccccagcacagcaaacctgttcttcattagggctcctcagacagcaactcaccacctccagggagtagcttaaaacagctgacccatacacatatactgttgagacaaaagtcttttcaattaaaatagaggcatgatcacagtgagttttaaacaggagattcatatgagcagattctgatttttgaaagacgacagtaaaagcagaatggaagtgtcaatttcagaaaggcaagaggatgtacacaggttacctaggaggttactgaagcagtcagtgctaaactatttgtattaagaaaaaaaaagagcttaagagaaatgcacatttatactgttgtgtcaaactccaaaaataaatggaaattgtgttaaacaataactagtatagatgagtaattttaaatatatgtatatatatatttatttgtatttctaccagatgtgtgtattaaatatagatatagatatagatataataaaacacaggctagagtttattaaattactatcccttatgatcacagccctgaggtccattataccagtttggttgttcttatctctttattgtttacatccattttctatgcaaaatgtgaaaggagctacctctctaaaaccctcggaaagattttcaccttgaaaataacaaaaaatggacagcttcttgtaaatctaatcaaagctctaacatgttttgaccagttacatagtttttaaaaggtgagggacagtagagctaatttaaaatgctaacaagtttttaggtaatcaatcttaacaattagatgattaatagctggggagttaatcatccccagtcacaaaagaatggctctgctcctgcttcatacacaattaattgtgagccagcaacgtcttgccattatctactgtgtctgaacagctattgagttgaggtttcctttatcatctgatgatgtataatttgattgtttcccttaaaactcattcctaaccaaaaatcaaaagaaacatactgagactttgatgatgaaaataatatatctaacatttaaaataaatagattttataacttggtgacgaactcagtttgctctctttccctactccaataaaaattattggttctgaaactaattttgacatttaatatcacattaactttcattgtcatttaattgctccatgtcctccttgttttcccatagattttaaacccctaggccttggacatatttctgaattcctcatcccattttataacattgtacacatccaataaatgtccacaatataattgaacagaattgagatcatgacgttttatctcagtaacttgataggcttgtaattatacagtatgccctaaagtgttgaattacataatctctacccccttttattttcttttacctgattcatttcttatttataactaatgtttattaatatgtaaatatgccccatcctttcctcctgaccgcaacatatatatacaaggactgtggtttctgttttatttacatttgtgaccagtttcttgaatgagtggctaaataattcagtgaatagaactcctactatctgtttcattgacttagtgagtttttaattctctcacttagtgaaattttacttgtcatccttgtttttatttccaccacttcccattcctaaggatgccttctattctataccttagttttagatggttaccacattgatgaataataatcaattctttttattttatatgaatgcaacatcagcttccattttcaaaggaaccttctatccacagaacacaaactaggaccgtgctaaaatttcaggagcctagtgtttattgtgttcataaactcatgacattttccagcttgaggtgatttaagaggccatgtagcacaaacttgtattttacagatgagaaaactgagcattgagcaagttaaatgatgtaccaaaagtcaaatcactagtgaatggcaactgagactgaaatcaaagtcccctaggcctggctgtgtccagattgtacgagtgcctcatgatatctaagctacaaaaccatgatgggggatgaggggagagtcttgctagtgtctcacagtgcggctggatgacaagttaggaacaacagcaggactgaggcaccagagttgctaggctatgaaacacatcacgtggaaccatggaatcacgtgcaatattttatttattatttattattttatttttattttaatatttgcttaatatttttatatatttttattttaatatttgcttaactgttttttatttccatcaagttgctcatttcaatgtttaatgaacatttagggaacagagtccaagatctgggttcaaagacctgagcagcagagtgagatgaaatcaagaaacctttcataaatctaaaaaatgatctgtaggctgttgatacaactcacaatatcagattggcagcctggaaattagtatcttcagttgaggaatacattaaaatcttaaactaaggtctttcaagaaacttaaaacagcacggatagaagtgtgtttttaacgtataaaattatttgtgcctgggatttaatttctttaacacattccaaaattcctttagggcataggttttgttctgcacaccactgaaattctgcataaggcacagtgtctagaacccagaaagtattaaataattttttgaaaaaatatactcatgtatatattccttagtttttgtcaatagttatttgatatttagtaaaaattacattttttgtctatatatatatataaaagcatccaaaatgatagagaatagagtgatatctaatgctaactgcccaaattacacaattattcccagcgagtacctatcatatgctgaggaattaatctgtagattcagatacagtacagtggccaagattcaccaatagatttctatttttttcttatacacatttaacatcagaatttgaacatcatagaagtttcaaaacagtttgtagaagctacttaaaatttgtttcagatctcctgtaatatacattttattattttgaccctgcaaagcaaatatcatttttatttataaagccgatgacataaaagcttattatacagaaacttgcatttctcatttcctaaaacttgttttctcttcacatgttatgactttgtttcaacttaccataaattcaccttgctgttccagttaaacttgaaatttatcgtgtactccttgctgctaaccagtaagtcagtgaggaaaatattgtatgtcagatgcttttctcagctctattttcctctcttgttggaattgccttcttcatttttttgtgtgttgtatatgatattctactgcatttttaaagaagagagataacttcaatgcatttataattcaaaggtttactcatgttgttcttctgttccagatgatagattttgaaccattctttaacactgatttggccatcataccaaaaagaaatacagttgtccctcattatccgtgggggaattggttccatgaccccatagataacaagattcaaaatccaaaatcggatgcttcagttctttattttaaatggcatagtattttctataacctgcacacatcttcctgtatactttaaatcatctctagattacttgtaatacctaatacaatgtagatgctgtattgatagttgctatattgtattgctatttgcattattttttattattgtgattttaatggttttgtattttcaaatatgtattttcaatctgcagttggttgaattcccaaggatacagggtgaaagtgtgactgtgtatgtataaaagaaactacattttcaaaagttgatattctaatcataaaaaatagactgcactaatatataatcatagaccactaatagaaaagatattaattgggattgagaatggaaatcctatgctggctaaaaagtctctgatgagctaaatagactgattttgctaagagctactctttcaagagcccacgggaaataggtacttattcagtttagtcaaacattcaggaatccagacccttagtaatttgaaactgtgacagctacaaacttgaccaatgtcaaatttacctatttcccatcaaaataaatatttacataggaaataaatcataaaaacagaatatttggggatgaagcattattcttttcagttgtcattttattcgtttgcttattatttatagtgttttataattaactgcaaaaaacaaaaaacaagaaataaaatatatacatttaaattcattttaaaatttaaattttaaaccatgttttaaaaaatctaactttagattttgaaataactcagactattttgctaatttgtttgaactagtacagtctcatattataataagattaagtgacatttacttagtttgactaccctttcctatagcgaataaactgacatttaaaaagttgctgcttgctggcacttaagattgactgatgaggatgtgcagtcatggaggaagagccaggactgagaaagaaatataaatgaggaaaaggaagagagaaaaggagccagacaagacttgaggagagatgagagaaaggaaatactgtttgagggtagaaataggataaatgaagtcacagagaagaggctttcatttccacatctgttacttgaccatgtccatggtatgagagtttcatagttctttttctgtttttgcaggctgcatgctcaaatattctctataaaacataaacccatctccttaccctctcttcatttagcatttattttcaagatgctggctacattggtacattaatttcttatagatatttaatgagtcagttcacattaactggtgttcccttgcttaaaataataataataaagatgctggtagcttgtacctatgattttggtcaccaaaatacaggatgtttttccattacccagtactaataaaaggtgaggtacagaggtacagtaggtgagacaaattcataggctggcagcagcttagtttttcctatatttgaccccaactggagaaatgtgtattattatttttcaaggctgggtatagagctatatattgttgagctgttttattaatataaatatatagagagttaaaattgttttcaaaaagcatgttaggagttcacctaatgggagtgactgagaagaagaaaatgcacagaatttagtataaagaaatcccaaataataacaataaaaaagcataaagtatatctgaagatttatgttcaacaacctagttcaaaatctataagaaggaatgatgatattatcacacagaaaattatcttatgtgaggttctagaactgactgtaggtgtcacacaaaatttagacaacagagattctgaggaaatcaacatatcctacatcaaggaaatagattaaaatgtggtatggtctaaaggtaagaggtctgaaccaatattttaaactacataatgcaagatatactaatattagattctaaatatttttaaatatttgtgatgttacttgtacttgaacaaatgaattttgaacatgcttcataattctgaaactctgccattacttaatgatgctaaaatatgcataatatcctctcctcaaggaatctcgatgtgttttccaaaattaaaactgtgtccaaactgagttttccaaaatccttaattttgagtaatgctgttatctttcacctctggagtgttcacaaaatctatttttattttctgaaggagtacagcgtgtatatattaaacacagctaaatgaaccgagaaagaaatccagatgtttaaccatgaaatctaaattttgaaagagtcttttgaaaatatgctgaaatgttttcaaaatatcatgatgatcaaaacaaattgttattggaatgaccttcactgtaagcagtattaacaatccggtattatacagaaagcatacatctttttttgaaaaatctttgtaattttaccattcagtgataaatataaattcctgaaaatgccattcttaccagaaaaccagtcaatatggttttacattagagcttttaaaaacttagtttgtggccaggcacggtggctcacgcctgtaatcccggcactttgggaggccgagacgggcagatgacgaggtcaggagatcgagaccatcctggctaacacggtgaaaccctgtctctactaaaaaatacaaaaacaactagccaggcgttgtggcgggggcctgtagtcccagctacttgggaggctgaggcaggagaatggcgtgaacccgggaggcggagcttgcagtgagccgagatagcgccactgcactccagcctgggcaacagagcaagactctgtctcaaaaaaacaccaacaacttggtttgaaacatgtatatataaatgtatatatttaaatatacattgtggctatacacctctaccttctctgtattacttatctatgtttatagctatttatatacatgtatatgtatgtgcatatatatacatatgcatatatatgtgtagagaatagaactgtagttactagcagcttggaagagtagagggtaatagggagagattggttaacagacgtaaaattttagctagagagcgggaataacttctagtgttctatagcacgttagggtgactgtagttaaaaataatttagtctatattttcaaatagctagaagagaggatttcgaacgttcccaacattaagagatgataaatgttccaagtgacagatatgctacttactctgatttgatcattacctattgtataagtgcactgaaatatcactttgtacaccctaaatgtgtacaattattataggtcaattacaagccaaaataaaaaaaccacacaaataactcataagaatacaatataacaattattcatatggcatgtatattgtattagtaatctggaaatggtttatagtatgagggaggatgtggataggttatatgcaaacactgggccgtttgacataagggatttgagcattcctggagtttcatatggagcagggtcctggaactaatcttctgcggataccaaaggataattgtataagaatcttggcagcaaaattgtggcagttcagaactataaaaaaaagtcaaagacaatgggaaaaaaagactcagtcaggtgtccttattctctgcttttgatggggcactgagacattgcctgtgaggatttgaggattgattatttccttgtgctaagtgttttcctgaactatgtgttttacctgaacattgaaaacctaccaccacatctgagggaagaactgttgttatttacctatctttcatgaggcaactgacacaagtagatattaactaacttgactgttagttgctgctactaaagggcagagatgattcagagtgaggcagctgcactccagggttccagctctcaaccgctgtgctgcactgcctcccaggaaatactgaagtgctaagcatggttgcgggtctacggatgatgcattacagtttatggacagaaaaataatcaaatgcttcatctgaagaaataaaggattaagaacaatagaacatagattcttcagaaactggatcatatgagtaaggtcacagaaaagtaaaaaagtaacattgttgagttttctgccttttcaataaattaatgactttaggaaatatctattagagatatataattttaaaatatacacacatatatatatataaacttttattcaggtatgttagagagaaccagtagagggagcttttagccgtaagtttactttctattgtgaaaggaattaatcaaataatgtgtgaagaaaaataaattctaaatatgattattatttacgtgatacttcaaagcatccaaaaaataaattaagaatgttatttttttcagttactttggaactcagttacaagacatatttttatttatagtaacaggcaaaatgtatttattgtgtacaacatgatgttttgatatatatgtacattgtgaaatgactaaatctggctaactattctatgcattacctcacatagttatcttttttgtagtgagaaaacttcacttcaactcagtatttttgaaggacctagtatattattaattatagtcaccatgttatacaatagaactcttgaatttataacttctgttaactgaaattttgtatcctttaatgaatacctcctcattccccaccagaaaccctagcccctggtaaccagcattttatttattttatttctatgggatgaactttcttagattccacatatgaatgagatggaacaggtataacgggttatgcataaagtgccttatgtacaggttatacataacgtaccttattatacgcttataacttatgtgtaacaagtataaggtgagatctcattgggttttaatttgcatttatctgataatcagtgatgatgaacatttttttcatatacctgttggccatttgtatgccttcttttgagaaatgcctattcagatattttgtcttttgtctttctgtgcctgatttattttacttaacataatgtccttcaggttcatccatgttactgcaaatgataacacttcgttcttttttaatgggtgaattgtattctattgtgtgtgtgcgtgcatatagatagatatacaaacacacataccacatttgctttatccattcatcctttgatagatgcttaagctgattcaatatcttagctattgtgaataatgctgcaataaacatgggagtgcagatatgttttcaaaatactgatttcacttcctttggaatatgcctagtagtgggatttctgtatcatatggtaattctattttcaatttgttgaggagcctccatcctgtttttcacaattgtactaatttatattcccacaaatagtgtgcatgggttctttttctccacatcctcaccaatacttacactttctcattttgataatagccattctaacaggtataaggtgatatctcattgggttttaatttgcatttatctgataatagtgatgttcaacattttttttcatatacctgttggctatttctatgctttcttttgagaaatgcctattcagatattttgcccatttttaaatcaggctattttattgttgctgttgacttgtttgagtaccttatgtattttgaatgttaaccttttatcagacatatagtttgcaaatagtgtcttccattcagtagattttctcttcgttttgtttattgttcctttacctctgcagaagcttttatgtttcatgcgttcccatttgtatatttttacttttgctgcctgtgcttttgatgtcatatctaaaaagttttattgccctgaccaatataaaaatgctttcttctatgtatttatctagtagtctcaaagttgtgggtcttagatttaagtatttaatccattttgagttgatttttgtatatggtgtgagatggggatgtaatttcatcatttcacatgtgaatattcaattttccaaacagctatcaggttctgggctcttctttgacggtagacattttattactgatttaatctccttacttgttattggtctgttaagattttctgttttttttttttcataattcactcttggtagatggtgtatatcaaggaattaatccagttaagctaggttatccaattttttggtgtataatttttcataatagtctttgatgatcctttgtatttctgttgcatcagttataacgtctcgtctctttgtttctgacttagtctttctctttctgcctttcttaggctaactaaagatttgttgattttgtttatctttctaaaaaaatcaactcttagttttgttgatcttttctatcacttttctagtctctattttattgatttctgccctggtccttattattttcatctttctactaactttggacttagtttgtttttgtttttcaagtttcttgaggtgcaatgttaggtcatttacttgagatcttcttttttgatataggcatttattgctataaaacttcttagaatggataaagtaattcttagaattgcttttgctctcccaggggttttggtattttgtgtttccattttcactggtctcaagaaattttttaaagttttcatgaacattttttcacagactcattgattgttcagaagcacgttctttaatttccatgcatttgtaaattttctgaagtttcccctgttcaatcaaactattgatttctagttttatattattatagtcataaaagatacttggtatcatttcaaaattctgattttttatgaattgtggcctaccatatgatctattttagagaatgaatatgcatagaataatgcttattctgtagttgttggatggaatgttatttatatgtctgttacatacatttgatctagaatgtagttcaagtgtaagtttctttgttttctgcctgggtgatctgtccattgctgtaaatgggttgtaaatctcctactattgttttattgcagtctatatctctttttaagtatattaatacttggtttgtatatttaggtgctccagttatgggtacatacgtatttacaattgttatatcctcttgctgaattaacccctttattattaaataatgacttatttttacctttttacagtttttgacttggagtccatttaatcttatataaatatagctacttctattctcttttggtttctacttgcatggaatatatttttctatttattcaatttcagtctatgtgtatttttacaggcaaagtgagtttcccatagacataccatttaaatcctgtgatatgaaaatttgcctttttgatgctgtcacataagtttcataagctttttttcagtccttgtcattctttatttttttcttctgactttatattttcaaataacctgtctgtaagttcacaaatattgttttctgcttgttcagtttttcttttgatgctctctattgtattgtttgtctttcattgtatttttcagctccaggatttctgtttttttttttaatttaatccctctaatgaatttctcatttttttacttattattattattgttttattttgttcacttctctgtattttttgaagttctccgagcttctttaaaatggttattttatattattttcaggcacttcatgtattgctatttctgtatgatgtcactggcaccttaaaatatctgtttggtgttgtcatgattctcattgttctgatctttgtacttctatgtcaaagcctgtgcatgggaagtcattgcttattccaatttttatagtcttgctttttctaggaaagccttgtggcaggcatagttctggggcgcatcagactcctgagccagtgttgaccagtgtagcactgccagaatcctgggtcctgctttagctggtacaatgctggggcatgccagaatccctggacagctgtgactggcatgacactgccaaaagcctggaacccactacagcaggctaggtgttgtgtttggctggaagcccacagcctctgagaattgcttgctcctgagggctacccaaagcctgggaccactgatgtcaatatggcagttgtgtaggccagagataaatttcactaagcaagcttaaagtgtgaggctatgtggtctcacctggtgagacctggtgtcctggtgggtctataggctcagtctgctggtactggttcggaatatggagctatgaggggtctgctggtgcagagttttcctgtgagtacccagtgttgtgtccaggaaaaatcctgtgctcacatccctttcattctatctagtggatggcatctctttccatactgtgctgcctggggttgggagaggggtgatgtgggtattgtaaaactgtgattcctaccctttcaatgtgtcttttcttattattgtactacaacgaggcactgtgatctctcacgtggtaaaaagatcctagcccttgtgacgttatttttgtgcatagatagctgttcagattgatgtttctgtgaagggatgcttgctggagagtcctactccactgtctggctcccacaaggcatttttgactgctcatctgttgctgtgctggatattatcatccacaggagaattgcaaagatgggtgcctagacacaacgagcttataattttgctggtaaaattgttagcttattagaaatgtattgtgaatgaaatttatacataatagtgtattggcaataagcttgacaaagaagataagcaaacaggagttagaaagaccagagcacagagaataatagctgttcccgaaaagacaaaggatatgaatttatggtgaagactgtgaagggaattttcgatgggaaaatattatgagcaacatggctgatttaggaatgggcatggagggtgaggaatcatatacatacaaccaaaataaaaggttaatatgaaggatataagacacagatttgaatattgcatgaggccgcaagtgctggcaaggagatgaaagtgatccagatggtagtaggaaataagaatacattctataatgagattgcagcaggaatggagagggtaccgaaggatggagctagaggataattaggaaatataaaaaattggaaggaaaaaaccctaacaagaggcaatagcaataatccaggcatgaagtgattaactttgttagatgtgatgtgctgtttttcaagccatataataaactctccttactgaacaaaacaataattatgtgctttcattctcttgcttctccttttagactgtgttaaaaaaaaaaaaagaaaatttaagctagttttggcagtgttccagtgagccagtttgtggcatttttgtccatctgcctttactttcatggtttactgattgcttattttgcagtcttttgtttattttatttatttcttcataaactaaataaataacatttatctaaagtatcagctggatataatggggatagatgtccagggtaattttccatcatacttaaagtcttctttaggagtacttttcacattccactgccaaccactgaccaccagtatgttcacctttagccttcagaactcacggaagaataggcaagattaatcggatcataaggatcatatagaaaacttataaaaatggtaagggtaaaaaatataaattggggtcttcaatgccagtccagagtgtaataatgaacaactgtaaagtttatgtatgaggtgataattttaagtcaactcttttgagagattagcatggggttgtccttagaacggactgaagagcggaagattagcagcagagagagaaatcagaaggctgtacaataggataagtatgaattgatttcagagggaatgaagaagatttaagtaggtaatgagagaagagtaaaaaatcaatgatttactagatgtaaagactggagaaaaaatgtcaaagatgactgatatacacagtttaaacgattagtactgtaatagatatattcgggaaacgagctagtatttagttgaaaattgtgtgtcatttttaggcacattgatttttggtactcacagttgatataggcatatgtacaaatattttaaagctatttctcatattctcatagattccataaagaagactaaaattctaaaggttgaatagccttcatttttttaaaaaaagtatagaactcattagaaattagatttttttcagaaaaatatttggctaaaaatagtgaaatctttttttttaattttattttagatgtctgcatcgaaaccctgataggtatttcatgctatttcttttctggaatgtgaaatccagtattaagtttgatacatcaatcagtatgctatccactctgacatagtgaaattgattagtaaaaaaacaatgcttgtgttgtagaattaaaatttcctttttcttattattatggagaacacatgtcagagtccataggaggtacaaacaggtattctatgacaagggacttgaaaaggtggtgtgtttgtgtcccttaaagttaaaccatcagtggacctaattagcataagttatagatgccttttttcctgaggttgacaccatggagttatttgtcagggatatttttcatccctggaatttgtctttgaatgcatcttattacaaactagtgattcgaccaaattatggatgtacatcatttgtgtttagctaaatagtcacttattgtgtaaagacattttttggaagctctagagtaattcactcttctatgcactcctgcctatgcagtgacttttttttttttaatgtgtcttaagtacttgcctgaaaatcataaccatgcacagtacaagtgtctgagtaaagttacacaaataatattgtaatatgacaatacacatccctcaattagtagcaccaagaataatgcccttgcagtagacctgacaatttcaaacaccatacaatagggaacagcatccaagacagccaaaccctctgtcatggcagaaacagaaacagcctgggaaatgttacctccatattcacttgtggtagtaatcataactgtttattgcttaaattagagagaaagtccaggaaaaaaatttcttatttagctgagtagttttctcattcaaaaatgcatttaactttaggccaggagtggtggctcatgcctgtaatggctcccagcactttgggaggctgaagcgggcagatcacttgaggtaaggagtttgagaccagccttgccaacatggtgaaactctgtcgctactaaaaaatacaaaaaatagccagatgtggttgcacgtccctgtaatcccagctaattgggaggctgaggcaggagaatcgctggaacctggggggaagaggttgcagtgaacagagatcgcactattgcactccagcctgggtgacaaagtgacactctgtctcaaaaaaaaaaaaaaaaaaaaaaaagcatttagatttaaataacatttaatgagaaaatgaacaacctggttaaatatcaaatgattaaacttacattagatgtatagaagctaccatcaaaattaagccttatttactgggatgatttcaaaggtttctattcttatgctgattattctgtgattatttaaaattggtagaaagatctgattctggctcactcacttctgcttcttccatttaattagcaagtatttgccaagtagttattatataattagcattgtgctagagtctttacgatgccaacatttcaaggagcaaattgcttctctcaatgtctgcattgcttgaaaatggagttgttaagtcaaaactcttaagctgccagtaactttctccctctgtttaatagtttaccaagacctccaatgttggaactatcttgcatgtcacaccaattaaataaaatgggtgaatattttcaaattcagtggtggtaaatgtttctagaggaacacagctgtgtgagtgggtgcaatagaactggatttgatatcaagtggccttctacaagtatgattttccacaaaaaaaacacaaagcttaagttaagccctgttattcctactttctctaccttcagatttgagtgataaagacaatagaataaaatatatcctctaagtagaatatttgcattatgtaagctaaaaagattggctttttaaaacaatcaagtggtgaatattcaactccctaatccaatcctttttctttcagaacaactttggaatttcaagatttcaaggttgtgtgctctagggctttgaaaggcagagtaactgaggataattctttgcaaaccataacaatattaatagaatcatcccatcatggttttagaaaacaacaacaaccaccaccaatccattactaaattttacacccaataacattattaaggaccaaaatggatttaagttttttcactttatttacaaacatctaatgctaggcacccagaattagtcctaattgtgctaggtattgctcctagagctttaaatttattatctcatttgatcctcacgataaccctataagtttggtatcattatcttttattgaagaaaagaagtctaaggcaaaggtaagttaaatgacttgcagaggatcacaaagtcagtgggtgattgaaccaagatataaacaaagacaagatataaacaaaggtatactgactttgccatcttaaaagtctgttaaggcggctgggcgcggtaatcccagcactttgggaggccaaggtgggtgtatcaggaggccaggagatcgagaccatcctggccaacatgatgaaaccccgtctctactaaaaatgcaaaaattagccaagcgtggtggtgcacacctgtaatcccagctactcaggaggctgagacaggagaatcgcttgaccctggaggtggagattgcagtaaactgagattgtgccactgtactccagcctggcgacagagcaagactccatctgaaaaaaaaaaaaaaaaagaggtctgttaagggtaacatttgccattggtagataaggtttcccttcacaaaagaagagaaactatggcatatgtgcagtctatgccttctgccacccactaaatagaaagggtgcatgtatcttggaagagactcgttaatcaaacagatgtgctttcaataatggtgaaatctcttcattaagcactggcagtaagtcattacaatatcttctctagccttttggctgtgatcaagggtagactatcttctcattaggataatggggttcaataaaagagtgttccatcgttctccaaaagggagtagagtggaactttttgttaactataatcatttagtgattcattttatcttttttagatcttgttaattcattgttgcacaaggttaatcctttatccacttaggctatggttttgacaaaatgtgttggtcataaaagttaacttcttaaaagacgttaaagacagtttcaatgaacatcagtaacataatgtgtggaaataagaaaagtattttgtttctatttgcttgcccagagtgatattaattaaagcatgatttatatattttaaatgaaataattgaggacatttttgacatatgttttcattttttgtggcaaacaagatcaggagaaaattataaatatttgagttaaacatgtatttggcagtaatattgtttgtgactaaggtcagtccttagtctcacaagattatattatcatgtaaaagttataacaataatagatccatcaaaaattggaaaatatgaaaatgagtctctccctttgagttttttaatgcaattttaccaatcaaatatgacaatgatgaataattttgcacatttacttttagtatcttccccctatgaaaatgcttgtattataaaattttacctactggtaattacagttaactcacaaacttccatcctgattatgcctacttaccattagatcaaaagcatttgccaatcatatccttttaaataatcatttgaatggttctgatatttcaatgataaaattctgtgatttagttttatgcttatagttggatatttgaattatcccagatgtttttgctattataggtaacctagcaacaaagaagttttttcctattatcttttttccatatttggggatatttctgtagaaaataatccccagaattgaatttattgaatcaaagagtataaagctcttgatacggagtccctgaattcttaaggaatatgtttaatccatctatgtagctctggaaactggcttactacctagtatgctcgttacttacatttttgaatgtgttaaacttttaagaaaacctattaaatgactactttatgtgcatggctatctgataataatcttttgtacttataatagattttcctaatatctaataaattttcacatacattatctgaccttatacctacaaaatacttgcaaggggcacaaggcagacattttgatcatcacttttcagagaaaaaataaaaaaggacctaagagagattaaggatatggcgtagaatttagtcttcttacctggaacagcagtggctccattacatcctatctctgtgtacatgtgctttactacggaaagaatttgaaataagttgattttgttttcttttcagtgaataattgcttttattcttaaggaggaaaaatgtctgtcagaatgattttgtctgttttatagtgaaaaatgcataccactccttaatcatcatcatacaatttttctaaatgttcagtgcaaacatcaatatatgttaaagcattattttatacgtttaaacagaaatgaaaggcaaagatcaaagtaacccattaaactctatttatggtacttaaaacattagttagggcatttttaaatgtactatgtgtgttatgtaagtgtgagctctgaattacaaagtaatttaaacaaatacggattcctaaaaatttctcccaggcaagtccttacatatagatcccctataatggtttaagataattatggactgaatatttcttagttttttaaatttagagcattgattgaacattgatgaaattttttcaactttaaaaatgtattttataatatctatccaatatgattgaatattaaattattcacgggatgaaactgcctgctataggcttaatgaacacaatgtacaaaatatactagttttccgtcttttctcctttttttaaaaatttttatttactttttgaatcaggaaatgatcaacctgatttcagagatgagaatattaaagcccagagagtaaagtagtttgtccagatctatgtggtgttttcttttcttttcttttcttttttttttttttttttttgagaaggcgtcttgctctgtcacccaggctggagtacagtggtcgaatctcagctcactgcaagctctgcttcccgggttcacgccattctcccgcctcagcctccggagtaactgggactacaggcgccagccaccacgcccagctaattttttgtatttttgttagagacggggtttcaccgtgttagccaggatggtctggatctcctgacctcatgatccgccctccttggcctcccaaagtgctgggattacaggcgtgacccaccgcgcccggccccaaatctatatggtttttaaggatctttgctggggattcaaagcctattttgttcacttcaaacctcagctcttctcgctgaacaaaaaggcaattaaaagaatgatgatagacaaagttgaaagttcactagtttataatttttaaaaatcctatgccaccatttttctttcagtagtttagacttaatacgtttttgaagattttaactcaatgtaatggaaaacatttataatatgatggaaacatttttaatgaagcttttcaacaaggagttcttaaaataaataaactttgtggtcaaacagagattaaatggctatctattaagaacactatggaatttctattcaaattgggtagcagactaaatgacttctaagatacaatcagtttgtgatttaattggttcttgaatggatctgcctctggcttgtagtctttatactgtaagcatttatacaacaagtctgcaattcaaccatttgactacaaattgccgtaagtttttggaaagctattaaagctcctctaatttttacaaaactctcttgctaaagttattgtgtagcgagggcataccatgtgtcaggtattatgaaagttttccttccttctttctctttgcaattgctctatctacctatttatctaaaatcacacacatatataacatatacatatatacataggtatacatgtacatggatacatgtatgcgtatgtgtatctttactaaatatgtatctatacatatatgtgtatgtatctatatgtatatgtatatatttgtatctatacatatatgtgtatgtgtatctttactaaacctaacagcagttttctaaagtaaacacttttattacctacactttgctagtgaacgtaaagaaagtgaaacaaattgccaaagattacataactggcaagtggcaaagctaggactcaatctcatggacaagtgacatctaagcctttattcttaactactagattatcttatgataatttaaacttgtgtgtatgttttatctttttgttaatcatcagagtcaatgatattcagcatcttctgcagtacagaccaaggaaaacaaagccaagctgtcttaggcagccaaaaaatgactatccatgcaaattaaatgtcactatgttttacaaatttgtctttactattagacatcaactaaagtagttcagaaaagagatgataaaaccctgaatgagtgaagctatagaggaaaatgtgaatgaaaaattaaaaagaaatactaagtttaaacaaatttaattgtggtagaaatttaaatatagaagatggatttcaggggttgtagtattaccacctcaatatttggaggatctgtttacatgtcttctcctaccactggcagaagagccttggggttagaactttttctgtcccttgttatcttctcagtatctcacctggaccaatgctatggcatgttttcaaagataacctagtagtggtgatgaaaggcacagtttcttcatgtttaaagatgagccatgggtttccttttatattttctcacatagactcccagatctgtgaggtcctggaatgtacaagtggttatcctcataaattagctaacaccagaattcatctagtagcatagagcaaaggattgctctgccaacatctgaacaatcaaatcctggcccaaacaagccaaattatctcaacatcaactcatattcttaccacatcctgatgttcctatgctgatattgcttgatcatacagattccattttgttctcctatttgagagtttgagaatctgcttctcttctctttccacccctacctcaccctcctcccttggaattagagattgaatgatctcggacatcttgataatctctcctctctgctctgtatgctcagctactcgtcttacaatcattaatttttaaaatttaactacatgagtgtgccatttgtttttcccacctccagggaaaagagatgaacttgactcatgattttgatcccatgattcatcctcagcccttgctgttggatgtggcggaacactcactagtcctttaataaagatcagatgctgtgtggatactggtgggcttcttgagcaggttgctattgcctacctagaagcatttgccgaggattttcttttcttttgtcgtcagtgctataatatgccacagtctttaaattgacctcagtagtgtctcattgaacttaatatttagttcatttttctgctgacttttgagaggtggcatggccagaaatgtatatagtgattgtatcttttctctttttgccttatgaaatttacttaactatatggcttactaaatatataactggagaaattaaatagcaaaaattttactactttttccatgaaaagttaagtgtttatgtagtaattaattgcttagtccagcttcctgagatataaaaataatgctgataggcattaacaggcgatatgattcactacttttactcattcattcaattttatattccaaagaacatgttttctaataagaggataattaaatgtttacaagtgttatcttggaagtaaatccaacaataatttataataataaaatggtgtttgggttatacatgtggcactgtctcaaagagtcttaatagcatgggaaaattagttttattgtgcagatatattaataaatttaaagataatcaggataacttttgaacatttacaaatgctcaaattcgagcatacaaatttgagtatacaaatttgagcatacacatttgagcatacaaatttgagcatacaaatttaattaaagtatttttacctttttgccaacctaacatccttacgtgagaatagcatataattacatatcactataaagagcacattgtaagttatttacatattgttagactgttagaatgttacctgctaaattggagtgggaactaaacacacatacacacccactgactgagtctggcacatttctgggtcttcctttccttacaggaattaaagttcttgactaagtgattcctaagtttttcccaagtataacatgggtatacatttatgtttctaattttaaagaggctactaaatcttacattttatcatgctctctaattcctcttttttttatttttaaattttactctaagttctgggatacatgtgcagaatgtgcaggtttgttacacagttatacatgtgccatggtggtttgctgcacccatcaatccgtcatgtaggttttaagccccacatgcgttaggtatttctcctaatgctctccctctccttgcccccaacccccgacaggccttggtgtatgttgttcccctcgctgtgtccttgtgttctcattgttcacctcccacttatgagtgacaacatgcagtgtttggttttcggttcttgtgttagtttgctgagaatgacggcttccagcttcatccatgtctcttcaaaggacatgagctcattcttttttaggcctgcataatattccatggtgtatatgtgccaccttttctttatgcagtctatcgttgatgggcatttctgttggttccaggtctttgttattgtaaatagtgctgcaataaacatacgtgtgcatgtgtctttatggtagaatgatttatcatcctttgggtacgtacccagtaatgggattgctgggtcaaatggtatttctgattctagatccttgaggaattgccacactgtcttccacagtgattgaactaatttacactcccaccaacggtgtaaatgcattcctatttttccacagccttgccagcatctattgttacctgactttttaataattgccattctgactggcatgaggtggcatctcattgtggttttgatttgcatttctctaatgatcagtgatgataagctttttttcctatgtttcttggccgcataaatgtcttattttgagaagtctctgttcatatcctttgcccacttgacggggttgttttttgcttttaatttgtttaagtttcttgtagattctggatattagacctttgtcagatgggtagattgcaaaaattttctcccattctataggttgctgattcactctgatgctagtttcttttgctgtgcagaagctctttagtttaattagatcctatttatcaattttggcttttgttgccattgcttttggtgttacagacataaagtctttgcccatgcctataacctgaatggtaatgtctagattttcttccagagtttttatagtttggggttttacatgaaagtctttaatccatcttgagttaatttttgtatgaggtgtaaggaaggggtccagtttcagttttcagcatatggctagccagttattctagcaccaaattcccaattagccaaaaattggtttaagtgattcataaatctcaagtaaatctggatgttaaaggttgaaccttaataataattacagagtaaatggaaagtgagtgaatctcactggacttgtttctttagagccaagggttgaggcagagttcatagagcctgacttttatggattcaagttgtgcaggattttctgaccaaagcttcatcctgtgatttcatcttggtcagttaaatctaaataaattctactgtcatttactaaaatatttagggcattgttatgcaatctaagattatttacactttaataaatacatgaaaattctaattgtatttattgtgtcaagttttccattgcaaacactgatttatttttttcagtcaaataataactcaggaaaaaaaatagaccaggtgaggtttccttacacattatccatgctaccatttatttaagaaacatattattgatcttttatgtttttgcaaattccatgtaattaaaaaaaaaatgtaagaatggtcaatatctgaacttgcttctgtgttttccatgatgacctatttatgttgcattatagaatttaaccaactgtgtatgaaagtttagatgatattaacatgtgagtcaataagaaaagaactgttatacagaaatattggaatgatttgactttcaatattctatactcaattgtatgcaagttagataaaatcatgttgaattttatctcatgtacgttaccaaagcaatacaaattccttagaagttatataagtaaaaatagatttatttttaaattatcctggaaaacattgtcttggtattcaaaccattttcacctgtgtttatcatcagaggtttccatcttttagaacatttatttaccagttctcttgtatttttctcagctgtctgtttgccatatggtgttactttcagaattctctgtaatactgagaggttgtgcttgtggtaacataggataaaattccatgcagacttgaatatttgaaatcttactatatgaagattcaacctatacgaaaatagaagcttaaccataatttataggtattatgttagaaaaatcccagctatttctacatctattttttattcttttgtggacatgtagatacattcttagcaggcagatctggcctaaggcaagctagtggtatagcaacattggctttcctgctttcaataagacacaagttttattccccctgaagtttaatgcctcatatcttaatattctcttttgattcccttaaggcaaccacccatgaaagttgcattcagactcttcattctcagaaggtatactcaaatgctatttcttccagagacattttaattctagtaggagtcaaactcgtaaagaaaatggttgaaactctgagacaaattgataggtagcatgtatagttaagcctgctataaacagtaaaagaagcaacataaggtagaacattttcccctccaaggagaaaaaatcatgtccgttaagtatattttgattcattttttattgtaatttttgttatccctggaaatagaacaaaaacatgtgtcagctgactaccattgaacctgtacacaccctgcttcagcttttatccaatgagaaataaaattaagtcatgtaggttgttagagtctctctctctctctctctgtctctctctctctctctctctctctttttaactgaacctggctgcaataataatactgaccttgactgtgacctctctgtgtgatagttccattgctgtgccttagagtcgaatggtatctctacagttttttcagaattcttgggtaaaaaatgtagcaggtgttgtcaggggttaggaaagagaggctatttattctttccctgtagttttggatggaaataaatactttttaggtgatctgtttctaagaagtgcagttttccggaaaccacacaccgtattctcaaaactattttcctgtttcttccttagcatttagtctaatcatctcaaagtaaaggattattcttaataaaagaaaatacggctgctcacattaaatttgcttcaagtccaggagaaaacctgcttcaaattttttaaagacatttttgcctccattgtatatggattattagcccaatttataagagtaagtgccagaatacagtctttggtggtattttagggtgatactctcctgcaatgggattgattttagaatttgtagggtatatactagttgaggatgtaattggaatttgtgcctgtaaacctataagctccaatcctaaaagacacatgtttattcattcaaaaatatatatctagcattggtgttgtcggttactttgctgggcataaaaactcagagatgaatcagacacagtagagaatgtctgcaatctataggaaattatattctgaacagggacggactcaaaagtgtatgtgtgaatatatgtgctcttttaaatccaagaaaaatattttccacatcaccaattgtgccactgaaaaataaattgttattggtatacagtggcatttgaagatattagaaaactcaaatcaaaaagggaacattgctctgccatgaataaatgatgtttatacttctctttgcaaactgctatgtcacctccaggataacttgtcaagtgcattttcatattatgtttcaaataacactacccaataagtggaacttagaaaaatgtatcagtgtgcatattcttatgttctgaataataagaaatgtgaaatgtcaagtgatgaactaatagcaaacaaataattcaaacctctctaggttagcttgcaacacagagtcagaaagtgcatcaagaaaatgtaacagtgtgcagaatgaatttgtaaactgatttattgacacattcaaatgatacagtgctatttataggacactgtactatagatgttcctgcagttactggagaagaaactcttgtcctgtggggtctacagtgactgccttgcttcaataacatatgtttatttgccatatcgttgtccattttctaaaatagaatatactttgtaaggattttcaataagtttatgaatatgaaacgaaagtggatgactgaaggaattttctaggcttcattagttgacatgcactctttttgagttaaataatatgatattctagaatctaaattgattttctatgaaaatagaaacaaaaataggaaaaaataatattttgatctactccgttggtttacatgaatgcctgcaaaaaataagtaattttgactacctacaaaattgtatttttgcacataccttatagtgtctcttgttttaactaagatgaatttatgataaaaacatgaaaaaaaatcaagtggttaactctaatttgtttattaagctatgttagtaaaagcaactaatactggcctatgactttccaatttaaaaagaattttgtgtcatttcattgaactctccattagcatagtggtatgcttgataacattatcttctgggcaaaattagttgtactactataagtacccatatcactttcttgcggcattgacatctctagtatagcacttgatagtatatggtaggtatcttttcatatcttttctagactctcaagtctcattaagcaaaagatgtttattatctgcgccagtcacacacttcccaaattcaatatatacacacgggcttcctattggtagtaagactttattaactttgattgagttattgtttcaccaaatcgaaaactgaggttccaagatgttaataaatgtacccaagaatgcatatgaatgagaagtagaccaaaatgcaaaggtaggtcctctaattctaaatatcagttctttctaaaatcttgatcttccaacctttcctgttcttagcgcatttgaaattataggtctacacagtataagaaacattattaaaatgaatacagacatattttaaatagtactaaacatttgtgttataacacgtatatatgtaatttttcagaactgcttcctatatacaggtcacagggcactgcctcgtggttatttctaatccaccccacagttcaataactcagaattgtaaaatgtgatcaaataaagtaatcatgatgccaaattcccttaaggatgcatcatttttaaaagtttcttaatatgaacatttcgagtcagtgatttagacagctttgaatatcaatttttcatgaaaaagaacaaatgcgatgacataagcagacagtgatccacttgtgttatgaaggtagcagtaaatgggtgacaatttcttgaaatccagatatgttcaaatgagcagagttggcagcgtgtcctaggcttttttgacaaaggaatgcagtgtcattatctattactttgatgatttatctacgtcacagtaactgcttcaaacctagaaaaaggtaaaggggcaaaaagaattatttttcattgttctgctatgaatccatatcagcatttaggggtttgttttataatgttccttaaataagtttaatttctttacataagcaagtgataattaagtaagcacttttttgatagtaaggaataagctcacttttaaaattctgttctctcacaaacatttcatgacattatagaatccagaaatgtcagctataaaagagatcccaaggatgatgttcatttctcctgctttacaaatggagaaactgagattccacatgaatatgtcacttgatcaagagagttgacaactaaatggaaattagaacttaagttttctaaattcaggttcagaggccggcttcagtaaaaatataggtgttgggaaaatagtacagtgatttccatgagattgcagccatctcttcattattatggtcatgaatatacatatctcatttatttttcactgctatggctctatttcttatttcaaaatgtaaaaacagcaacttttctcatctcttggtggctatatgaacttcagcaatacagaattcagtggattgggccttctccatttcctatttacttctgattacattgttttctcatgatgcattttgttttcccatctggaattcattctctgggaatctcctctctgagaaagcttcaaaaccaaacagtgtttattttttgtaatgacattgcttgcactttcattctgtaatatctccattcagaaatctttaattgttcccaattcctttctagatgagatcgcaaattctctgcttagctttcaaggatcagcacactttcaatcactttttcttaacacttcccaaaacccacctggcgtattaatcaaactgactttttgtagcctctgattagtttcatttctgtacctttgcttgtttctgttttccttttttcctgcccacaaaagatgtaagatctcctttaaattgtgaaaatctctagattgtagtgcttctcttctcatgcactcctggctgtgtgaacataaaacatggaagaggttatcccaggtgtggtgctcaactgtctgggtgaggctttgatctcctgagttctggtctctgtttgccgctgtattggtgattttcatgctgctgataaagtcataccagagactgggcaatttacagaagtaagaactttaatggactcacagttccacgtggctggggaggctttgcaatcatggcagaaggtgaaaggcacatctcacatggtggcaggcaagagaagagagcttgtgcagggaaactctcctttctaaaaccatcagatcttgtgatagttattatgatcaaaagaataatgcgggaaagacccaccccatgattcaactactttccacagggtccctcccacaacaagtggaaattgtgagagttaaaattcaaaatgagatttgggtggggacacagcgaaatcatatcaccgcctacacctgacttcctttctgattcttctttcctgattagaactttcaggacttgaatctctcctctccttccctttttaagaccagagttaagcttcaacttgcttatttcaaaaacctcctactgagaagcactatcaatttgctacttatcactggtgatgatggcaaaatgatccaatcaattttcttccttcagttccatctaaaatgagtgcacacccacatatatgtgttgaaatgacttactttttgttttcttttggattggtatagtttttttatttttcataaaatctgtctgaaaacaattttatttagaaattaaacattatcaatactatatgtcaaggcaagcaactttctttggaatataatatatcctagaaatcaatgcaacatatttttacgtttagattacccccagatgcccagagcatttctttactggtgaaatacagaattcttggacttgacactgagaggaagtgtcagcagtgatctaaaaagtatttcttcttaaaataagggaaatgtgtgtgcttaaagacagagacattagaaaggggaggatgaacagattatattttttaaaaaatggttaggccgggcacggtggctcacgcctgtaatcccaacactttgggaggccgagatgggcagatcgccaggtcagagatcaagaccatcctggccaacatggtgaaaccccatctctactaaaaatacaaaaaaaattagctaggtgtggtggcacatgcctgtaatcccagctactcaggaggccgaggcaggagaatagcttgaacctgggagtcagaggagctgagatcacgccacagcactccatcctggcaacacagtgagactgtcaaaaaaaaaaaaaaaaaaaaaaaaaaaaaaggtgggtggggtggggtggggtgtgagagcaaggtccctcagaagttataaatggatgggcattagtgcatagctatctttattttccaggttaccccttatggaaaaaggttcgcagttaccataacaccaattaataaagccatatttgctggaaaaatcttattcaacagcaaagtatcacagtaagagaaaggacgtttagtaatttaatatataaaaataaaccttcggtagttttgcctgaaagaaggccagtaagtatcttaaacatcttagggagcttttacaagtgctgtagcccttgctttctgttttctagttaagcaaactttattgctttcaccaatgagttacagaatctatgactggtaattttagtcaaaaacatgagttcaattagatgtgaagatacaatcttggcatatgttcttaaatgagccaaacctcctattttaataaataaggtaaatgagcccaaatccatattttatggccattgctcagtgaatgactacacacactattcagtcacccacataagaaatcagtaatttttgtcattcttcttcctattacttctcacatctggttgaaaaacaaattcagtcaccttctaaaatatctttcaccactttcttctcttgtcattccactgccactgccttcattcacctctgtatcatctccaatttacctttttttttttttttttttttttttttttttttgagacagggtctggctctgttgcccaagctggaatgcagtggcataatctcgactcattacaacatctgcctcctgggttcaagccatcctcccaccttagcctcctaagtagctggcactacaggcacacaccatcacgcctggctaatttttgtattttttgtagagatgggttttcaccatgatgcccaggctggtctcaaactcctgagctcaagctatctgcctgacttgtcctcccaaagtgctgtgattacaggtgtgagccaccacacctggagactactaatttatactggtgtataatagtgtccaagtttctagaacattcgtccaataatggctgtaccacccagatatcaatgttttgtttcttctaaaatatagatataaccatatcatataactacactcaatgaaggagccgtttcagtggtttctcaaggcctacagaatataattcacatttactgcatgacatttactaacctgtgaagtcttgaatcaaagatacctagattcaaacataataggtatccaatacagatttgttgatagaaaaatgagagtatgccaaacagggtcaaatgaataagattattcagtttgccctcggcattcctttttgctcatctgttctgtagattcaatgatcgccaccttccatacatccactgtgcattcattctgacactggtcactgtcccatatgccaagaatacagaagcaaacaacacaacccttacgtccaccctaatagggttaataactcatagtagagtcagatattaaacaagttaatacgcagatgaatgcagaattactaattgtcataattgctggaaggaaggaaggaaggaaggaaggaaggaaggaaggaaggaaggaaggaaaataggaaagtgtgttccctgaaaagagagggaagcagactaaatttagtgtaagtgatggtgaactcagggaagcacttgcctcctgagatttgatgtaggacatgatcatttatccaagagaaaatgtgaagaagagcactttaggcagcgagaacaagtgtgtttgttctgttgttgttgctgtttttaagtttgtttgtttttgtctctttcttgaagatgctatacattcccatatttacactttattgtgatattgactctgttgcctggagtgctcttctctgtcattttatgtgtagtgaaattgttcttatcataccatctttttttttaaatattaaaactgtccttaccccttcaggcagaacttaccttgcctcctccctttgttcactcctttcaattgcgattatcccattgcttatagctaactgggtaatttatttttctctagaagacaagccttctagaaggggatacaacttctttattcaatggtaggtcctccgtgttattgaagacatgaggagaaatgaattcagattactgggagacaaaggggaatatttttcaaatcgccacttcaaaggatagtatgcgactcaaaatctaaatatatttaagaaagatatagttaattaatgccagattaacagaaattaaaataaatgaatattattttaacatagatccttacattgtttaagataaattcatacccaggggactaaatattctccaacttattttccttgttcattagagacaaaaagttgatttggattacttagaattaaaacctgttgtgagagcccttatatagaaattttaatagaatcatgtctagatagaaaataacacagtttacattaaacgtctactttcattacagcatacttggcaaaatatcacattttgtcttgttgtgggcttccattctttgaatgttactgaagcccagttcctaagaatccctggccaggtgtggtggctcacacctgtaatcccagcactttgggaggccgaggcgggaggatgacaaagtcaagagtttgagaccagcctggccaacatggtgaaaccctgtctctactaagaatacaaaaattagccggacgtggtggcacatgactgtaatcccagctacttgggaggctgaggcaggagaattgcttgaacccaggaaacagaggttgcagtgagctgagatcgtgccagtacactccagcctgagtgacagaacaagactccatctagggaaaacaaaaaacaaacaaaaaaagaatccctgtagtagtctgttctcacactgctaacagagacatgcctgtgcctgggtaactcataaagcaaaaagatttaatgggctcacagttccacgtggctggggaggcctcataatcatggtggaaggcagaggaggagcaaagtcatgtcttacatggtggcaggcaaggtagcatgtacaggggaactcccctttataaaacctgcagatttcatgagacttatttactatcataagaacagcacaggaaagacctgcccccatgattcaattacctccaactgggtccctcccatgacatgtgggaattatgggagctacaattcagatgcgatttgggtggggacactgctaaaccatatcaatcccctacaaagcccacaacatgtgggaattatgggagctacaattcagatgcgatttgggttgggacactgctaaaccatatcgatcccctacaaagcccagcaaagttggcttccatcccagtcttctgcagtctctctggccactttccgtcctgtttacctcatgcttctgctccatcctcactggcctcctaggacctctgaacatacccaccttgttcctgctccgagccttttgactggggtttgttgtgctagaattactactccacagatatcagataaccctatggcttgttctctcttttccattaagttctgctaaaaatgataccttatcagtaaggccttctgaaacctctaatttcaaggatgcttatccattcacccatactcctcatcttcctgtcatgccctattttccctataattaacaccatctgaaatactgtgtattttttttattatttactataatatgaaactctaggttgttcactgttgtcccccaactgtaggcactctataaattgtcattgaaggaaatgcatattaactttgcactcagcgtcactgggtagttaatactatttttcaaatgttataaaatcaatatatgttaattgaagaacatttccaagctgtagaaaatagaagaaaatgaaagtcaacaattatctagcaatcagtacagtaccatgattgacattttggtttacatattctttcagtcatttctttacctataaatatctatttcataaaatgaagatcatattataaatactgttttatagactacttttttagcctatcatgccataaacatttgtcaattgattaaggatttttctacagcttcacccttactggctctatagcgctccatttttcactctgtacctcttgattgcatggcctaatctgaagttacttaagccaagtacactgggaaaatgcttacctacagcacttagttatttaaagctaagtgggttaagtagtctaggaaatagacttggttttcagtaagtacattgcttattgctaaatgctaactttcagttaaccagttaatgaaaccagagggtcaaaaattgcaacatttaccagtggaccaataaattacaattcaaatgagcccagcccttaggaagattgtcaatcaaagctttaagagtactcaagttcatttagtcatattgtgattgaccttgacggtcttcagattattggtttattaaaagttctaggtagctcgaccttcttacgagactgtagaatttgagttaaaaaaagaaaagtctactgtcaccactgtgttagagattaaaacctctgcctagctcctgggtggtgattcagtttttgaatactatttccttttgttgcatgaagttataaaattaaaacttcaatttgttttccagattacagctagggtaaaaattgttttttattattttgtgttgtagagtttttttttttcttttaaattagaagatcaagttcgaggagtcaaaagcttaatttaaaaaaaaagcctcacaaatctatttcatttctagtacattacagttcagtagataatttgaaactgattcatctgttataccatctgttggaaatatgctacagctgttaaatgtccagcaaaatttgaactacttctcgaagtaatttgcccttggtacatgcagaccagacaattttttatttgatttacaaccaagatttctccaaacatgaccgattttctagctatactacttttatttcattattatttttaaacatagctattagacaaaccaaaatagaaaatgaaagaaatctgaactaatttttaagattaaaaataatgaatttattcattgccataagctattaaaattgcattgattgtgttcaatatttttcaaaatatatgaagacttcctatggtgtgccctacattctgcatattgggaaagaaaagaagttcccttcctcagaagaggattattggcagagaaatcaacatataaaccaatattgatcataatagattttcaatgatacagaatgaaaatattatattaggaacaccaaagtcttatgttctttttaagactaaaagtagatgtaaaagagctaactgacagtagtcaatagtttcaagtctcaaaaaactcatttgctggagccaagatatttaaaaagtcctaaagtcatgtactgtactgatgagttagacaaaccctctatataattcaggggttccaaattacaagtcattttaagttgttgaagatcagagatgatatttcttatgtgggatacagtgaagtagatctatgtgtaagatcatgggatgaagccatttctcttttgcaatgcagattttaaaatggaaaatacaaaaatacatcttagaagctaaacagatgaagtgaatacatctcaatagtcaaaactaggaagcactttgccttgcttgcttttagatggatttatttcttatcattgtcagtaattcattgattcaacagctctctgcaaggttgtgttatgctgcatgacagattttgaggctctgggaatagagagtggacacatcaggcacctgccttcctctcatggtatttacagtccattcaacaagaaaagtaataaagaaattaaaaacaaaccagataatttcagattgtggtgagtgctgtgaaacaaaacaagacagtgtgatagaatagtaagcaatgtctcaatgaagacagaaattgagttggttaatttagatgaactgatcagaaaaagtgaaggtagtatttgcgtcagaatcagagtggaaaggaaccagctcttttaaacctggtagagagaattttagctggacagcggagaggatggaaaggcctttgagcaagggtgtgcttggtgtgtatgagagagagaggagagtgaatctagagcttagtgacccagagaaggagtgaaataaaatagcgccagagatatcttcagggccagaccatcttgggcccagtggagcttcgattttatactaaataagaggggaagccatcaggaagccttcagggcatggcaaaatctgatgcccagttttaaaaaatccatctggcaactgtgaagaaaatggattgtaaggagataaagatcgaagcaggaaataagtgcccaataaatatttattgaatgaataaatgaaataaagttgatgtcttttgctgaggctattcaatgtaggcatatccattaaattgctgattatatatgggtttctctgagaacatctatttaaaactgcagaaacctctttcagttaaaagatgtgggtctgatttggcacacaaaatattgaaattcctgcaatattattatatagggtaacatttcatgtaaattcttagaatcaaaatgagaggtggtgagaacaatttgacaatttcaatattattaggtctgtgtagcccagtgcaacatatatgattttacctgaagtcactatagaaaccatttgtcccagaaaactagacttcaaaagcacaggccttagaatcaggtacaatttggcctttgtcctgactttaatatcctttagctgtgagatctgaagcctcctcatctataaaatggtaatactacccatctcaatgggttactgtgataactcaatgagatgacccactcaaaatatttacttggctatcacgtaagtgttcaataaatgattgctattactatcaattgattcgttgattgtggtttaatgatctctgccatctgtatattcatcaaggtccaaattggaaggattgagatgggaggtgggaaggctgcctcattcgggctcacccctataacactgggctttgtctcattaaatggaaaatgaaataaaagagtaaattaggtcacctccatctagtaggaaacaagagagatatagtaaaaagaaaaaaggaaggcagatgaatttattgtattcacttagcaattttcgctgtgtgtcagataagttatgtccaatcagttgatttcattccaattccattatctttagctttttcctaaattagcaattgatgacaaactaattgtacttctcttcatggtccttctgtttgataagttcttttgtgaacttatttgtagactctatgagaaaataattaattctcaatgcaattttatgacctgttttagcaatgacctagcactctagtattttctgtgcaaagttagttgcttctgccatgcagagcctaatataaataataaaagatctctaatataaaatgaaatacataaaatgaggctatatttgtatgggaatttctatgatagatcagtaagtgaaaaggtatgttaaagaccagattgtaaatgttttttgtttgtttatttgcgtgcatatctaaatatctgttacgttaaatgttgcatctgtgtatatgtactatgaagagtaataatagcaatgacttctatggattattagggttctttctttaactgtattgtatgaaattctacaggagcaagagaaagatgtatcttattttcaatagcaaagagtagtccagggaagctggagcaagagatacacaaaagcaatgtatgaaccataaaaatgggaggaaaatatggtataagtgaagatatataagctagattgagtagtagtcaatgagttctttgccctaagaaggagcatacatttttatagcatacttctataactctgaatgtttaaccatttattttatgttgttatgatttaaaaatctagaacgactgggtcaaaacaggaaaaggacttttgaaataatggaaaaactaaggaaactgtgggtaagacaggattaaacaagctgccccaatttatgttgctaggaataaaatctaaatattttgactctaaggagcatgctgctacctctgaaagtcacgcctttcaccaaaaagtattaattatacaaagttaagttaaacttgaccctcaactatgtctaaaaattattataaaaattggaagagaatatcatattctgtttcctgtactttccacatattattaaagaaaaatgtgatatgtgaaaattagaaaatgtaaaatataaattaaatttagacaaaatttggcttgcagacatcaggagtaatttaagaagctctggccaaacctcccaacaaacttgccttctgcttcccatcctgccttgttccttatgactaaaactatcttgaattacaagctgaacgaaaagctcttctatggcttcccaagcagcacagcagttcctcaagaggtcttttgtcttcccccgatgtccatttcagggtctggtgtcccaactcagtgctccaggactgcaccttgccttctgctcctgagtgtcccgatgttgtgtgcccccccacatttctgaccatcattagttattgcattaactaatgaccctgaaatggacatcagggggtagataaaagacctcttggaggaactgctgtgctactgatgatggaaaggaatagtcataacacgtgatgcagggtaaatgtgcaggtataggtagagtagctcgaacttcaaaaggcagaagttgaatgtacacgtaagaccacagagtgatgtgttcaactcagaatgtgccttttgccatggaatttttcctaatataaaagtgaggatgttattgctagaatttctgttcagctagcactgtctcattcttgagtcatttgttgtttttagttgttttcctccattaggcttatgttaccaaatgggtcatataaaacatctatttgaagtgttatagtttaaacatatattgttttgtgaaacattttcagacattatatttcagcagagatgcatttgaaaaccatacttttgtgtcaattacgtatattctgaagtcctttaatcttgtaaactcctgccagtatcccttgccaatagccaaacctctcagccgtatcttttaggtaaagggcaacagctatttcatgtctatttgccaataatttcctctgctccagcttgagttagtacaggattcatatagctagtctgccttcatgattgactgaaattgtgtgaaaataaaactcaaggcccatctgcttttctaattttcatccaagattccctggaagggaagtacgctggagaccaaatatttgccattgctgtgtatggctgtagttttggaagacatcccagtatgggaaaacacaatactggattatttcaaatgttagttctctttttctttcgctccttccctcctttactattatataaaaattctaaatttctccagggatttgactgatttcctagtatttaatgtctgcaggagattgagatacatgttttagtacaacaaaaaagcagactttttagaatgcataatgagtgataaccattattacagttggaaataaaaatggatagtatattgtaatagtcagtatggcaatatgtgcttgcatggagtgctgctacaaccatctctgggaaatttcaaattcattgtgggctctttcatgttgcttgaggtgttccctctttctaaaatttcctttctacctatctgtagtctctaatttcttcagattctattcattaattatatggcatctgacactctaatcattaatcattctgattcctaagttccttcatatttgttatactggataagaggtttggaaactcactctgtaaaagctcagatagtaaatagtttagtttcgtgggccatatgatatccattgcaatattctactgctgtgtgaaagccatcagagacaatacataaatgcatgatgtgtaactgtgctccaataaaactttacttacaaaagcaatctgtgggctgggttgggcctgcaggccatagttttctaactcttggtggttaacactattttggggttttcagagcttgagagaaacttaaacttcctcatattacttgtgtatcacctgtaggaaaggggttcattgacatattcagggtcacacgtttatgatggagccaggtctaatgagcaactcaactaacaacaaccctacatttctaatttatttgtggctttttgtatttgattttattctatttagcattgaattttaaaccatttttattactcttttgttgcttcatgtttaattactttttgtggattcatttattactgccacttatggaggaatatgccatatctttgtatgtatgtgtgtgtgtgcatatatacaaatggaatgtagcgaaatggaattatatatatatatgtgtgtgtatacacacacacacacacacacacacacacacacatatacatataatctgcctgaagtagtgaaaacagcaaaatgcagtgtaagatctcaataaataatcgtgattaatgtcctccagggaaaaatatagtaattgttgcattttttagcttataatatgattatagattatgttttaatttggaagaatgtgagattgctggtgctttacattctgataataattttgcagtcacctttaaaaaaaattgcttattggccctgatctttactaagctcaatttaattctaattattgttattctgaataattatataattttttcaaattattactttaatttttaaatttttaaaaattgatttgattttttaaattagtaaaaaatgtaaaatttggtactcagatgatgaattagttacagaagccaatttgtttaatgtaataactctaaactatattatggttttataaatgctacatataaattctaaatttaaattagctattggatcatttaatcagttatcaacttagtttaattacattcaacgcaaccatatctatccattggatattcactcttagaaaatgtgtcatgcattattatcaagtatgagctagcctgattgagcaggtatggactagaaaaatttctcctagcatgatcctgcagatttataacgtggctttcttcctcattttcttcatatttctactcaaatgctacctgatcattttgtcaaaactttccttgagaaggcagcataaaatagcaattctcttcctctccacctcacccccaaactccctgcccactgtttcatatttaatgttccttcttagtattaattaccatagcatactataaatttacattttttcgttggcatgtttcttcccacaaaaacataagctctacaagggcagggcattgttaatttcaccttcagctgcacttcagtgcttggcagttgatgcatatttaaatgaatgaaatgaacatgagtgaatgttagcacatttctaatataacgggaacattagaaggaatgtttactccaattaaaggcaacacttatctcaaaaattataaaaagttataatcaaatgtatcagaaagtaggaaaatcaaggatgtatgtttgtgctcacagctaaacagaagtagatgttttcgattaatatgaaacccattactttagatgatagctttgtgaattgatacttttaaaacaaattttaagttcttttcattcttttacatttaactttctggggaacttatttatacacacatgccatatttcacagaggcacgcagtataactaagaaaaataagcaattttacaaatattatatgaagacggatttgttgattttaatttccaatttgtatacaattgagtggtgagataataaataataattcatttctccagtatcattggggacttaagtgaatttacaagaaaattagtttattctttctgttgctaaaatattttttgcttataaatttgagagagaaacatttttgaatatatagagaaacattttctgttttattaaacagagttctgagcataaacatttgtggggaatttaagaccactactctaaaaattaagtgttgtggcatgttataatatgagatcttgcttccagactctttgaggttcattgggtttagtacattcattcatttatcctacaaatgtttttagagtacgtgccaagtaccattgttcagatcactggagagtaagcattaggccaactaaaacttcatttcagatagagctttctatctagtgggagagaaagacaacaaaacaattaaatgagtaacaacataacatatatgtattatgacagaaaatcaagcaggatgtggatacagagactgatggcaacaaaatgctgggtgaactagcaaaccctgtcctcagtggcaaaggtcacattgagcagagacctgtgacaagagaggatacttggagtagtagttgcaaaggcttacagcaggggtaggattgtttttaaaggaagaggaggggccaggtgcggtggctcacacctttaatcccagcactttgggaggccgaggcgagcagatcacgaggtcaggagatctagaccatcctggctaacatggtgaaaccccgtctctactgaaaatacaaaaaaaaaaaaaaaaaatagctgtacttggtggcacacgcctgtaatcccagctactcaggaggctgaggcaggtgaatcgcttgaacccgggagacagaggttgcagtgagccgagctggcgccactgcactccagcctgggcaacagagtgacactcggtctcaaataaaaataaaaaagaaaaaagaggaaaggggccatggtggctagacaggaatagacaagaacatggggaaagagataagactagtgttgtggccatcataggccactgggtggcggggtagcaggggttgggcaggggtactttgaacagtaggccaagttgagagcaggagccagagagcattttgagtacagcagccacaagttcacttacagtttgaaaagtgtttcttcagctgctgccggcaaaactatagcagagtgagaggggaagcagggagaccacacagtcttttgtaacagtgatctctggaagctgtatgtgccctatctgtagctatggagttgaagtgaggcagtaggatttggaacatcccagtatcagaagacttagccctccatgccatttcccagagacccagagagggacggtagactcagaacagtcctggccacgttaacattagaagcacttaggcgttggcaaaatgagaaagatccatcaaaggaatcagagagcaagcagctaatgagaaaaaagagaaaaaaaaatcttaatgacattataaaagccaagtgcagaaagtgttacaaatagaattgaggtattgcctggtttcagtgcagttgattggttgagcatgatgggaactgattaatttttctgtcagtaataattttcaagttgatggttattctgtctttacttgctgatgtctagttctttctttctttgatttttgagacggagttttgctgttgttgcccaggctggagtgcagtggcacgatcttggctcaccgcaacctctgcctgccaggttcaagcaattctcctgcctcagcctcccgaatacctgggatcacaggcatgcaccaccatgaccggttaatttatcatttttagtagagatggggtttctcctgttggtcaggctggtcttgaactcccgacctcaggtgatcaacccgccttggcctcccaaagtgctgggattacaggcatgagtcaccactcccagcctcttttttctattctagtgagaacatgtaacatgagatctgccttgataagtgtgcaatatcatctagaggtataatatttcacaccagatctccagaacttagtcatctcacataactgaaattttatacgtgttggttagcaactccccatttcttggtcttttggctttggtaggagtcctctttgtctttcctcctccaacattagtaattctagttccctgttcctataatgtataaatacctgaagatttccaggagatgccagataccaaagcttattacaggaacaagctcaattttactcatgattctcagatagcaagactgaggtgaagtcctttggagtaatgtgctttgctatggttttccatttgaatatcagggttatataaacagctcctgtgttatattatatttaggataacagaattgcctaaattcctttgctaaatattgtttcaaagatacataaaagacatatcagattcaatgattttttaaccaacacataccaatcgttatttcgaaatcgttgttgagtgtctctctccctctctgtcttttgttttcagaaaaatgtgatgagccacttgtctctggactcccccatgtggctttcagcagctcctcctccatctctggtagctattctcccggctatgccaagataaacaagagaggaggtaagccaaattttgattcttttatcaataaacatgttaaataagaacatgttatatttatagccatatatatatataatcacacaacagatgttggcagacaccagaaatcactcctgccacttctattaaaagatccatagatgccattaacctctcatgtaatctccacattgaaataacataggaaaacttaggctggaagttagagatagtacgtcaaaaaggaagacattttgaagttgcctgggataataaagtcaaaatggcataaacgtttagagttaaaattcctattaatcagaaaatcatttagaaagatgtaaaaaagaattgactcccaaaatgcgtacggtgtattaaaaaaagcactttgtatttactgtatattaatgtaaaaagttagttcctattgaaaatgcaaatgccccttgtaatttttcctccggtacccagaatgtagctctattataaaatctgtgtaaaaaatcgttagatgtgtgcaactacaatgtgagttcttgaccttaaatcatggtatttgttagtaactggcagtttcaaattttctagcaattcactgagagtaaaagaacataattaaggacagaggcaaaaaactcttttgcttcaaaggaacactggtacaaacatcagtgaatggcaacttaaaaaggaaagaaacaatattatctcagataaatatgaatcaacaaacagagaccatgatgtttaattcagtaaaacaggaatggtggtggttgacaggggcttcggtggagagggagaaaaaattgagatatctgttaaaaggtacaaagttttagttagacaagatgaataagttttggatatctattgtgtagcatggtgactatagttaataatatgttgcatccttgaaaattgctaaagtaacagcttttaagtggcctcaccatttatgaaaaataactgtgttgtgatggatatgttaattatcttgagttaattatttcacaatacatatgtcaaaacaccatgttgtatactataaatatataaattttttgtgactgcaccttaatacagctaaaggaaaataagaaatgtgaaatcataaaacaatctagaatcaaccaattctataaataaaaaaatgaaagggaatgaatataggaggaagtaagaaagggaagaagggagggaaggagaaagggagggagggagagaggaaggaagaaaggaaggaaggaaggaaggaaacaaagatgaaaaaagaaagcaggaggaaacccaaaagaagaacaagaagaagaaaataaagagagggagaaaaaatattgtatcagaaaagaaaggcatatcagatttagaaagaccaaaaaagagaagaaaatagataggaaaaagctagcctagtgtatacagaataatatataaggtattcacagatctatgaagaggtctcagtcagtaaaaagacttggtgaaagagtgatacacaagcaaaggtagaggaacataacaaaaatgcagttttaatgtaatattagtataaattagctcatttttataacctgatattcatcaggctatggacatgagagagttgttgagttactataagttatcaaaaattctgcataaagatgttgaagtaatataaattttaatatatttctctctcataaaagtcattgaaaacaactaaaacaatgaatatagacagaaaaacatgaaacaagggactggccatacccaaatggtaattatgatacagaccttcccattactaggaaatctaggacaaaatatgaaaaagaaataccatataattctaggtcccaagagagtgtactgttccctaaaagaagtgccataatgccgagagacataaagcacctgtgaggaatggaagcagagtcagaaaatgttactttcaaaagttttgagtgaaaatacgactgaagaagatgatttgctcagtaaatttgggcaagtcaggttctgtcatgcaaacagcacttcaggaatacaaatgagacaatctagtcaccaatgagaaaattgaaagtgcacaataaagaaattgtggccacatgactggtgttgagcaaggaacccatttccatataagacctcgactaaacgatgtaggagctatagttgtaggagagagtataaatgttataggcacagaaatgtaaaagtgtcaattatgggaattagagagatgtgggtgttttttcttcctaacctttcagagcagcaggttaccagatgctgaaactttaggtacaaatttattctgcctttggttttttaatgggaattaacatcttttacaagaaaaaatatataggttttttgctctcatttaattctagaaaagttaaattattttttctttgttttaacataatacaagataccactttacaccatttagagctgcttatgtatttatctactcatacagagagagtcaggtatctgatattaagcttccaaagtgttaatatatttcttaacttggacacttggatttgaggagtatctttactttccttatagtagttttgtctgtagtttgtagaatatatatttatatctacctagatgattgacaggtaggtaggtaggtagatagagagaaatagaatgcatttccagaaagacagatgtttcaaaagcaaaaaaactataaaacaaaagttacagtttcttaactgtgtgacccacagttcatctctttttgaccattgatatactggattgtcatacattagggtgaaattatcacgttgggaaagaaagtgttgtctgtcctatagatatagatctacacttcattgtagcccattttatcatttgttatgtggggatgtgcagctacgtactttttggcttctaaagactgctttgcttatcagcgttatgctgtccataatgacatataactcgccctccccaacgctctcatttttgctccctaatttttacggatggtgaggtaactaagctatatcttcaccctttatgctgctctgcccctgcaggtacagcaagaaacatacatgtagggcttcacccttgttggccacgtaaatgtgggtcaagggaactagcatgagaaagaaaggttatatcctctccaaggaaaaacaaaaagaaagtcatacatagttgttacaatacaaaactttttttttttttttaagacagggtcttgctctgttgcctgggctggagtgcagtggcatgatctcagctcactacaagctccacctcctgggttcaagtgattcttctgcctcagccacacaagtagctgggattacaggagagtgcccaccatgcctggctgatttttgcattttttaatagaaatggggttttgccatgttggccaggttggacaacaaaatattttcttccactctaaaatttatatgcaaatgcccttgggagaagagccatgtagggtgaaattcttgaaaacatatatgtggctaatagccagcattgagagaaaagagatttttttttttaagtatagcatgatgttatatatctggaagatataaagaagacagacaattccaagcagaaaaaatatatgaacattatagaatccaggaatgttggagatacattttcttaatttacaagtggcaagagtcatctgatacagacactatataagtatctgaaagtgagaagatcatatactaacagaaaaatatcagaatgtaacctactaattatacaaatgcagaaaagaacaaattcagttgagcattatgttgataaacattggcttcaagttttattatttacttaaatgatattcctaaagtacattttggagagaaagtttataaatacataggaaagcaccatataaatgcatatattcaaatgacagattgtcacatatttatgaaattgaatttagtttatggttctccacaatacaaatccatctgctataatcttgatgtcagggaccagtacatggcaaaagtatggaggaaatgagatgtttaaatgaaaaatccatgcgtaattctgacatgtcttttggagctcattgtttttagtttattggtgctgttgttttcttatcaacaccttattcctgtgatctgtgttctgatttatccccacatttttaatccatcgaaggcttcccagtcttgtgtcattctgagttagtagcacttagatgtgttactctttccaaggttagcacagatacaaaacctttgaaagtttcaaacagcatatcccttaccttacttttaatatagaattttacagattataaactgctttcatctgtgctctaattgtttctcaatcttcataacaacctggttagaaagaatggtcagttagagatgccaatcaattcttctgccaaactttcaaccttgtacttcatatgccttttgtagaaatcagtccttttcttctgccagagagacagccatccaccacgtggtccaggtctctctccactaccacagaggcttagtgagaacacctgatctcaacggttgctattagaatccctctgctttgttacctgacatcgttttgggaacccaggggactactggggaaacgataacaggctatgtgtaaactagagagaagaggagagcaggtgctggggaagaagtgaagacatgaggccagggtacctgcacagagaaggatgaatcaagctctggtttcactcacaggctctttcagacccctgtttccaacttgcttaacctctgactgaacttcagcttgagtctctcagatgtatcattccagttctaatggtcacctccccctgtctgagctcattaaagtaagtttttcttcctagttactaaaggacttttggttttaaagaaaaacacaaacaaaaactagttattatccccgttttacaaattcaaataatacatatagaaaccccaaaatacatcattaggttctaaagtagcatagctagggaacagtggcacagggagagggacacaaatccatatcttctgctggaacccaacactctttatatgtaattacaccagatgaggtaatatcagtgctgcctttttgaattagcccaatgatggtgcctaaaatgagtttgaagatttgagtcaagttcaatttatttatgctgttatagccagagaaacccagtcatgcaatctcagtatttcccaactaatgtagatcctgaataattttctttcttttcaccttcctgccactgatttttacttagtagatatgtctaagaatcttgtttgttgcctcctcaaagatgtttcctcctatgtattttccctgagtaatttctcccattttaagaatgcgtcatcttctctatcacaccagagggcagaaggttgtggtggtgatgttgttttcacattagttttcctctatttccttcagcagggaaaacacattgcacttgcggtcacataattaataatcacttatcaaaggagtatgtgaataacagatgtttggagagactgctagaatagatctcttgaagtttctacgtgtatctcaaagagaaccacagtccttacctttccttaaaagacaccactttatactagaatgatttataatcctttgggtgtgtacccagtaatgggattgctgggtcaaatggtatttctggttctagatccttgaggaattaccacactgtcttccacaatggttcaacgaatttacactcctaccaacagtgtaaaagtgttcctatttctccacatcctcgccagcatctgttgtttcctgactgttttttttttgagacggagtctctctctgttgcccaggctggagtgcagtggtgcgatctcggctcactgcaagctctgcctccgaggttcatgccattctcccccttcagcctcctgagtagctgggactgcaggcgcccgccaccatgcctggctaattttttttttgtatttttagtggagacagggtttcaccatgttagccaggatcgtctcaatctcctgaccttgtgatccacccgcctcggcctcccaaagtcctgggattacaggcgtgagccactgtgcccggccggtttcctgactttttaatgatcaccattctaactggtgtgaaatagaatctcattgtggtttgatttgcatttctctaatgaccagtgatgatgagcttttttttaacatgtttgttggccgcaatccaacccaaatggccaccaatgatggactggataaagaaaatgtgggacatatacaccacggaacactatgcagctatagaaaagaataagttcatgtcctttgcagggacatggatgaagctggaagccatcattctcagcaaactaacacagaaacagaaaaccaacactgcatgttctcacttataaatgggagctgaacaatgagaacacatggacacagggacgggaacataacacaccgtggcctttcatagggtgaagggcaaggagaaggagagcattaggagaaatacctagtgcatgtggggcttaaaacctagatgacagggccgggcgcggtggctcacgcctgtaatcccagcactttgggaggccgaggcaggtggatcacgaggtcaggagatccagaccatcctggctaacgtggtgaaatcccgtctctactaaaaatacagagaattagccgggcgtggtggctggcgcctgtagtcccagctactcgggaggctgagacaggagaatggcctgaacccgggaggcggagcttgcactgagcccagatcgcgccactacactccagcctgggtgacagagcgagactccatctcaaaaaaaaaaaaacaaaaaaaaaacaccctaggtgacaggttgataggtgcagtaagccaccgtggcacatgtgtacctatgtaacaaacctacacattctgcccatgtattccagaacttaaaaaaaaaaaatcactaaagccatagtttccagtttaatttttaaaaattaacataaaaagacacaaaagacaccactgaagttcataattgccacgatgcctttataccacagcttgctcagataatcactgtaggctggtgtcattttccacttcctgttggccaggaggaagttctagtgataagcatgacgccaacctcttccctagctcacacttacatacacatgtccccctccggaaacgcgctgggctgcctcttacaggctcccaggcagttcagcaaacagtaaaaccttattctactcttgagaaatctattattcctgctactcctagaaagaaaatttttccctttttcccactctcaattctcttgtctctgagttgcatttataaaacaccttctttccctctgctttttctttgctctcctctttttgcctttaaatattagaaggatctgtcacaactaattaaatctagaactgcagctgatatactataaactgggaacggaaccacagcgcgtccatgagggcattgtctgtctgtgtggcctagctcctcctgctggtactcttctgctgtctctagtccgtgatgtactcctttgttacacatggcccactcatgaccgcccgaatcagccacagtaggcggtattcttaaccttaattaggaagctttattcttagaatataacatcaaggcttaaattatgaagtagactcaagttcccaattgatgagattctgccctatttttgcagcttccattccaatatttttcctctttccctttgccagcctctaccatgtagtactttttaaaattttctccttttctcactcacaggtaattcattattacttaagtatgaagtaatcggtgaagtgatacctctcaggacgatttgccttataaaagcacatccttgggagcagaaaaattcaaagaactggtttcctaatggggcatttcaggatatttgacattcctattttggctggtcatacttcttcatcttcaattggctctcctggaaacacctgctgattttgtcggctctgaggcagtgctgagcagtaaaaggagagtggcttgtcttcatgcctaactaagttccagtactgagctgaccaaggacaagcatgggattagcaaattatttaaatgtattatatcttggtttcctgatttctatgattactatatctgaaccaggatataataatgataaaggatataatatggaataatttgtcatctgagtcaggaacttttgacagtgaaagagagtatcattaatagttacacaaggataatcctgaaagtatggtccctctacttgtagtttaaaataaaatcagttatactgtttagcagagctaccgtgaaggttaaaagaaacaatttacacaaactatgttgcattgaaatattagtctctttcccataagttactcccagcttctaaaaacaacactatagataccaacattttaaaacgaggattgaattaaatacctttgtcattacaaagacgatgcctccttaaaaatttattgtttaaatttgtgtatttgccaatgtatgtgtgttttcccccattatcatctaagacaaaatattatcataataatttaaaaattagtaaaataacatttttaaaactttcagtatttttggggtgttaagacttacagtgacttaaatattctgcaggacttttcacctcaaactcctttcaatttaagtgaaagagattatgccagtgatttttaagtgttgttttgttcttattatcttaatgttgtttgaatttgatctcttagaatctatatatcttatagaaactaacatgtagttataagcctcatataaaaaattgttctggacattagggcgaataaaaagtatcacctttgttttccttagcccaatatattctatcttttaaatacaacttttcaaagatttcttctgaagacctcacagatttcatatccacctccccaaatgaatgagagtttccatctaactggtattgtgaattttaatgtattcttttttacttaattctcaaagataaaccaaaattttggcttgactgggagttttataaaattaaatgtgtaatacaggaatatgtgtatcattgacacttgttataaatgatagaatgttgaaagcaaactcaccaggcaatgactcatacattttgtttgggcatacctttttaaattttaaaatagtattgttatttttcaaccattacactcaattttaaaatgttggtatttcaacaccttgtttttgttttcttcatagaaatctgtgctaggttttgttgcaatttccatagagcaatgcgtcccaaagtgcatgatgttaatatgtgtggtgaacacacgtatatacatacaagtttccataatcaaatcagactggacagatcttgtgctctgggatcttcttttggagaatcacagatcgtctttatcacagaacatctttaaggccagcagaatacatttccactttgggatttgcttttataaaatttagctaaacattgtgcggatcacgggctttcaatggggtttctttaatgtacttagaaatatagtcgtatctcccatggtttcactactgtgtttctgaaaatactgattataaaagttctttgataataagtctagtgatttttagtttaacagaatgaactagacttaattagagaaaggggaataaagataaaagagtttttcaattttggacttttgagatgaagaattttttagttaattatttttaggaagttactattttcccctttgtgtaccaaattctatatatcttaatatttgctattgagaaaatcatgtactggcttaacatcaatgctatcacattgatccctgctgccgcctttgaaatggctctggaatattaattttctaacactctctttagatcacaacattaatagctgactgtctaaaagagggggaagtttgcgaataattcattattataatatgtttggtaattttagtttaaacacaatactgaaaactatcctatttggtactggccctataaagtttaggacatatgggatgggataaccacatctgaattagcaaatcaatgtatttaaacaaacaaacaaaaatttaagaagatgtgaagaatacatatacctttgtaagattgttgatatggatctagatttttcgttacccataggagacatcttgggccacttcctacttgtgttcaattgccaaaattcctcactcacttctataatgagaaattttgagtggacactctctaggaccctgtcgtcactgaacgcccgttgtgtagccaagaaagatcataattccttggtcttgatcttactgggctcttacagattcttagtggtctggaccacacctccctctgtgcgtagatatcgtttctatgaaatttctggagaatggtcaggatatctaggcaaaaagctttatcaaatatttacacactgaatttttctttctaaaccattcaagaatataggcaaaatgtgtttacgagaataatcatttaatattcctttatccctttgctttttttttttttttcttttaagacaaggtttgtcacccaggctagagtgcagtggcatgatcagggctcgctacagcctccacatccttgtgctcaggtgatcctcccatctcagcctcctgagtagctaagactatagactcgcaccaccatgccctgctaattttttttttaatgtttgtacagacagggttttgccatgtgtgtcaggctggtctcgaactcctgcactcaagtgatctacccaccttggcctcccaaagtgctaggattacaggcatgagccacagagcgcagcctatatgctaactttattcatagagagtctttagtatttttcacatctcaaataaggaggtggagaatttttgtgaatgatttctaccatcagaaatattcattttaaaaataaaattcttcacagcctgaaagcactttcatgctgtacttatgcaggtttgactctcagagaatattttctaaatgtgtgaacaagtacataaaatattatttactgcatatattattctactaattgtaaatttcaaatactcattgcttatatgtaggaatcatttgttaaatcaagagttaatatttgctggtacttttcttgttccaaaaaactatctcacaaattgtttggtcactgtcgtagccaattggaatctagactataatagcagatgagtaacaacaaccaacgcaattatcatcataaataaactagaaatttaaatctcatttttaaaaatgaatattcagagtcattagagaatggccctctcatatcaacattctttcaacacttccaatattgtagaacagagaccatgaggataatgttgagctgataaagcatgcctttcttatctcaagatattatttcacatacatggctttcgacttgtgctggcttttgggtaacagaatacattgtatcggtccttaacactgtatctggctcataagaaatacattctgtaacccagtagaagcagtgtagcctacaagaagaaatgaaggccaggaaagaatagggcaagtccacaagtagccgtttgggaagctcacatcagctggttggtgagtggcattgaacagagttcattcaatagacaagtttaggccataaaaaaactgcacctgtaaaaactatagttcaaacctgaaaattacaattcctctataccaaatgagtgactgtatttttcaatatctactctcctgtgattaaattccatgcttttgtgactatttatccctttttctttattttacttattaagaggcagaccaaattatttccaagacaattgggaggacttaatctaataatgactctgttagcaaccggctcaggtcatacttattaaaatgaacagacccttctcttaatacccttagcaaattagtgactttttcacatttttttctttcagaattaagaaatatagaattgttcttttatatgcatgccttgcaaaagtaattctaaaaaaattgtcactaataagaattcaaagcagtgtagcctttgttagctgccttttctatacaccaagaatgagcaatcaacattgtttactcatcctcttgctttaaaactcagatatatgcttgacgcgaatattgctgacaataaaacatgacatttaagacagtctatttttattgttcttgcctctttaacatcaaaatgtaaacacaaaatgtagaaagatttcttccccaggttttcacccaaaggtcattttattttatttcccttagctattatgattttcttagcaaggtaaggaattcatgttgcttttattttgcttggttttcattctcagcaacttttgcaatgtatttcctttgcatctgtcttctgctttaaaattgatagacaatggtatctgtttgaactgcgggtccttgtctgcaatatgtctgtaaccaccacctcaccagacatccacaaccggaaagactcttctgcctccaggatgaattattttgcattacaaggtttgtgcctgagcatatgtatgaataatgcataattaagcgtgttctataattttctctagccagtgtctggcacatacatatttggatggataacgaattgggttttgttttgttttcaaccctctgcttagaccaccaaataagtcttataaggatctactcttaagatgatgaaaagtattgttgacttccttactcttcctccctgagtgttctagagggtggaagttaaaatcacgtgcttctgaggtgtacaggcttctatggtactgtgtgcggaattggtgggtttttggtctcgctgacttcaagaatgaagctacggacccttgcggtgagggttacagttcttaaagagggtatatccggagtttgttccttcagacgtccagatgtgtctggagtttcttccttctggcgggttcgtggtctcgctgacttcaggaatgaagctgcagacctttgcggtgttacagctcttaaaggctgcacgtctggagttgttccttccttctggtgggttcgtggtctccctggcctcaggagtgaaggtgcagaccttcacggtgagtgttacagctcataaatgccgcacggacacaaagagtgagcagcagcaagatttattgtgaaaagcgaaagaacaaaccttcccccgcgcatgagggtacccgagcaggttgtcactgctggctggggtggcctgcttttcttcccttatctggccccacccacatcctgctgattggtccattttacagagagccgattggtccgttttgacagagtgctgattggtgcatttacagtcctttagctagaaacaaaagttctccaagtccccaccagattagctagacatagagcactgattggtgcatttacaaacctttagctagacacagagtgctgattggtgcgttcacagtcctttagctagacacaaaagttctccaagtccccaccagattagctagacacagagggctgattggtgcttttacaaacctttaactagacggaaaagttctccaggtccccaccctaccgagaagcccagctggcttcacctctcaatggcactggccacgggactttgtggcacctagcccaggcactccagcagcccagagggagcttgtcccccaaacaagcccagcaggcgcgggctggccaccaagccggcgcccacctggaacccgtgtggcctgagagcagagggagcggactcttgcctctgccagccccagagggggacccccacagcacagcagcgggctgaagggctcctggagtgcggccagagtggacgccgaggccgaggaggcaccaagagccaggaagggctgctagcacattgtcatttctcagtactagagtcatagggattgctagagactcttctcgtattatggtaaggtcatatgttctcataggatcatatagaattcccagaggaggatgattaaatttattccaacaagaggctaataaagcagaaatgatgacttctttactgttgaagggctggcagtccacaaaaacaagtgccaagaaggccaaaatagcaaaggatgttaccactgcccccaccacatttatattcccaaaccttccacacacctacattcacattcaaatagtattaaagtataagcacttctcattggtcttcaggtttttttttaattagatagatcagtcttcttaaacagcattaacatgtttaagcttcctgtcctttggtagtgacttaagttgtcaacttccttaaaagtcattactgacggcaaagtatttctttttggtcatttcaagacatccacgtgtttttttgttttgttttgttttgttttgttttttcgtctatctctatctcagaacttataatgaagtattgtattgtagacttatttttctgaccccaagagactgggtgggtgtcacctgaagacatgtcctgtgtatcaagtatccatgaatacttgacatacaggatgatgccaagaacagagctgatattcacaaatgtagaaataaatgcttgtatgtacatattattttatctgatccttacaaaaccctaggaagaaattcagaagttacaaaactcagtttgatgaataagaaaactgagattcaccaagtttagattcttgcctaaggtcacagctaacagaaactggatctgagtatttgaaattaagtcttctgacttcaaaataattcactattctgtcctccacttgtcttccctgactttgtgagaacttttcttttggaaaaatttgaataatatttgagttggttataaagcataactaaagttttcccactggtgttttagaacacaaaaagagacatttctctttcatttctgagaagcgtatattgagtagattttcattcagaatgcctttgtgatttctttgcatgttttttaatctgttttaaataatctgaaagtaaaagaagttattttaaatatttgcatataatgatgtatttgttaaaagcatatctttttttcactatactaaaagcctagccaaaattgaaatcaatttagtctaatttttgaacttgtattatgtggggtggcaggcaaaaaaaaaaaagacaaacctgtactctaaatattatatatgtgggaaccagtaaagatttgaacagaacaatgagaccaacattctctctaccagaaaagaatttaaataagaaaaaactactgatatgcagcaccaatacgctagaatctgacagaagctgtatttttaaagtcactaacactcttaatattcaaaacacacctgggaaaaagcagtaagtcagtacaaagtgaaagaaaatgaataacaggagtaaacctcaaccacaaaatataaagtatgtgaggcctactagatatgccgtaagtggatctacatttagtgtgagatgagaacaatctggcatcaataataacaatatcccattgtatgatcattatcaatcactaaatgctttcttccctttcaaataaaggattcagcattgtgacattttgcctttcattttgttgttgtttagtagaatgaccatacttcctggaaaactagaaactcccaagggaattgattcattcttttctcccaaacttctttctatcaagtattaaataaagtaaagcaaagactcatttgaccaaatctttcaaagttaccattatctaccttctctatagattatttaagacaatcattgatgatggaaaataattttctaaagactgtttccaagaagcacaaaatacttttggtttttaattcaaaatcctgtatttgaatttcaacaattcaaacaagaaattggaaaccaaatattggtattttgtacaccaaactgtgtttgttggtttcattcccaaagaaatagcactaactaggaagagaagtatgagttttaggctttcaaatcgtggccatcaggacttgagaggaaatatgcaggtgccccagttttagggatgtttattggatacgtccaaatgatgcaacttcagcaaaactatcttatcttcgtgatttggtcagtgatttttttttttttttttgtaagacggagtctcgctctgtcgcccaggctggagtgcagtggcgcgatctcagctcactgcaagctccgcctcccgggttcacgccattctcctgcctcagcctccggagtagctgggactacaggctcccgccaccacgcctggctaattttttgtatttttagtagaggcagggtttcaccgtgttagccaggatggtctcaatctcctgaccttgtgatccgcccacctcggcctcccaaagtgctgggattacaggcgtgagccaccacgcctggccgatttggtcagtgatttctatgcaggggcctggagacaggctttgagtacctcagtcttttttttttttaactttaagttctggggtacacgtgtggaatgtgcaggtttgttacacaggtatacatgtgccacggtggtttgctgcacccatcaacccgttatctacaatagatgtttctcctaatgctatccatcccccagcccctaccccctgacaggccccagtgtgtgatgtccccctccctgtgtccgatgttcccctccctgtgtccatgtgttctcattgttcaactcccacttatgggtgacaacacgtggtgtttggttttctgttcctgccttagtttgctgagaatggcggtttccagcttcatccatgtccctgcaaaggacatgaattcatctttttttatggctacatagtattgcatggtgtatatgtgccacattttctttatccagtctatcagtgatgggcatttgggttgattccaagtccttgctattgtgaacagtgccgcaataaacatacatgtgcatgtgtctttatagtagaatgatttataatcctttgggtatcagtcttaatttagcatcttgtggttccaagtgagaagtttaggtagacagacccagagatgccaatcagaactcaacatgctccttgcagcactgggaaagaaaacgcagggtggaggaagcacacagtcagtggttatgacagagataaagaatgctgatgctttgttacagcttcactttcatgtatttgtgagctctttctaacttttccttccactgatatgacatacatttggaaattatcagttctcctcagcaatttatcaatgaaatggcaaggattcactaaggagtgataaacaggcaggatgttttgtcaacagcctgaaatacgttaatcagcttctggaatgccaacaatttaaattcaaatagatttctcactgagcctgagatctaaaaccctgtgatgctgtttctgtttattggattaatgtagattttaggttcctttgtcctcaactcttgggaatcccccctactatttttttctttgtttggatggcttagttggaatagaaaaaagtgtggttgatttcttcagaagtgttatctgtgtgacctcatactcaactgcgggaataacagaaaggcagaaatcgggaaataaaaatcctgttgccgaatgagaattctacatctcactgccgtttggaatggtacagtgattcatatttcaggcacctcaattagacattcattattcataaacacttatgtaactctgagttattcaggctgggagagaacattgcaatctttctttttccttttctttattatatgacatcttatatcaaaaaaaaagaaaaagctaaaaaaaaaacactctgctacatgtaaatctgaactatttattttaggcaaaatggcatgaataaaacaaagctgatctacatttggctttgtcttgtcaaagaagcaatctgaacaaataggctaagatcaattctattagaggtgaaatacggaccaagataccaacattgatcccttcagccatggcccttgcatatagttccaatgtacaataatacaggtcaggacctggaaaggcctaaatgataagactaagtgtcaaaatcagtgttgaaaggctgctcaaactacagaaaatgaggtatccaggcatttaataagcatgcattgagctaagcacataccaccactaaagattcatttgcatgtgggattaaaacatctgaaaagttgacaagggaacgttttagagactctgagatggtgacatcattatgacacaaggcactgttggtctgaagcacactggtgagtgtccccaaccataaatttggagatagttcaggtggcatctgagtattaatcaaaagaaaatagatacttgtcttactcgatgaaaataataattattttttttgaaggggcatcaataatttaacaaatatttgtggtttactttgtgttcagaacatgttgtagtctatgtcagcactgtctggtaaaatacatggtgagccatatatgtaattttcaattatctaatacctgcatggaaaaaaactaaaaagaaacaggtgaaatacattttatatgttttagttaaactaaaatattgaaatattgtcattttgttatgtaatcaatataaaaattatcaatttgctactttacatttttcatactaaatttttaaaatctggtgtgtatgttacacttatcttgattcagaaactaaatttccatcagaaatacttcatctatatttaaatttcacaacatttatggtttaaacactggactcacatagccaaattgctcccaaaatatctaaaatgttctcctataaatgaattatcagttttaaaatatacatttaaattatttaaaataaaatagcaaatttagatctgcagtctctcaggcatgtgttagtccttctagcaacatgccaagtctgagtagccacaggtattgacacctgcacctgtgggaatggtgaccctggggatgtgcagggtgtaatcatatgcagtggcattaatctttggggagagtcagaattcatttatagcctggtggtggctaagagatggcagaattataataactgaggaggctaagtacttaacatcaatttgcagggcagtctcattttatcaggaaaagcaagaatggcagaggcaagaatgcgatagctgttccttgacattggaaaaccttcagcaaaacccagggtttgggggttccccctgggtgtctgaaatgtagcattcagcactagctccagcctttgggcagctgtgggggccagagaccaagtgtggtccctggcccagggtgggattagacagcataagtggtgtcaagaagtatatgttagagttaatgaagagtaggcagtatgtggatcacaactctagggaccatcaaataaaacttctttcagttaaggcattttgtttactgttaaagaagacaggactctaggatgtgtcttacttttccagaacatgttacaaactgatgtttcttgagattatgttggggtatgctcagccagtctctctcaccgggttctagagacagctgctgctgattttgagggtaaaaatctagtattcattgatctgaacagctgaaagcaaatcccttttgatgcaatcagattgactcaaagcattagacattttctctctgtgcagactaggctaaatgcccttggatagtctgtttcatgggcttagccttagcaatatggacctggattaattactctggcattgtgtaaactctgtaactatgtagaaatagtattatctcctatcatatctctatgtctgaacattatatgcaaccttctgtttattatcacagtaaaaaagtctgtccaaatcattgtatatgcataatttctattatgtttagagggattgatgattagaagttgataggaagacattatttaataattacaagagaatgcattctttaacaaggataatatacctcattaaaaataaaaatcattgaattatttctctactgaaacatatcagtgtcagaaataacatgaccctaaaggatatcagttgtgaataaaagccccaaagtggggattaaagtattaatagtcatgggggtaggtatgattttgcagaggtagaaactgaaatacagataaataactttcccatggtgtctgttgtatgtagtgaagccaggattaaaaaactaaggcctatctaactgtgttttttcataatgaggtactaactatgatacgaatgctccaaagctgtcaaaccacgagaggaataatgtattataccgattattcattcagaaaaacaatacaagtacttcaaagtagcaagaatctactctaaacaccattttcacaggtataaagcaaaaataggatttgatctttgaaaatatctattttaaagaatttagtatattgtgcttttatatcaattatgtactgccttaaacattcatcaagttctgctctaaaatgcagcatctctgaatatgacctgcagcttcatatgctatagacagagtagtcagagaaagtagaaagcaggggcacccattgcctttgaagagttttcagtgaaaaatttaaagaaaaaacgctaatcacagacataatgtaagtatatgaatataactattttcccctaaatctgaacatagataatgcaacataaatctcatgataaagagcaatctctaccttatatagcttagtggagaattagaatataattagtaaatgttgaaaataaagatcaactatgttgatggtattttaaaccattcagttctgtatatcgacattttgccaacactatgctaattctatggctctctttttggccctgagtttacttagtattctccacagtatactctgacctcgcaaatcaacattcatggtacaaaacattaaaagtacagaatatattattgttaagaagaggattcacatgtaaagatgacaatgaaagtgttcctggggaaaactagcaagggagtggaaagtgggatggagaagtaaagtcagtgtgccaaatgtcatggaatgtaaccttggctcagatcccacagggaagctcttgagataagtcacatgtcacagctgtctgaagcaggggctagaagctggagactttatatgcctacatctatcagacgttggttacttttcccaatttcccaactacccttatgttcaggcaagatgggttctggcagcctgagggttgtccgcagacaaaatcttatggattctagctattatttgataaaattgacatgttcacaccttatgccccagcaatttcaatgataggaagacatcccagaaaaatgcctgctcatgtttatgggaagatgtgtattaaaaatatgcagagaagcagtgtgtattgtataataacccgaaaatgaaaacaacttaaatgtccataaacatcatcactgttcaaagcatatgctacattttatataaagaaatacaatttgaaattcaaagggaatacacttcaagtaaatacacatgaaagaaaaatcataatgttgattaaaataagtcatagaagaatacatacaatgtcatttcacttacataaaatccaaaaacaggttaacagtatatactttaggaatatatgcatatatgataaaaccagaaagaaacagaaaggcatgctttattgaaagtgaaggctatcggttacttctaagttgcagggagggagatggtgtcacaggaccaccagatttgtatgcttgctgtgcagtaacagacaaacacactgagacagcagggtttgcaacagagaaagactttaatgattatagggcagctaagcaaggacatgagaacgaccgtcacatccatctccctgaggagttctgggctggagtttttaaggggattgtggagggtgagcggctgtaaaattggggttttgattggttagggtaagagtgatgaaatcatcttgatgcggaaactgaattttttgtcagcttctcctggggtactttggaccagctggtgtcagtaattccacccatatgtaggagctattgtagatcaagatatgaagataaagaagatctagcttctgaaacgcagttctataattaaagaagtgatataacggtatagggacttagagggccgactatgacttcctaggttagaaacatagcttggccacttaaaaactgaataacctcagtagaacctcattgatttcactgaaaatcaacttccttatctataccatggaggtaataatgctgactaccttattcactttgtggggattacataagttaatacatgtaatgcatttcaagcagagctcagaggcaagtgaagcactcattaagaaaacattcttggccgggcgcggtggctcacacctgtaatctcagcactttgggaagctgaggcaggcagatcacgaggtcaggagatcgagaccattctgtctaagaccgtgaaaccctgtctctactaaaaatacaaaaacttagccaggcatggtggcgggcgcctgtagtcccagctactctggtggctgaggcaggagaatggtgtgaacccgggaggtggagcttgcagtgagccaagatcgcgctactgcactccagcctgggcaacagagcgagactccatctagaaaaaaaaattctttttaattatacatgattttgattgcactgaaaaagggtgggccagttgcacctgtaagaaaaatcttattagttttctgttgggactactgagggacacaggatggaaaagcactctgaacagacaaattggcatgtgtgcaaagcattgaattacaaaataacaagggaaaaggtgttcaagggaaagtgatggagaagattgtatgggaggtggcaggagacaccttgatatcatgtggggctgtctgataaatttgcattttgtcttagagctatctgtaattcttaggagattttaaacatggaaatagcatacagactatttcactaataaccaagtatgccttgtggaggatgaactgaattaggacaaagttgttagcaaaagaccactaatagctgtttcaagtgaaaaatgttgatggatttaagtaaagcagggtagaagaaaaagaaagcagattaaacagatatttctgtagaattaactatactccataactgactgacttcagagatagaaagatgctaaattatgctgcagaacaagctaccaccaaaatctcactgatttacaaaaaggaaggtttagttctcactaagatacgtcctggcagctgcagcattcaaaatgtatttgtttgttcattaccatttatcatctctttctctgtcactgttgacaagatagagatacaaagttgttcaaaaatatttcaggtgtaactatgtatacatttgttacatgaattatcacaaccttaaatcttttatttctattgtcttaaccatttttgccacacagaagctattcatatgacaattaagttgatatttttggccgagtgtggtggcttacagctgtaatcccagcactttgggaggctgaggtgggaggatcacttgagcctaggagtttgagaccagctgggacaacatggcaaaaactgtctctctaaaaatacaaaagttagccaggtatcctagcacacgcctgcggtcccagttactcaggaggcagaggcacaaggatcacttgagccggggatggggaggcagaggctgcagtgagtggtgatcgtgccactgcattccagcctaggtgatagagccagaccctgtctccaaaaaaaaaaaaagactttttttgtggcagtgtctcaaacagacacaatctgacataatttagcatgttttctttatttttgacacagggtctggctctgttgcccaagctggagtgcagtggtgtgatcttggctcactatagcctctgccttcttggctcaaacaatcctcatgcctcagcctcctgggtagctgggattacaggtgtgcaccatcagtacctagctatattttttggtacttttagtagagatggggttttgccatgttgcccagaatggttttgaactcctgggctcaagcaatcctcctccctcagcctccaaaatgttgtgattccaggcatgagccactgtgcctggcccataatttagcacttctatcaaatgcaattatgacatgaaatatttctggttaacaactgacaatgtaactaatacaataagttttatttacattttatgggcagattttttttggtgcattctgtagtcatgaacaaattaaatggtcattatcctcatggagattctagcaaaaagcaaattataattacccacattttcatacccagctaagagtcctagaaagcctccaacctgttctagccattttctcatatttgtacagctgcaaaaaaaatatttttgagtacattatgtgagctaaattgtatttcaggtggtagagactatagataaatatcctctttcatacaaactaatcctttcattttgatgcattatttttgaggttcatatgaaccacaaccacatcacttgaattgatgtattggaaatgtgataaacattgtgtccagactgtatttgctatttattagaacttacctctccttgtatgaaattaagtatttgttttagatcaatttctttgagttgctttcttttttcttttttaagtgaaatagaaaatgaagtctgtagaatctggggaccttcccttgactaaaaatgagtttccatagtattaccataaaatctatggtaacccatttcatactgaaagattcttgattgcttacctgttgatgtcattccctaggtgacgtctccttaaagacattattgtatcccatttttatttgtatacacagcatctaacatcatgtccagcatagaatatgtgtctaataaatgttggttggttgaaagataattttcatctgcagtttctttatgcacattcgagtttagtatcttctgaattattgttttgttttatatatgacttacatgcacattaaagtaagaaattttccaaagagcttgagtagcgctaagattggtcattttcaagcatatcaaaagacaatgagtgaaaatactgtagctatactttattactctgcaagcgtatgactaaatgcagctgactcctccacacaaaattaccatagtggttaagagtgagattttagcctaatacctaagtctgaacctttctctgctgctaactcattgtgtgatttttgtgcaaattacctacatttctggacctctatctcttcacttttaaaatggggatcactttgataattgcacctatctcacagagacattttcaagatcgaaggagtttaatagtgtataaaatttagtaaaattcctggtacatcataattgctatgaaagattggttatgggactcaacaaaatctgttaaataaaaaaagtatgaaaatatgaaaatatataataacatagtaacatactacaattatgaatatggactcagttctaattctgaatagtagggaatgcatttggaattattagtaactaatatgatatattcttttgtaataactatatttttccatgcttaggtactgatcactcaggattctagttgtgaatgatagcagcaacactagctattcaaacagaaagagatttattaaagggacttttttactgaagtttctagacagctacaatcagatttgaaatgccaccaccaagaacaacacctacatctccccagagctcctcagtgaagccagcactgctatacccactgctgtagatgcctgatgattctggcactgcgtgccaagctgcccggggtggcctgggaagaccagctggctctgaccctagccttgtcagaaaatcagtttggcacagaaattgctttatctctctagaaccaaagtcttgtgtttttctttctgttgggcatttaagtcaaatacctctactctagctgcaagggaagctgagaaaatgaacttctgaaattccccaaaatatgcaggttgttcaaagctgctccctggccaccaaggtgtcctcaggcacagagacattaactagaagaggattccttgagcgccacaaataagaacttatggggccttatttagttgacaggggtgaacagtacctggaatatcagttgtaaatgtaaggagaattctcacatagagtttaaattgcttaactatattcaattatttcaaaaacatgaaacgaattatactagatataatctcccataggatttactgaggaatacagagaagagtaaaacaccctgctctgattcttacagtgagcaaagaaggtgtcaggagtagagaattttttcccacatgcaatgtgggaaaagtataaagtaccctacagatgcattgaaggaaactcctctctttaggaagaataaggagagtctgaattgatttgctggttaagtgtattggtctgttttgcattgttataaagaaatacctgaggctgggtaatttataaagaaaagagatttatctatacaagcatggcaccagcatcttctcagcttctggtggagccttaggaagtctttacccttcatggaggatgaaggggtgcaggtacatcacatgatgacagaaggagcaggaaaaaggaggaagtttcaggctcttttaaacaactagctctgacatgaactaatagagtgagaactcactcagtaccaagaggacagcaccaagccattcatgagggatccacccccatgatccaaacatctctcactagacgtctgagaccatctccaacatttgtggccacatttccagatgagatttgcaggggtcacacatccaaaccatatcattgaccaaacatttattgaatttcatattaccaatgaaggtacaaattaagtaatatatgttccatggaattattaaactttctccacatgttgaaagatttattcaggcataaaaagtttctatttccaagaaaggtacgtaagtggaaatatatagagaattttcagggaaaaatatgctttttaatttgactaaaaagttggttagatccagaaatatggtgggttctttgtgaatgccataataaagaactgaggcatgacactcattttattatttttaattgtttttccagagaagaggctgacatggttaaagtgtgttgttaggagatttccattgtcaatgtggtacagatcaaataaaagtgagaaagctcttttattataccaaatagcagatacggtgaattttaaatgcttcatggtaaagagaatagagtggaaagtgagatgcagatgacatagattctatggttctagaataaaattattaattttaatgaatgtgtggagcaagacagatatgaatctcagtgaccatgctggaaggactgtggtgttatttacatctatagaaacatgatggaaaacacattctggaatttagaaaaaaatttagatagaattgttgtgttgaatgaattatatttgttttctgttgctggataaaaaattaccataaattcagcagcttaaaacaacacccacttatcaactcacagttctataggtcagaagtccatgtggaccggactgcattctctgatatgggtatcatgaggtggaagtggatgtgttggccggactaaggtacttggaagctctggaaacagtctccttttagcgcattcagattgttgacagatcagtttcttgcagctgtagaaatgaggtctcagttttcttcagcaatggaaaaccccccttacatcaaatccctgtcttgatttcagtctttctgatttctgcttttgctggcagtttagaaaatcactgcttattttattagattagggatatgatttggctatgtgttcgcacccaaatctcatgttaaattgtaattcccaacgttgggggagggacctggtaggagatgatcatggggggcaagatttccaccttgctgcttttacgatagtgagtgagttctcaggagatcaggttgtttagaagtgtgtagcacatccttctttgtttcctgtctcctgctccaccatggtaaaacacgcatgcctcaccttcaccatccgccatgattgtaagtttcctgaggcctcccagccctggttcctgtatagcctggggaactgtgagtcaattaaacctcttttcttcataaattacccagtcataggtagtttgtttacaggagattgagaacagactaatataaataggctcttcagaatactttctctatcataaggtcaattgattactagacttagacaaatagtgtgcagctggaagtgctctctggaacttggaagaggattgaagtaagagatatactctgaagagtgaattattccagtagtgctatgaagagaagtgactgacataatcaatgaagattatattgagaagcaaaagtgaaaaatctgagatcttgcaggtaaaaaataaataaataaataagtcttagtgaaaagatctcaatttcatttatgggagtaaatgccaggaattgagagcgggaggtaaaatatgtattgttagacttgaggaggtcatgattcttgaagtggaatgaacgtgcacgtctaaaacacctaaaagtaacgggaaaataaaagaaatgaagaaagaaaagaataacttcccagatatctagcaaaagggaagcaatagaatacaccagctgagggacttgtaaggaacacatcatctgaggaaacgttcattgcagtaaaatgagaagatggaatgtgaataagataaaaatgcaaattatgtagaaagcatagttgcaagaacacagggtggactagagacaaaaagggcttaggaggtaaagaacaatcccctagtgcacataatctcttgttttcatctctttgccttggatcacgggccaatcatgacagcaatggtgcattttcatctttgaatccatgacacattgttggccctcaataaatttgcattaaacaaatgaaaagcaggtaaccagaagcgatctgtgcctacaagaggagctgtgtgtgccaggaattagtctagcaggagcttggtagattatacttcctggaaatatagatgcatataattttaaagatataatcatgaaatattaaaagaattgtaaaagtggcagtgaattatttagaaacagtgtccctgcatgcatgatacaatattcagatgtgtgttaaaatgtatgctccaaggaaagtcttggtatagttttatgtgcgctgcatattttcaaataatgctggaaagcagtttaaagcttttgaatttcttcatcccgttttcctgtctccttgtagagctccctttgatttcaaaggtgcttcattgctagaatgagaaataggtggtaggaaagtttaattctttgaggctaaagtttgaaacagtttttcatttacagataaaaattctacctttggacttcagcattgttcagttttccccgagataaatccgtagaagtagcctacacctgcctacaccttgtgactacatcttcagattatatatatgcaggcacagttttagaaatgggctggcaaaggaagcaagagggaacagaagataagatgctcccctcctctgtaaaagagatactgtaatcatatgattgtgtttttagccaccgaaagcaaaaaccgactgatattacctttagatgctaatgatttatttgatagaaatacatttttgctttaagcttattgatcatgctcatttataaatgtaaatttattctgtcatcaggattccaaatcatttaaaacctacaaatatttattgaatgtttcttgctaaactctgtggttggttttgggaggatgtgtaaaatccaacacttgatctccagggattttcatcacctaggaaggagagataaatacattttctttttgaatggaaaactaacatagcaaaagaaacaaaaatgctataaatattcaaagtatgagatgttagtcctatcacatcctttgttgtatgaggataaatataagtaaatataaaaacacttatatacatggcagatatcacttggtattaattctccttcagctcttggaaaaataaatcttattgaagagccctataaacaccacttctcactacacttactgcataattttagaaagaggtttaattaacatgaaatagctacactcaactggtctaaagcagctgtgtagcgtgaaagtcacacaaagccccagtctcaatgatgtattcctcttcccacctcaatcatcataatccactttctgtggtactccagtaagttcagggaggctttctttcaatactgcaagtcctcattgtcctcctcttaattctcataccttttcatttcagaattctctcttggatctttgatagtacttgtaccacctactggctcaaacatttattttagttgctctgaaagcacaggaggcgaacaagaggcaaaagtggagactttgggcatagtggccattgggtttgtggcagatttttctggcccatctcagtaaagaaaggaatcatagtgtttggggtcttaaggagaggacaaggaagatatgagccaggtatcagcatcagagagaccatatggccactgaaatctcaaactggatcatagcatactgacagtgcttacatggcccgcattccttgaattctgaaccctcaagatgatgaaacatggagaaatagctgatgtaaacttataaatacataaatcattaggcatagggtaggcctctataaaattgatagttgaattgtgactcatcacttgggattggtgggttacaaatgtgtaaagcctcaggatttgctctctgttttcaccttaatttgcttatttattaaatatgtagagagcagggatgaggaaccactagcctgggagcaggatccaattctcaagaagaagtaattgtttattatagagaagtaaagtagcagaatgaaagaggaaagaaggaaggaacagcaagagggagggatggatgttaatttgccccacttgggtcaagtctaccactctctactccatgtctataatattaatctctgtgtcataagggaaggttctgtgactggcagccacaccgtaactagttggaagagttgtccaaagcaagttagtttgctccttctgaaaaaaggagagcagttgtagaaagtttgcacaatgaaaaaagtttatatttatttgaactgttgtattagtcttcctattattaacagagactagccaggcagcaatatttaactatgtgaataataaagaccagaagtcaattttttttaaagaaaccatagctggccagaataattaaagctgcatgttttcacagtttgaggttctgttaagtcaggaattaagtcattgtcgacacaagataggtcaatctcatttagtagcatgccattgtaaattaggtgatttctcatcactccttgctgctccatgatagtacaaatgcttgtcaaaagctttaatggtcataggtaaaacactaattatgtatcccacaatagttgttacagtaaggtaattctttgtgtctctagggtaggtaaatgtttcagttatatatttgcaatgaaaactgaggacagttacagtggctcatgcctgtaatcccagcactttgggcagctgaggtgggtggatcaccaaggtcaggagttcaagaccaacctgatcaacattgtgaaaccctgtctctactaaatacaaaaaaaaaaaaatagctgggcatggtggcatgtgcctgtaatcccagctacttgggaggctgaggcaggagaatcacttgaacccaggaggcgggggttgcagtgagccaagattgcaccattgcactccagcttaggcaacaagagcaaaattccatcaaaaaaaaaaaagaaagaaagaaaatcgggtaccatcctatcttgatgaacacaaatgtgtagaacctcaggatttactctctgttttcaccttaatttgcctatttatcaaatacctgtagagcaggaatgaggaaccacttctctgggagcaggatccagttctcaagtttgattttatctaatctatagagagttggtattctgccatgaaaagtaagtctttcaaattaatgtccttaaaatgcccttcatctggtccaatcagaacagagtaggagaaaacagtgctagagacacagattctcagttagactttctgatttaaaggcccaactccaccacatgatggagtgtaacctgaatgacttagtctctctgtgtgtgtttctgttttatctgtaaaagtggtataatactaggacctacctcatatagttcttatgaggattaatttggataatatttttaaaaatgtttggaacaatgcttggcaaacgaaagcaacataagactgccccttaaatgaaaaaatgaataaataaacaaagttcctcaagttttaagtacatgtaaaaagcttttgtgagctaatattttatagctattaaaattatacaaatggtacacatttattataaaacattcaagttgaataactgaaataaattactcataatcttacaatctggtattgatagtattttagcgtatttttaaaatttttgtacatcaaattagaatcttacagtttaactgtatattctcatttgtaatggtattgtcttatgtggaattctataagcattattccatagtcttacatattttaataatatattttttaactaattccttgttgctagattatgagctttgttacatatttagataggttccaattttgtcactttttatgatgctgtaataaacattctttatgaaagtctttgcccacttttggggtgatgagagcacctggaaatgaaactgagaaaaagagaggaacatgtaaattatttgatcagtaaatctataaatattatgccaatttacatttgcagtatcattattacctctcatggtgacaatgtaaccgaattttaccaaggtcaattttccttacctaacccacgctttggaaccagctgagccttctctcctccaggtctcttcccatgacctcttttccctccctctacttgtctttagtcttctctcctttgtctctccatctctgtattttcttcttttcagtcctttttatctgattctagttgctgctaaaaaaatatatatgtctcatgaggtatgttcttcccaacactcatagactttattctaacttcagagtaatggctgtctgcccactccttcctttgtaagtaagaatctgtgacttgaagaatcacattttttcactctggcatagtacatttgctagtggtcttaataatagtgggccactagaaaagtaagttttaattgtgtttttaactgtggagaaatgataagagatgtcttcgaaaatagcaaaattattgataggatgtttctgctgcagcctacaaagttagttacttttcactggagactgagtttattacatgagcggcctgtcttaagtttcttgccatctctcaagcacattctctaatataatttattcattgaagcatacaactgtgtttctgccttagggctttattttcatctcctcacaatatacaaaattaaaccccaaagacaatagcattatatgtttcaaataattcttcaatagatatttgtaatttatatttcatgcaatataacaagatgctgtgcattgattgagagcactgtagagaatgtaaactaaactgtaaaatgtgtccagaatatatttcaactaagatggttttatcagtctaaacttaaaatgtgtttcaaaaatcctgcaataccaggattctgcatctattgtgctgattttgctcacttctgactttgtaactttttctgaaggaatcacatttttaaaaatttttaaatatgtaattaacaaaaattgaatatactcaaggagtacaatgtaatgatttgatatttgtatgtacgtttgcaaggattatcaaaatcaagttaatacattcattaccactcatgctgtacattagattcagacttgttaatctaattggaagtatacatgatttgaccaacatctccccactttcctagccccttgaaactatcattctactttctgcatctatgactttgacagttttagattccacttataagtgagattgattgtacagtatttttctttgtttatcaagcttatattcataaaatgtccctccagttcattcacgttgtcacgaatgacagaatttccttctttttatggctaatattacagtgcgtgtgaatgtgtttgtgcttgtgtgcatacatgtcacatttttgttatctatacacctgttgatggacacttatgttgtttccatatcttggctattgggaataatgttgcaaaaagcataaaaatgcagatatcccttcaacatactgatttcagtttttttagatttgtacccagaagtgtgactgctggatcatacagtagttctatttttaattttttgaggaatctccaaactggtttccataataattgtatcagtttaaattcctaccaacagaggagtataagcattcccttttctctacagcctcccaaacgttgttgtttcttgtcttttgataatagccattctaacaggtgtaatgtgattgtcttgatttgcatttctctgataattagcaatattgaacacttgttcatgtatctgctggccatttggtttttcatttgtttgttttgttttgtttttgagatggagcctcactctgtcacccaggctggagtgcagtggtgcggtgtcggctcactgcaaactcaacctctcaggttcaagcgattctctttcctcagcctccagggtagctgggattacaggcacccaccaccacatctggctgatttttttgtatttttagtagagacggggttttaccatgttggccaggctggtctcgaactcctgacctcaagtgatttgcccgcctcagcctcccatggtactaggattataggcttgagccactgcacttggtctctgctggccatttgtaagtcttctttgaaaatgtgtcttcactttttagaaattgttttgtaattgagttccttatatattctagacattaaccctttatcaggtttaaaaatattttcttccattccgtaggttgccttttcattttgttgattgtttcctttgctgtacagaagtttttagtttgatacagtcccacttgtttatttttgcttttatttcctgtgattttggtgtcttatccaaaaaatcattgccaagaccaatggcaagaagcttttcccctaagttgtttcctagttgtgttacaatttcagctcttacatttaagtctttcatacatttggagttaatttttgtatatggtataagacgagggccaatttcactcttttgcatgtggatatccagtttttcaaacccatttattgtggagacatctttttcctcattgtgtattattaatggcattatcaaagagtagttgatcagaaatgcatgggtgggtgtttttctgtgctctgtattttgtttcattggtttatgtgtctattctatgccagtaccatgctcttttgattactacagttttataacatagtttgaaattcggaagtgtggttcctctagctttcttttttttttttttttcaagattgctttggtattttcatttatttggggcttcttcaatatttaatctgtaccttatagtttttagtgtatggacctttcacctcctaggttaaatttattcctgagcattttattgtttagatgctattatcatgggaacattttcttagtttatgtagattttatatgtagatttcgtatctgcaactttactgatttagttttctagttataaaaggtaaagtctttagggttttctgtatatggtattatgtcctccacagagattatttaacttattttccaattaggatgctttctatctgttttttttttaaacccaactgctctaacttggacttccatactaggttgaatagaagtgacaagagtgtgcacctttgtcttgttcttaatcttagagaaaacgaattaagctgttcaccattaagagtaatgttagctgcaggtttgccatgtatagcctttgttatgttgaagtatattcattctacaactattttgttgagaatttttatgataaaagaacttttaattttgttaaatgctttgttgcatctattgagatgatcatatgatttttagccttcattctattaatatagtatatcacactttctgttttgcatatgttgaaccatccttgcatctcaaggataaattccagttgatcacagtgtagaccttttaaatgaactgtttagttcactttttcagtgttttgttgaggagttttacatctgtgtttattagaagtattggccagtgattttcttttcttgtagcatccttatctggctttgatatgaacgttactggccttgaaaaattacattggaagtgttcccatctcaatttttgggggggagattttgagaagaattggtgttaattgtttgttcttaaatacttcataaaattcaccagtgatgccatgtgttttaggctttctttgtttttaatgggaagttttaattactgatttaatctctttacttgttattgatctcaaatagcctatttctttatgattcaatcttggtatattgttcatgtctaggaatttatctgtttctttgaacttatctaatttgttggcatataagagttcatagtgatttcttatgatactttgtatttccgtggtatcggttgtaatgttttctttttcatttataattttatttactttgttagtctttttttctttgttagtctagctaaaggtatataaattttgtttatgttttcaaaaaaactcagtttcattgatcttttctataggcttttctttatttctagtttttatcttattatccaatctttttcccctttatcaaggaaaacttctgataaggtttagctgtgtctgcacccaaatcctatcttaaattgtagtttccataatcctcatgtgttgtgggaggaagccagtgggaggtaattcaattttgggggtggttactcccatgctgctgttctcatgatagtgactgagttctcatgagatctgatggttttacaagaggcttttttctctttgctggtcttctctctcttgctgccctgtgaagaaggatgtgttgtttccccttctgccatgattgtaagtttcttgaggcctcctcagccttgtggaactgtgaggcaattaaacctctttcctttataaatcacccagtctcaggtatgtctttattggcagcatgaaaatggactaatacagtaaattggtactgggagaatggggtgttgctgtatagatacctgaaaatgtggaagcgactttggaactgggtaacagacagagcttggaacagtttagagggctcagaagaagacaggaaaatgtgggaaagctcagaacttcctagaggcttgttgaatggctttgaccaaaatgctgacggttatatggacaataaagtccaggttgagttggtctcagatggagatgaggaactcgctgggaactagaacaaaggtgacacttgttatgctttagcaaagagactggacgcattttgcccctgccctagagatttctggaactttgaacttaaaagagatgagttagggtatctggcagaagaaatttcttttatatgtatatatatataaaaaatatatatatatatatatttatactttaagttctagggtacatgtgcacaacatgccagtttgttacatatgtatacatgtgccatgttggtgtgctgcacccattaactgctgaagaaatttctaagtggcaaagctctcaaggaagcagagcataaaagtttggaaaacttgcagccccacagtgtgatagaaaagaaaaacccgttttccagggagaaattcaggctcactacagaaatttgcataagtaacatggagccaaatgttaatcactaagacaatggggaaaatatatctagaacatgtcagagaccttcatggcagtgcctcccatcacagacccagaggcctagaagggaaatattgtttcctggactggacccagggtccccctgctctgtgcagcctcgggagatggtgccctatgtctcagctgcttcagcaccagctatggctaaaaagggccaaagtacaccttaggccatagcttcagacagtgcaaatcccaatccttggtggcttccaggtaatgttggtgcacagaaggcaagaactgaggtttgagaacctctgcctagatttcagaggatgtgtggaaatgcctggatgtctaggcagaagtttgctgcaggggtggagcagtcatgaagaaccactgccagatcagtgtggaaggaaaatgtagggtcagagcccccacacagagtccccactggggcactgcctagtggagttgtgagaagaggaccactgtcctctagaccagagaatggtggatccactgacagcttgctttgggcacctgcaacagccacagtcactcaatgccagcctatgaaagcagccaacagaagggctataccctgcaaagtcacaggggcggagctcctgaaggttgtgggagcccaactcttgcatcaatgtgacctagatgtgagacatggagtcaaaggagataactttggaattttaaggtttaatgactgccctattggatttcagagttgcatagggcctatagcccctttgttttggccaatttctctcccacttggaatgggtgtatttacccaatgcctgtacctccattgtaactagaaagtaactaacttgtttttgattttacaggcttataggtggaagggacttgccttgtctcagatgagatgttagacttggacttttgggttaatgctggaatgagttaagactttgggagactgttggaaatggatgattgtgtttcgaaatgtgaggacttgagattttggaggggtaaggagagtggaatgatatggtttggctctgtctccacccaaatgtcatcttgaattgtaattcccataatccccatgtgtcatgggagagacccggtgggaagtaattgaatcatggggatggttacctgcacactgctgttcttatggtagtgagtgagttctcatgagatctgatggttttatgaagggcattttcccctttgcttggcacttctctctccttccaccttgtgaagaaggatgtgtttacttccccttccatcataattgtaagtttcctgggtcctctcagccctgcagaactgtgagtcaattaaacctctttcttttattaattacccagtctcaggcagttctttatagcagcataagaactgactaacacaacttcttcccagaatatacccagatataaatgaaatagataataaatcaaagtcagctgtactgagtttgaatgagactgatggtctcttgagcccagagtttagtttctaacagatctggaattgaatctaggcttcttccctagccatttcttggaggtagcccctttggaagtatgactagacctttccaatcattaatctctttgtctctaaagtaagcataatatctacttttttagggctgtgttttagtattaaggaaataacctgtttagctcaatgccaatcacactgtaaatattaagttaatggaaaaaatgctaaaaataaaattgataacaataatatagagaaccttttggcatggttgtctaaataagagaatagataaaaaaagaagtgcaaactatagaccaaatgtttggatctcatattagtttagcatttggaaactggctatagaactagacaattaatattctttgctaataatctataacatttgttaaacagttcgaattacagtagaaccaccaagaattctgaaaacccagtaagttaagttgatgacatgactggctgtctggatgctacggggcatgagctttagccatactcattaactttgataccccaaagtcaccccaaagaaatacaaatacagtgtattaggtatgcaatatccgcttcaagacaaaacttacagtcatttctggtatgatcaaattgattcccctaagtccttgttataggaaaaattatgacacacccacttatcagtaagacacgaatgtaacatttcctgagatttataatagttattgagaaaaggaaaagaaaatttatgaataatagaaataattttcctttatgttttgaaaaattaactcttatttttcagttatcgaacatgtaccttcaattcttcaatttagagtttatttatgataactaactttgatatcctctgagagcatgtctagaagatggcaaatgcttttcaccatgaattagtgctgaatgcagttttaaaaatcttaccttgttaatctgttagaagatagtagcaaataacaataccacattgcttatttgttgaatagcaacaatttcaataattcagtagaagacataagttatatgacagatatatataatcataaatctaatatatttgtaatgaagacaaatattagcttatatgtatgatgtttaatcttactttagactctaaataactgtgtgatattggaaatttactgaaattcgtaatgattatattttatttctttgtaaaatatagtaatttgacttaatgatctctatgattacattattctctaaatctggtaaaggtgaaactttagaaattgtgtgtgtgtctatatatatacatgaatacatgtgaatatattcatagacacatacacatatgtacacatacacaaacatatattcacatccatatatattttttaattgggtagaatatggagtgaggaaacttattgtattcacaaattgagtacttagtaaatatttcatagatttattaaataattttactttatgatatatattagcaagttccctgtgcttccctgtgcacgttttgaagattaaatgtagtaaaggatatagagcactttttttttattatactttaagttctagggtagatgtgcacaacgtgcaggtttgttacatatgtatacatgtgccatgttggtgtgctgcacccatcaactcgtcatttacattaggtatttctcttaatgatatccctctctgctcccccaaccccacaacgggccctgatgtgcatgatgatccccgccctgtgtccaagtgttctcattgttcaattcccacctatgagtgagaacatgtggtgtttggttttctgtccttgtgatagtttgctcagaatgatagttgccagcttcatccatgtctctacaaaggactttaactcatccttttttatggctgcatagtattccatggtgtatatgtgccacgttttcttaatccagtctatcattgatagacatttgggttggttccaagtactttttatatgtctggtactcatggtatgtgctcaaagattcagagaagttatagcacttcaatgtgagtctgatagtcacagatgcatcattatgaggatagtgtgcctgggatgaagggaaaggtagagaggaggcagagaagaaatgccctgagggtccagattggaagaggattcggtggagagaacttttcatttcaagaacaagagaaaaagagtagaaggaactcagcctgaaagtattcccaatcgaggacctcaccaactgactgcccatgccgggaacagttggccatcccacagtctaagagaaactaatgggcacacactgtaaaatgtaataggagtttaatgtaaatgggtatctagactttggaacttgggcgtataccactaaagatgttaacctaaggaaagtatagagttatcagtaataacatgtcagtttgtttcttgtttggttggtttgcttttaaacagtaggatagactgcttgctatacacatgttagaagctttgtagttgctaactggcaggcagtaaagcacggtggttaaaagtcatgccctgggtcaacatactagctgcttttcttactatccatgtgatctgtggcaacttacccaacctgtctatgcttaagtttctttaattgtataaaacatgtgcaatagcacttgtctcctacagctgtttcaaggattagctgagtttacctgaggaaaatatcatagataataagttcccaataaaagctgttactttaaaatcatttaattcaggtctggagaaaaacaaacttggaaaataccaaaattgagaggggaaaggcaggatgaaaatctcacagaaaataaatggttagagttgatggacgaccaggataacacagtgtctctgatccccagatagtatagaatagaaaggaaaaccctgttacataaacagtgtcaaatactgtattagactgttctcacactgctataaagaaatacctgggccaggtgcggtgactcacccctgtaatcccagcactttgggagactgaggcaggcagatcacgtgaggccaggagttcaagaccagcctggctaacatggagaaaccctgcttctactaaaaaaacaaaaaattagccaggttggtggcacatgcctgtaatcccagctactcaggaggctgaggcaggagaattgcttgaacccgggaggcggaagttgcagtgagccgagatcgtgccactgcactccagcttgggcaacatgagcgaaactccatcaaaaaaaaaaaaaatctgaaactgggtaatttatataaaataaaaagaggttttattggccatggttctgtaggctgtacagaaagcatgatgctggcatctgctcagcttccaaagaggcttcaggacacttacaatcatggaagaagacaaagagggagctgacacgtcttatttggcaggaacaagagcaagaggaagggcagggagatgctactcacttttaaacaaccagatctcgtgagaactccctcatcatgatgagaacagcaccaagaggatggtgctaaaccattaatgaaaaaccacccccatgatccaatcacctctcaccaggcttcacctccaacattgcggattacaagtcgacatgagatttggtgggacaaagattaaaaccatatcaaatactaaaatttaaagattaaaaactgaaatcagaaaaaataagccaactagaaatttgttaaaaaaagaatataagatattgattgaaaagtaagttattattctgtgtcacttccatataaaacattttttaattggcatgaatatttagagttaaataaatactagtagtgtggttaagggtttctgtactttatatttttcctcatttgtttatagtgttttttctcaaattttctttcttttctattaactttaaagattctattgattcttgtaccaatagagagttttaataggtttatgaattggcaagttctctactaatggatggtgagaatgattcatctttaaccccaaattcaaataatatcaagagactgttaaaatggtgcatgacgattttagcctttgtttcagtattaaactagtggcacttcattaatttttaacgggattcaatttgcctgttaagtagtttatagaatcatcttacttttggtttcctaagaaggccaaagtattttgcatactcctttctgtttagcatattttttccatgtctctccatgaaataaaaccacatttgacaataacttaagattggtattgtcaagtgtttgcaacctttaggggtcttttgttttaaatacctccatggaaaaagaaagcacacgatgcggaatcggactcatcagaactcaaactgatttctgttactagctctctgtggcctgggcaagtcacctaaactctggaagattttgtttttagcatgtgtaaaataggaaatttgataaatgtaacatttaagtgtattatgacatgtgaccactaaatgaaaacttttgttacaagtattttatgggaataatgactaaggattagcattcttgatatttaaaaagctcacaaattggataagaaaaacgatatcacaaaagctaaaaagagattattcagttaataattttattattagtgtatgtatgtaaaatatttaacatcactacttaacatttaaaaagtaaaaaccacagtgatattcattaaggtaggtaaatttttaaataatgataaatataatacaaaaaatgtggagttttattctataccaatcctgaatcatattatttataattttacctacttttaatcaatgtatattcagattcatattctgctttttaaaaataatttgaaaataatacatattatttatatcagctataaagtattctatatgatcattctatctcaagttacccaactttcccttactgatgaaaatttaaaagtttccagttgtagttgattatgaatagtggtagatggaagcaatgaacatattggtgcacattatttcctcatttaagggaagtgatgacaatggtagttatttctatagtaatgcagattccatgactgggaaattggagtttgtgaatcaaagacattattctatttttacttgaaaagagtgtgttgccacattatctcacaaaatgatacagtgaccacttcctccatctagaaaacttttctccttggctaccacaatgccacacactctcacagttttctttctctctcacttggcattccttttctttttcctctaaatagttattagacattggcacgtcccatcaagtcttggacagcacttctttcactagatcatcccatctaatctcatctttcaataccattcagctactgatgactcctaaatttatgtcttaatttcatcttcctgagacccaaactcatctttaaaaccgatatgggaacttgacacctcaagttaagactaaaacacagctcctaattttcatccccaaatctctttctctaatcgtttttttccgtttcaggaattgctactaactcacttcaagtttctcaactcagaatgtctagaagtcagccttgattccttcttttcacttgccatagtcgccaggagctctcaccctgaaatacaggctgtcaggatgttctgagaatactctcatatatccacttcttgatacatccacctcaggccaactcactcactatttttacttttccctgttattgttggaatatccatacaacttattcttgatgtagcagttatagtggtattttcttcaccaaataaaacaatgtttacattgtaatttgatcagaagatgctaaatagatatttcgagcagtgctcattgaggtatgtagagcatctcatgctttctgaattaaaagaacatgtacagtgtacataatatttggtcagggaccctaagactggtgagttttatgttttttcagagtggtaaattagttaatgcaaagcaggtgttcatttatagcttcaagtaggaaaattcactgtcctataaaaataaattttataagcactgtagctatcacaaagttaatattatgttttgaggaattaataaaaaaattatatagttagcaattgaatatttaatctcttgttcctgtagtatatataagtaaatataaaggaaaatggaaaaaatagacaaaacatacagacttttaaaacctcagacatttgtcagtttccatgtagttgagcggttttgagtgagtttcttagtcctgagttctagtttgattgcactgtggtctgagagacagtttgttataatttctgttcttttacatttgctgaggagtgctttacttccaactatgtggtcaattttggagtaggtgtggtgtggtgctgaaaagaatgtatattctgttgatttggggtggagagttctgtagatgtctattaggtctgcttggtgcagagctgagttcaattcctgggtatccttgttaactttgtgtctcgctgatctgtctaatgttgacagtggggtgttaaagtctcccattattattgtgtgggagtctcagtctctgtaggtcactaaggacttcctttatgaatctgggtgctcctgtattgggtgcatatatatttagaatagttagctcttcttgttgaattgatccctttaccattatgtaatggccttctttgtctcttttgatctttgttggtttaaagtctgttttatcagagactaggattgcaacccctgccttttcttgttttccatttgcttggtagatcttcctccatccctttattttgagcctatgtgtgtgtctgcacgtgagatgggtttcctgaatacagcacactgatgggtcttgactctttatccaatttgccagtctgtgtcttttaattggagcatttaccccatttacatttaaagttaatattgttatgtgtgaatttggtcctgtcattatgatgttagctggttattttgctcgttagttgatgcagtttcttcctagccttgatggtctttacattttggcatgtttttgcagtggctggtaccagttgttcctttctatgcttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatgttggagcttctgcacagcaaaagaaactaccatcagagtgaacaggcaacctacgaaatgggagaaaatgttcgcaacctactcatctgacaaagggctaatatccagaatctacaatgaactccaacaaatttacaagaaaaaaacaaacaaccccatcaaaaagtgggcgaaggatgtgaacagacacttctcaaaagaagacatttaggcagccaaaaaacacatgaaaaaatgctcatcatcactggccatcagagaaatgcaaatcaaaaccacaatgagataccatctcacaccagttagaatggcaatcattaaaaagtcaggaaaaaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcactattcacagtagcaaagacttggaaccaacccaaatgtccagcaacgatagactggattaagaaaatgtggcacatatacactatggaatactatgcagccataaaaatgatgagttcatgtcctttgtagggacatggatgaaactggaaaccatcattctcagcaaactatcgcaaggacaaaaaacccaacaccacatgttctcactcatatgtgggaattgaacaatgagatcacatggacacaggaaggggaacatcacactctggggcctgttgtggcgtgggggcaggggggagtgatagcattaggagatatacctaatgctaaatgacgagttaatgggtgcagcacaccaacatggcacatgtatacatatgtaacaaacctgcacattgttcacatgtaccttcaaacttaaagtgtaataataatacaaaaatttaaaaaaaaaaaactcagacatttgtcccaccttcccctgtttttaataatgctcgttgttttgttcctacagtgtctgagtattaagtattttctaatgagaccttttgtgaattagatggttaacgaaagagtgaaaacattacttatcaaaatactaataaatatttaaatataaatatacttattcttaagcatatttatatataaatattcttaagtatacacttaaatatatatacttaagtatatatatttaagtgtatacttaagaatatttataaatatactcattcttcagcatatttaaatataaatatactcattcttcagcatatttaaatataaatatactcgttcttcagcatatttaaatgtaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagtatatttaaatatgagtatactcattcttcagtatatttaaatgtaaatatactcattcttcagtataattacatgtaaatatactcattcttcagtataattacatgtaaatatactcattcttcagtatatttccatgtaaatatactcattcttcagtatatttccatgtaaatatactcattcttcagtatatttccatgtaaatatactcattcttcagtatatttccatggaaatatactcattcttcagtatatttacatggaaatatactcattcttcagtatatttacatggaaatatactcattcttcagtatatttacatggaaatatactcattcttcagtatatttacatggaaatataccattcttcagtatatttacatggaaatatactcattcttcagtatatttacatggaaatatactcattcttcagtatatttaaatatgagtatactcattcttcagtatatttaaatatgagtatactcattcttcagtatatttaaatagttgagtcagtattatatcttctaattaggtttctaataataatttcaaaaactatgacatgttttcttcccatttttttatggctgaatcaaaatgttgagatttataacttggaccccgtattctataatgtcacacagacatatatttttttaaattttaccttaagttctgggatacatgtgcagaacatgcaggtttattacataggtacatgtgccatggtggtttgctgcaccaattaatatgtcatctgggttttaagccccacatgcattaggtatttctcctaatgctctccctcccccagccctccaacccctgacaggccctggtgtgtgatgttccccttcctgtgtccatctgttctcatttttcagctcccacttatgagtgagaacatgtggtgtttggttttctgttcctgtgttagtttgctgagagtgatggtttctggctttatccatgtccctgcaaaggacatgaactcattcttttttatggctgcatagtattccaaaaatgtatatgtgacacattttctttattcagtctatcattgatgggcatttgggttggatccaagtctttgctatcataaatagtgttgtaacaaacatatgtgtgcatgtgtctttacagtagaatgatttataatcctttgggtttatacctagtaatgggattgttgggtcaaatggtatttctggttctgcatccttgaggaatcgccacactgtgttccacaatggttgaactaattttcactcctaccaacagtgtgaaaacattcctatttctccacatccccttcagtatctgttgtttcctgactttttaatgattgccattctaactggtgtgagatgagatctcactgtggttttgattttcatttctctaatgaccagcgatcatgagctttttttcatatgacaaaaatatcttataactaggtttgattctagtccagtatgctttttgttataatatgttacttaaagctcagacaggaaatgcaattctattttggggaattaaaattagtgatgtggtggtcataaagatgtgggaaaacttttaggatagtagaagctattgtccttattaaggtgtacaaagaattttggacctgttttttttttttttatttgattttcaattattttctctacattgtcattttagcccattgctatgtcaaccagtttcagcttgccctatgggggaaaaaagcctattaaagaaattctttacatgaagaattgatatctctgtgtttatgaatgtaacactttcagaagattgcactgaaagcaactatatttacaaggcttatctgtcctgtgtgtgtgtgtgtacttatcctaatgttgttaatgttgtttctcattcagagccttgtgaagtgggactgctacacacattttaagttaatatcaaaacacacccacaatgcttttggtgaaattgtttcatgttgccaagtatacatatgccaaaaatctcccctctttatcaaaacagatacgatagttacagtagttagtcattgaagtagctggatatgtgtgccattcaccttcataggaatcagagggattgtaagaatgaacttgagaactgcattcttgccatccaggaactagggttaggattggaataagtaatgtgtgtagcaagtgccagccaaagagaagggaatcactcactatgcatgagtcctggggaagatcagagcactcataaaaggcatttgagttagatcttaaagaatttgtttactatatttaaccatattgatcttgagaacaattcctttgtatttcttcctcaaaaatgaactaaagcagataaagtctttataacctatgttttcaagtatatgaaattactatatcatagtctgagaccaagtgtacaaatatgaaaagtggagatacaaagcaattttccacttactgcaagtcagagcaatatctgtctcaattgtcatgagattttacttgaacatgacctcatctttttgtcctttcatgtgtggtcgacctagcttcaaaatcattgtatagacagtacattttccttatattgttgcacagatcactggcaattttgcatcattgaatgcaacattgtatatcaaaaattggcatatataaattatatcactgcacacagggcagacaaatttgtacacattgttttgcatctatttgtatataccattgacattattgcctgtttaataatagattttgttaatgcacagataataagtacatttcttttttgctattctgcatttttttccagtgatgtcttttagagctgagcctctgccccagaaaataatgaagcttcagtaagagtccctgaggcagatggcatggagatgttatttgcatccctaattatttggttaataaacaataaactatatttagttactagttagaagattttcattttgtaaatgtacctctgacccttttctttcttaagtgaatgaaacagtaataaataactaaagctgttttttgcacaaaatgctagatagagactaggatttgagaatctatttttaaattcacttattgttacccacttagctaaaagccactatgtgagttaaaggaatatcctgctgtaaacagttccatttaaattcttaacatttctactttgaattgtggatcctctcagccagcttcccgggtccctttgaagcaggcctgtgccaagattccccacctctcatggggaactaagcaagtccattcttattcccagctcatcagaataccctgtccactcactctgctgacccacataagctgattgctccctgatgtgtggagaagtgattgtgataatgttcacaggaggggatgtgctaatgcatgagtgataactggagcccggtaaaacttactgagacagaattctaagcagaattccacactcctttcctagtgtggtccactctgagtgctagagttttaatacaatccaaggatttctccaagataattgttaatgacttaattttatgaggattttatttatgtaaacaatcaaataatttttaagaatgaatgaatatatgtatatatatatatatatatatagagagagagagagagagagagacttgagtaagaatatctgcataaaataaattaagccaagaataaaatctagaataaatacagtaactgctctggagaagtctaattctgctctactggagatacaatgagaaccactaacatgattaaggagatttttttcaattacaattcaatttgccttacataatctctgtcgttcttatatgtatgcagctggacccaagaattttccctcctgtttcagggatgttatttccaggatataattaattaatatattcattttttactttattcttatattcattttgtagatattgagtgcctattatgtccagagaaccatgctaggcagtggttattaaataatgaatacaaataatttcttgacttaaaaacaatgggcaatcctaagagtttacttagtacttgttcagggtttgctacaaattccatgatttaactgattttcttattgatatccattctttgatcttccctctaatagaggggcaatttggtaacctatatcactattgtatgtttgagctttgaagcattttgtagtctatatacttactttctgcatcttcaccgagtaatattccttgtgatctgcgtggacaagaatgtttttacttttttttttttttatatcagagagaataacatcttgagaatgatgacattttctggacaattccagtgaatgggcacttagctagggaagccaagaaattatgcctaattaactatgctatttccaaaattctgcagacttttactaagaatgcatgccagggatgaaaaaatacaaagtaaagcagtagatttgcacccagaaaactgacataacttttcctttctttgcaacattgatatttgccttcaactgatgaaggcttcgatcttgatttcaattagaaatgcagtgaacaaagagattctagggaatacatacaacatgaagctcctcagtcttccttacaggggagaactacacagcagcttccaaatagttgcaaagacgaacatgacttcagtgactttgactagattatattatttttattgcctttatttttcacacataagacttcatttctgtgaataaaatatatgacatatctggttttccatatggtaaaatctttaaagattttttgtacattctctaaatgaataaattggattctcaagtataaaaacatcataaaaattgcttataaaatattctaaaagaaaccctgagtagctggcatatagacgtgctctacaaatatttgctgaatgaatgaaccaggagaggtatttatagtaaataaggaaatgaccagactcattaacaataaaaattatatacagtcaagtgttacttagctgaaataacatggtgtaaataaatggtgtaaataatatgccccctatattaataaaacagatgaagcaaaactgaaaataagccaataagaaataaaatccacttgatagttttgctaatgattgtaacataatagcttgcattttaacttacattttaaataaagaacgcagtccaatctctcaaattatggaagtttttcttctaaaataattctgataactagctttcatttgaatatctccagtagtgaagagctcattacttttatgggaatccattctattgttggtaatagttatcctaatgctttaaaaatattacattgacatctgactacctgcatgttccttttagaaaaagtttaatttagaaaaagaaaaatactactacctgagataacacacaaaggtgtattttctcttggccacagtattttcaggacattaaaaaaataagattatacatcatttatactgtttagtaagtgagctttcaaattacaggtcatgtaagtgttcaagatgttctaatcagacctaattgtcactattttacattaaacttgtatacatgtctaatgtaaaacaatgtgtttaaaataatgtaaaataagggtatgtttgtttttacactctggctcaggctagcctctgtgtatatcactgtggcttctgtgtggagcaagaacttaatcaaatttggatttgcattcacattagtttcaccactatctaggctttacgtagttgtaagcaactgtttagcttttgggtctggctttcatttttcttgtctcttataatcttagggtaatatttgacattttaaaaacaaattaacatccttaaatcaaagatcttaaaatataattgttgtgaaattccctgaaaataatttacatattttttaaatacatgaaactaaatgacttgctgtaagtctgtttctcacaactgacactctgcttttcctgtgaagaaatacataaacagaagcctcagctagacagattttcttttgtttgcctaattgccagaaggttaatgattttcataatgccatttatgtctggatattatcagcactgtaaaaaaaaaagttctaataacttttgttagtgtagtctgcagaaccattgaaggaacaaacatattgtataaggaaactttttgttttctcagcaaagtgtttcaaatatgttaaaatcagctcaatattcagtattattatttggttaaattccagaatggaaagaacttgtagtaaaatgattaggctatgaacagacaaatgcaactgacaatgttaagtcgaaaagtattttttttttacttaattgaagcaaaatattaattttaaaaatatgagttagagctgaataatctgtagacataaaagcacgtatacttttagaatgtgtgatgttattgttgcatcactggaaaaccttacgtgtttattcttttgaagagtggaagatggaatttaatttactctttaactttctgttataaagcttaaccgtctttagtctcttcagagcaatgttacgagattgagtttccacatcattctggttattcttcttgaacacccttagttttaaaattatctttcttaaaagattgatctcataagattgaataccttgtcctatgttttatagcttataatttttcttttgtggactacctgttaaagtcttttacccattttttattaggtttactgattgtttcttattgatttgtggggcttgtttatacattaacaaaaatgaatatttttgttataggtttagaaatatcttctcccaatctatagttagccgtttaactctctgattcctgccttttgataatcgatgtctaattttactataatcgaatttatattttcctgtttagctagtacattttgagtcctgtttaaaaaatctttcccaaccacaaaaagatgctgtatgttctcttccagaaacttttacaatttgatctacacgttttgaccttgatttttgagtatggtgtggggcagaatcacttctagaacaatttattgtgggggaaaaggacggtgatttttgaaaaaggaaacaagaagagcttgtggattgctggcaatgatttctttatagatctgggtggctgttacactgttatgttcattgtgtgataattcctgatactagctatttatatgtttgtaatttgttcatttatatatatatatgtaaagactttataaaaatgcatgaaaaacatatctaataatacattgtaaatataatattctacttagatgtcataattttaaccctgtatattatttcataaagtaaggttacataattctttctaagcattagatacctttaatcatgaaattgataatgcgtttcttcaaaatgagtagctttgtttattgttgatgttaaaacaaactgtactggtataggttcaggtttccagccagtgaaaaacatttacatcattattcagtttgttatcctattaggtttcttttccaggtttatataattggcaaatttcataagcatgtctttcatgccttagagaataaaaatattaaaaatgacagtatacaggatgaaagcctgtggaacatcattagagagcgctcttcaagctgacatcaccattaatcaacgtatttggggcacgataactagccattttttaatctacctaaaactgttatctcccagcccacattttactagtttacatttgccagatattttgtcaaatgctttgcaataattaaaattgaagatacatctatggaatttatgctgttctattaaacaaggactcaattttataaaaggaaatccttataacctaccactattgcctcctctatcaccagaccccattcatctttttcctaaatatttacaactcacatgctagactttaaagaggatctctcttgttatttttcccagatgtaccaacttcactgtttttaaaatttatggtttttatggtttttagtttttgactatctttctttttttggcagctcctttaataaatattcaagaaagctaagattacatttatggataatgccagtccttggggttataatctgaattcgaatgcttcaaaaagttaaaggaacaggccaggcgtggtggctcagcctgtaatctctgcactttgggaagccgaggtgggcggatcatgaggtcgagagatcgagaccagcttagtcaacatggtgaaaccgtgtctctactaaaaatacaaaaattaactgggcatggtggcatgtgcctgtaatcccagctacttgggaggctgaggcaggagaatcgcttgaacccaggaggcggaggttgcagtgagccaggatctcgccactgcactccagcctggcgacagagcaagacgccaaaaaaaaaaaaaaaaaaaaaaaaaaaaagttaaagccactttgtctgtcttattatgtcttagcttgtctgaggaggtatttgtctatactcagttagtagttttgctacttctagaattatttgaaactgttgtctttgttggtagaaatgggtgacaaacagtactattttcctgtcattaaataatatctgatagtattatatcttctttcttctgttttgcttaaaaaatagctttcaagctcttttgtttgaaccttatttatataagtattaatttatcgatattttaggaatgattgggccactgccaattttcctactctagtttataacagatgttgattaatggatatagccctcttccctggctactctaatcaacaaatatctgcacttggttgaagcctgtttatccacttctcatagatcacatgacctccttgcagatgtttatcccccactgcaaataaaatctgagctcattaacgagttcattttagcacttattaagatgcctgttactgtttttgtatcaattagataattctccattataggcttaaactcatgttacatattattttcaatgttcagaaggtcttaaaattcatggtgtcatgtcttttttagttttgaataaaaattagtttttcaaatgtttatattctgtgcattggtcttagtctagaacttctcttagacttaccctagaaacttccaatttatccccaatatcttttaactactgcaaattttaacaggtttactgatgtataattgatatacattaacatatatatttatataaagtataatttatatatagtggtaaattttatatatgtacatattaatatatatcaatatacattatactatgtttagatatttaatctaatatattaatattaacttcaatatatttattatatattatattttatatattataaatttatatgaatatatacactgtataatttataaatatgtacgtgtgtgtgtatatatatatatgtcaacatggaaatattaccttttagctcactaattatttcttttcaggctggagtacagtggtgcaatctcagctcactgcaacctctgcctcctgggttcaagcgattctcctgcctcagcctccctactagctgggattacgggcacccgccaccacgcctggcaaatttttgtatatttttttagtagagatggggttgcaccatgttaggctgatctcgaactcttgacctcaagtgatccacccgcctcggcctcccaaactgctgggattacaggtgtgagctaccatgcccagcttagctcactaattatttcttagattatatataattggtagcctttcctcagatgagtttattttcctatcaaccaacttttgcatttctaaaactacttcatagtttcttttagtatccatctataaatgttttatttttccctgttgtaactgataattactgctatttttaatgaatagcattacctattttatatttttgagaggataaagcctatttatctccactagccctcaattgctattacttatggaactaattggtgttgaacttttgactttgttgacttcgtggcattggatttcattcctgtcatttgaaattttcatttgcatgttcttcttgacagccagtctctctctttctggtctctctttctctttcttctctcttcctatctcctctcatctcccctgttttttgtgctttatcattttgggactttctctactcaagtcccagaatgtccagtctgaaagtgtaccttacattactcgcccgatgcctgtgcctggcagtgtttttagggaatcatgtgtctagtcaccaagccagtgaatgcctttactcagctcagatatgcctatttgctaacctctttgggcatacagcctcatataatccatatgtttaagtgagtaatcagctttcttcagtctcttttcacaaccaggttagccgagggccagtctcggtttgcaaccttaaagcaagctttctgtagctgatacacacagggaacttacattaccaatattccgtagtagtcaaatgcccaaatgcctttgtatgtccccagatccggactctgtctggcctcggcttcagccccactcattgctttgcatgtttgttgcatttcttgtgcatagagatgtttatcttattttttgatcctggctatgtcttttcaattttcttcttatctatcttatctaaaaatacagtgtatttgaagcagaagggggtctcaaagcctgaactcataatgcaattttgcctggagtctccttttcaatttatttttttcagctgatacttatttctcagccagttattaaaggtagttctaaccctaattgaatttttttttcaccttgtatttttgctaaattagaatccaggcatatagtctctggtggtgttaaaaccaccaacttgagtgccgcgtttcttcaggagccatttatcactacaacagaaactccatggcctctctaaaccacccactaaattcctcttttgtctgacttactgaattacaaattacaaagcaaaaataactcatattagtccagagtactagtttcttcaattattcagattctctattgtaatggatcactctaggagcccacatagaatggacacgtagaatacaaacactgtatatctttacagcatacgtgtgctcacaccatatactacacacacgcaaatacacagggggaggaatatctgtgtatgtgtgagaataaagagaagagtgaggaaggaaagacagatggaggatgggaggggtgggaaagggaagagagagcacagaagaagagagagaaggggaatgaagaaacagcattcttattgtttcgagactagcaagagttccataacaagtatacatctttcaagttacttcaacaatacactagttatttgctagatgttttaggcactattatctctaggcaagtgttcttcttaggaactaagagtttatgactgttcagcatctccacttcttctaactcctctttgacgtccaaccactttctttgagctgctacaatacattgggaacttttttgccctcttatataccacattccagaggtggttgtgatgaaagaggtatcattattaatcctcggatcaatagaggttacacatttcacaagccaagtaaacaaagtaataaacttccccgaattgcattgcttgatagaccaaagagaaaaagggaacttttcatcgatctttccaccatgttcctcatgaaagactgacttttgccctccccttgaggttaatcactacagtattctctccacatatatttctgctaagaaatacattttgacttatatttcttctgattttagatttttgctttccttaaagttaacaataaattctattttgctaaaagtaatgagataaatgggattaagcagctgtatgttagttgcttgcttgctgaaagactggaatgcagcaaacaataagtaactgaagaaaatttattctggagcattcattagcaaaacagaggaaatagtctaagtttcaccaatcaatcagacattttctcacctgttacctcattgtattaattgctcgttgacttgagttcactcaatcactctgttgcttttggtaatacatagaactctgtatgaaattggctataaaatttcttcaaggtttcgaactgtatatctaacaggtaagaaaatatatttgttaccccacaataactgagtatattgttgtccccaaaattaacctacagctctttcaaaattttatggaattctaggtaaaataggaagatgaatgatatatgacaataaggaatattatatattaacactacaataggaaaaaaataacatataaaaaacacactacaaagcaggtataagtaactcattgttagtaaacagattatcaggaagtggtcccaagaggtactgcagactagaatctccaggatacacatcctgagatgaaaaatagcatctaggaagttaattaggagtgttttggggatgaaaacctgtggaagagaaaggaatgaaacagaaattagttacagggaggagtttaggtgaaatgcagtttcaatgaagtctttgaccaatccctgcagggagctctgagactgtgaagacacctcagagtttctacaggttggggcagggtactggctttttatagccccaggttgaccagtcgttgcagttgcacaaccccatgaaggtataccatctacatgtgcctctttttaacccaggaaattcctgaagaggaattacagctaagtactgtatcatagaaaaaatattcttgtaaaagtgtgaattatatgataatagaaactgagaagtagttacatcgtttgcacatatattccatagatagcacccatataacctatgcaaacacatacactagatacttaaatttttccaaatgttttgtgagatatgatttcgatatagtgaaaggtacagattttaaatttgtatttttttttaagagattaatcttgggcagggatcaacaaacttcaaccctctgtccagctacaagcttttgttaataacacttcattataacatggccatactcttttgtgtatgtactgctcttcatactataatagaatttggcagttttaacagaggtagtatggtctacaaagccaaaaatacatagtatttaaccttttacagaaaatgtttgctgacccttgatctagggtttgctattttcaagtaataccacctcatatgtaaagttaagaccacagcataacatatttcctgtccagactcctatcctttgtactattgtagttgcatatctgacttccacatttattataaaccctgttattcatcattactgtttgtaagcactaaattatcttttaatgaaatttaaaaacatgaacaaatattttatatgtacttaacatgtttagcattttaagcactcatttcgtcatgtaaatatgagtttcaaaatggtaaacttcccttaaggtgaaaaacttatatttttatagtatacacataaaagtgatgaattctcccagcttttgtcttgaatattacgttatttttatatttaaaatatatttttgctggacatagaatttcaggttgccagctttttttttatctttccttttcatcatgtctgttaggttgtttcattgtcatttggcttgcattatttctgctgagaagttgtaaccctctgaatacctttaagattttctctttagcatcgtctttcagcaaataattataatgtgccttattgtattttcccttgtatatctcctgcctggaattcaataaacttctcacatatctgagtttatatatttcaaccattatttcttcaaacatattttattctgacccaatctctgtcatctctgcttgtagtactccacttgcatgattgttagggcagttatcaatgtctcacaacttactggaataactgtttattttttaagccttgtttttcctctctgagcttaatttagatgccttatatggccctacattctagtacaatgatgttttcttctgtgtctcatctgctgttaagcccatccattaaattttctatttcagatgtaattcttactcctaaaatttccattttgttctcgtttgttgcttttctccttcaacattttgcatttttaaaaaatgtttatatgttttattttagataatagaattaataattactgtttttaaagtcctggtctgctaatttcatcatttctgttattttggggatacatttccattgatttttttctctctggttctaagacatattttcctgcttgtccaaatgtctagtatatttttcagttgatatacttgacattatggatgcaatgttgttcagtttctaaatgtttatgactttccttaatggagtgtcaagttttgttccatcaaaaaattaatttttggtcagatttatctttttcagtaacctttgctcaggtgtgtccagactagccctcatattaggactaaaatatccctacatataatgcatgacttttatgggatgtctactgaatgcctggagggattcaacaaggtctctcaattttgtctagtctgaaatcaaatttttcccagctctgtgcaacctctggttattgttgacttcagaactccctttacctggtcttgtgcagtcttgatctaaaagtgcacagcatggtgtttcttctgagtccagattgcagagacacattcatgactcccttgtagatttctaaagcactttacacagctgtgccctctctgggactctgtcctgttaattccagcttctttagtagctttgaattgtaatatgtttccgtttcaatgacactactgcactgctgaactctgtttgggatcatcttccatatgccatgatccagaaagtgaagctagcagaaagccaggaagttggcagggctcaccttatttgtttatcttattttatggatcacgtactgcactgcccattgtccagtccctaaaacagtgattttttaaaattttattttattttattttttgagatggagtcccactctgtcactcaaactggagtgcaatggcaccatcttggctcactgcaacctctgcctcccaggttcaagcaattctcctgcctcagccttcccagtagctgggattacaggcacctgccaccacgcctggctaatttttgtatttttagaggaaatggggtttcagcatgttggccaggctgatctccaactactgacctcaggtgatccacctgccttggtctcccaaagtgctgggattacaggcgtgagccactgagcccagtcagttattttatatattttttagttttgtaattttaaaaaaagctattctatcatagttttaagcaaaaataggccatgtaaccattattatttgaatatctgtgatgatttatgaaatgattattatgaacgtcctcatagaataaattattttgccagcctttaaattccttatttaaaaaatagtacacacgttttgatatactgtacattggataatctattgaatatttttatatcattctctttagtagctgaactcactgtaaaaattatagtgcctcttagcactaacattatgccatattttctgtaacttattttgtgtacaaccctagttattttaaatattactgtaaattaagaatattgatctatatgagtgccatttttctaacaaatgtttttacattcttactatttgctgagcaattcttatattttgccaaaagagatttaactttgtttagtatctaatttttctagaaatatgacttacaagaggtattgactgtatatcttctaagtgttaaataaacattcttcctgatttcctatatacttccctgtacctctcagtggtacaggaaattaatgtaagattaggttcattttaagaattgcaaatatttttctactttacttcacaagaaaaatatattttagaattgtgtataattgcttgtttttaatttataatttattaaatgataaagtttacatgacagaaaaaattggatagttacatacatttttctcatgattttagctgaagagtttatggtaaattggtcaaccctcagccaattagactttgacatgtactaataagatctaattgaggaattatgaagacatttgctcaggagaaaatgagcacataattacaccataaagaggttaaagaatcaatgttaccagctggaagaatattagttgaagtcccaatggcatctataaaggatatttcataatatatctgtgaaatagagcactgccaagaccaattaagatatgtagaatattccattgtcagttgtacaagttcaaatttaaatattcattttcccatcttacctctgcccatcttcaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggtaagtcattggcaggaaagcaaagacacagaattggattggaaatattagaaaatggtacaggatttactaagcatatatagttatcaatatttatgtattcaaatcattgggaaactatttattcatcattgttgatggaagaaagtttcttcaggctgtaatttctatccaatggttaaagcaatgattctagatctggactatgaatttgaatcacctgaggaagttttaaagcacgtagatgaaaggcaaacccggatcaataagaccagaatcacgtaagttgaaatagtgattaatgatactgataacttttctgaagacagcgatcttcaattgaaggaaaatattgaaattatgaagaatataatttagagaagtaagagcagtgatagatgttaagaaaagaacttgtccattttataatagtgtcttaaacacttattacagatctatgttcactttattcctttattatgaaagaagagaataaagcttaacccatttgttcttaaaatgtctctattaacttaaaaagttgtatatattcaatcaaatattcaccacataataatttgaataaattatttaacagtaaaatttaagtgttctactttgtttaattattttaaaaagcaggcatgaccaaaatcaagtgctgtcatcaatattaaaccagaagaagaagaagaaaaagaagatgaggaggaggaaagggagaggatgaaagggaagggggaaaagaaggaagaggaaagggttcacttttaaaatcatgtccttcacagtattagttggagtgctggatatttttaactttatcatgaatcactcttgtagactttgtattttaaaagtccccaattattttttctaagtaacaagagtttataatttctagctaaagtggatgttcatttctacagcagtatgtgaaataaggatataatgtcctgataataaaaaatgtgtctacttaagtagaactttagaaataactcctttcaagtcataattatatggaaagaatatttgtgtattaggatgtataagttacggaaagcaagtagtgggaaaaatgcctctttctaaaatgtcttcatctcgcaattgagataattcaaatcctcaggcataatttatagaaaagtgcttatcaagcctgaatacacagtagaattagctagagaactttaaaacatatagacccttgtgtcccaaccccagagacttgaatttagttggtctaaggtgcagcctgggctttgggattttaaagctccgatggtgatgctaatgtacagtgaacaccgaatacatagtttagattggttttcagtctacagttaagaaggggatagaggaagtatatgctgaaaatgaagaggagaacagaaaatttgaaagagttgcccttaaaatttggcagagagagagaggggaagacggaggagtaagggggttgggtggggggaaggggagggagaaatcaagtggccaaccaaccaaacagcagaccaaacaactgagagtaaacagtgaaggcttggatcacagacccttctaacacccagagcactcattattttctaactttctatggtttctaaactaagatcaaatgagcatgttggtaaaattgcttgaggggtttactttctgtgatttctaaactaagatcaaattagcatgttggtaaaattacttgaggggttacaagtcagactctgaaatactgttctctatatcagaacagaaatactgttcacatttttgtatttgtaaagtcttcatctcaaaattaagagtgttcaaatctcctctcctctcataatgtgccaagatagtaataaagatagctgctaaaatacttgaactttaatgtatctgtcaaatactgaacagttaaggacggctaaatgcagagacataaggaaaaaaggctaaggaggataaaattgttcagcttgtcttggagtcttttttttttttgagacggaattttgctcttgttgcccaggctggaatgcagtggtgtgatcttggctcactgcaacctccgcctcctggattcaagccattctcctgcctcagcctcccgagtagctgggattgcaggcatccaccaccatgcctggctaatttttttttgtatttttagtagagacagggtttcaccaggttggtcagtctgctcttgaattcctgacctcaggtgatctacttgccttggcctctcaaagtgctgggattccaggcgtgagccactgcacctggccttggactcttgatattacatagaataataatggttgagtcggggagacaaggatgtcatgtagtgaaaacatcacaaattatgaagatatgctgggtctacttatagggctctccatcttaaggtgataaaggtgcatttctattgtcttctccctttctggtgttcactttgtttcttcctttcaaatattgtgtttcttattaaaaatcagtatgctacgtgatgagtgattattagtagtgagctcattataaaattttaaaaatcaaaacaagttggagactatgttagtctgttcttgcactgctgttaagaaatacctgagactgggtaatttacgaagaaaagagttttgattgactcacgtttccacaggctgtataggaagcatggctttggaggcctcaagaaacttactatcatggcagaaggcaaaggggaggcaggcatgtcttacatgccgggagcaggaggaagaaagagacgggggtgtcacatacttttttattttttctgagacggagtctcgctctttcgcccaggctggagtgcagtgacgcgatctcggctcactgcaagctccgcctcccggtttcacgccattctcctgcctcagcctcccaagtagctgggaccacaggcgcccgccaccacgcccggctaattttttgtatttttagtagagacggggtttcaccgagttagccaggatggtctccatctcctgaccttgtgatctgcctgcctcggcctcccaaagtgctgggattacaggcacgagccaccacgcccggcctgtcccacactttttttttttttttttttttttttttttgagacggagtctcgctctgtcgcccaggccggactgcggactgcagtggcgcaatctcggctcactgcaagctccgcttcccaggttcacgccattctcctgcctcagcctccccagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtgagccaccgcgcccggccctgtcccacacttttaaacaaccagatctcctgggatttcactcactgtcaggagatcaacaagcgggaagtccacccccgtgatccaatcacctactatcaggcccctcttccaacactggggattacaatttgacatgagattttggtggggacacagacccaaaccatatcagagacacaatctaaatattgcaaaatatatttaagtaccagtaagcctgccacataatgattacattatttaataatctgtgacagaaatgttttaatccttactaatacaaaaaaaaaaaaaaaagagtccaatcctttgacgtattctaaaagagttaaagttcgttgacttctaaaaattcttgaatattttagggctacgtcttatcattcattaagtgattaaaatttagcatttacaaatttcaaaaaaaagtactcttggggattaagtttattaaaaatgatattaaatactagagttttttaatccactactgcttaacattatgtatactggacttgaagagaattctgatatagagaagattggatggctttttgatggaaaacaccttacaagatgtaaaaatttatgtatttttgaaattgtttttactatccattttataatgattgtttacctgagaaatatagaagataatgtatattgaatcacatgaatataattttaaacaaatgtccatggttatgtttttctgattgttggggaaatggacaacataagtaattttttatagtattcttattaaatgttcatatggacattccgagttattttatcactgttggataatatattaaaataagcaaagaacaagtcatatataagcaaattatgacagtttcacaaggttttagagtcatgaatcttgcattagggagtgagaatggctcctgaaaagattcctaaagaatggtttatctgaatatttaatattcaaagatctgagtttctaaatgggcttaactagtcaaaccttccattcctctttgatgatactgagcataatagaattctttatattttacaatataatttccttctatttagaacctcttttccaatgtaataggtaaataaaattgcccaaaaaatcattacatctacatactccaccaactctaatttgcatgattatcttgagatgttttcaagtttcctaagtataatctgttagagagagagagaggaagtattctgtataagcattttgtatcagaagtccattaaacattatattaaataagaattccagcaggcttttgctaagaggcctgttttgcttgggaaattcaattactggattttgaatgcagatattcggagccaaaataggaaactggagtaaaagcagtggatgccttctttacacaccactattattttgtaggataggaacatactacaaatttaccagtcatatgagcgcagtttttgtttttctttaaaaaacacttcctaatcatgaaaacatgcttgtatattctcagttatttttaaaaacagttttgatccattttgttaattttaagtaggtgttagactgaaatttgttaccactgcatctattaaatggagaattctacagaacacagctgttttatcatatttaaattatatggttagatacttatcaagaatatagggataaacaaattcatattatctaagaagtattaaatagattacttattttcaaaacctagatctccttgtcacatatacgcttttcccatgtacaaatgcatacacataattgtttcaataaatttaaaacatttcaaaaatctagaagacaaatacaatagttggcagtttcatttatgaaacatttggattttctgaatagcaaggcataagctggaccacgtattccctactttctttttaattacatattccatcaaccagtatttataaaataaaagttctcaaaaacatccttttgagttagcctgtaattagccatcaggcaagtgaaagccaagatatggagtcgaaaggtctgaattcatgtatcttgtttcatttgtttgttttataaacttggagatctgactttatttctctgttcctgaaatcctaatctgagaagtagatataattcctattgggatatttaagtgagattatgtaagtaaagaaatttttcaagctattaagattagaaacatgtgtgtcatcaattcccaattttagaagcattctccaaatctagtgtagtatgttttttcagtgacaatagtcagtaatgacaattttcagaatttttagtcaccctctatgtttttcagattccctttacctctttttactcttattcatgattgaaaatatctgacaatattttagattaaggaaatgttacttaaagttggaggtagaatgtatgcaaatctctgtcataattttcgattaacacatggtaaatacatgtttagatagtgcagtgcaggctgggtcagtgaggcatgacaggtagacctagctctgtgccaggtgccattgcagtgcttgtaacaaattatctgttaccatcatgatggccttgtgtccaatgagccatttaaggggacactgtttagaaatgaatggattgttctgtcctttcttttcagccatttgttatagtggttgcactaattttccaaatcacttaaaaatctgttcccagtataaatataaaatataaatgccattctgttacagttcaatggtgtacttagattctttcaaaatatctagaattttgtctgcatgcgaaagtcaggatgacaaccatcctgtcgcctgcccctacatcttccatcggataataacttctacttcacttaggacatgaatgtgattcttttccccaaaagatgagtattacccttgcttctttatgtaaacatctacattcctgctgccatcagttatttgggtaaaggatcaggcagacatattcataataattttatagatagcttattgagaaataaaacacatcagaataatctgcatcaaacaaacactttctaaaattatctttgatataaatggggtaaaaatcttcagaacttgtatagaaaaaaaaacaatttccaaggcgatttcagaataagctccttatttctgtgaaatagatttttctgtttatactcctcttaggctggataatatttttaaagtctcatgaattttaataagttgagtggatattccagatccttttgcatatactgtaatgcatctactagtgaattttgatcacctttctaaatacacatttgtatggtgagattctcattttcaaaggtcatgaggtttcttgggacaatttctgagactcaatattgtacataaatagaactgttctaacaaatatggttatgtgtttaatatttttctaaaatttggaagataaaaataagatgctgttgataatattgaatatattattggcatatattatgagataaaggaaaatgttataatctcataagatttcttacaggctgtaaaataacagtatatagttcttcacagtataatgtatttttcatctatgagataaaataggatatatgtaattattcttctaatgtttaaagtatccatgaaacaagatttgttatcaattatactaatattttcaggtgttttattttacattgaactcaatgctaattttttttacgttgaactcaatgctaattttttttacattgaactcaatgctaattttttttatcgtgtcaaggttggatttaggttacctgaggctaaataactccaagtaaatacatagttatataatgtgttgataaatgggtacctacaaataatttgaataagatatcagttccttcttttaagatgtatgtttctactctgctcaagtggtaacttagaggaatactagtatgcttattttgggaaatttagggcacagtaaatcatgcttcttatgtgcctggagacgcctgagaggccgtggaatgagtaattctatgttacactctggaatcagaccacctaggcagattatacaattttggtaacatagatctgtgtatcttcacgcagattctttaagctttctgtgcctaaagttcccaacctgtaaaatgggtctagtcacttacctgaatagtatttacctcaatggaggttgtaggtattaagagaaaaagtcaaacaaagggtttagagcaatgtctggaacatattaatcactcaattattttatacatttgtgatttctaggtgcattaacatagtatattggctcttttcttgaaaatttaaaatagcctgttacttccactttataataacgtttttctattagtgtattggtgtgtgtactgtattacatacatctgtgtttcccagcctggaatgacaaatgactcatttggaagtataattgagaatgctaatttatgccattcaaatcttgggcctacttattatcacatcgagtcctatgccttgtcatatgaattgtgcctggaaagttttttcagatatatattttttaatgaaacttcagtgaaaatatgactaggatgttttcattagacttagtttaataaattcacttgataaagtgcgttaacttcggaaagaaataacccatttttgtctacagtacttctctgtgtcttcttaggccaactgaaaagggtaggataagaagacttgaaaataggcttataagtattaactaaaacagtttatgctggttagccatgaaaggacaaatcagctgcaccaggaacatccaggagcttgtcagagatgtagaatctcagaggcttaacccagatctactgatcagaatctacagtttaggaagactcacaagtgattcatatatacctccaagatagagtgtgttgcttttgatatttgaagaactctcacgagaaagaggaataagcatcagcatttgtgtttccaaaccagaaggtagaattagaataactggaatttacagtgcaaattgcagacagatttatcgtgaaaaaagagtgagctttgataaataggcactcactgagcacctactacttattgaggctagggataaacagaccaaaacacaagcataattgctgtcttctaggggtcaataaactggtgataaggctaaacatatacaattataagtatattgtatgactgttcaaatagagaggtgcttgcctaggttgttttgggaacactaggaaagtggtcttattcagagtggttgggtccagcaaaggcttctttggagctacctactattggctaaataggtaaggagttggtcactcagagaagaggggcaggaagtcattccaagcagatgaatcttctgctgaaataggtaggaatggagagtgggattctataaataactgcgtttttcctgactttctgacatgcaacaaaataaaaagctgacctttatctatttatttagagacagaatctcgctctgttgcccaggcttgagtgcagtagagcgatttcagctcattgcaacctctgcctcccaagttcaagggattctcctgcttcagcctctcgagtagctgggataacaggcatgcaccaccatcccatgctaatgattgtatttttagtagagacgtagagacggggtttcgccatgttggccaggctggccttgaactcctggcctcaagtgatacacccacctaggcctcccaaagtgctgggattataggggtgagccactgcacccagcaaaaagctgactttttaaaataaaaaaaactctgaaattatatcctgtgaatcagtaatgcttaatttatataatgtaaatatctaattttggaagaaccttggagtttatgcagtcgcctagggcacatttttatctctgtgccattcatcatatagagctcactgcagagcacaaaacagatgtttatgagtttacaactgaactgaagtatctcattctgtagatgaataagctgaggctgagaaccatgatgtcccttaaactggaaccttgaatccaggtatactgacctcactactgaatatggagccaaatacttattttggttcagcaagaagttccattactataatgaacccctgctcattttgagtaattgaaaatactattgaatacatacacgatatttatagaacaagatagcatgggctctggaccggacctcaaatatctgaactctgctccaacactttctcgtggtgtgtatttaactatgttaatcaacctactatgggtcttagttgccttaggtgtaaaagcgatataattgtatttaccttatgcgatttttgtgagaaataaattaatcaaaaataaattgtttagaacaatgccccataaatatagtctcttcttatcgtcctcttgtttcactttctcctatttatcagtattattacgaatgctatcattaatgtttctcaaatactatattcaaagtgatataaagaatgcaagtaagtagttaatagtaggtctagccttgagaataatatattttaattggaaggacagcaaaaatcactacaataactttaaacaaaagcccgggtcatcttgcacagctttcaggatgcttatgcccctggacaccgtgaagatacccattctatgtgtttcacttatgcatactgttttccaggtagctaatttagtcagtgttgactttgggagagaactactagaatgttaaaatgtcttggcaaataaatttggtttgcttgagttaaatagcttaattataggctgcagtgaaatgatcattctggcaaaaagatatagtgctgacaggctgtctgaaaggttcattcaccatctatgccttttcagaagtctagagcaagagtagagaatagactttggcttctagaaaaaattctgtccatttccaaatgaaaataatgtttgagataagtatctgcatttctccgatgaacttcaccaatatattttgatgagacagtgaatgggcctattgtaattgcaatttaaatgctttataatgatattaatatgcagcttggaagatgtctgtgaaaactcctgtgatttagcagagaaattcagaaaacttcagctgcacaaattaataaataataacagccaaccaacacttattgggggttccttaagtgtttaatgtgctttatatcatttaatcttaaaaacaactaatatgtgaggatatagattattatttttatgattaagccctatttttggctgcagaaattgaggattagagaaagtacaactttccctggggtacacggtgggactgggtaatggatgtgttaactaacttattatggtaatcatttcacaatatatctctgtatgaaagcaaaaaaaaattgtaatggttgaataaatatcacatttcctgttttaaggaacatacccgcaaaataaaatacaaataaaaataaaaaaaactaaactaaactaatcaaacagtggagctaggataggaaaccaaagctacctaactaaccagcctgtgttccttgccactatggccctggtcagccattcctttcacaggcaatgtgaaacttagtgatctctgcatttaaactgtaatatagcgcttgtatataagatgttggtattttatttattttttatttttatttttttgaaacagagtctcgctctgtcacccaggctggagtgcagtttcccaatctctgctcactgcaacctccgcctcccaagttcaagcgattctcctgcttcagcctcctgagtagcttggattacaggcacctgccaccacacccggctaatttttgtatgtttaatagaggtcgggttttgccatattggctaggctggtctcgaactcctgacctctggtgattcactagcctcggcctcccagagtgctggaattacaggcatgagccacggcacctgggcttttttctaattttcaatacaaaaattgaggttcaggatcttacctaaggtcacagagcttaaaagttagaagatcttggtctttaatgctattgttggtgttgctgttttcaatttttaaagaaagtactatttacctactgtattagtttgctagggctgccatcataaagtaccataaactgggtggctcaaacaacagaaatttactctctcacagttctggaggccagaagtccaatattgaggggttggcagggttgactcctcctctgagggaggtgagggaacagcctgctccaggactctctccttggctcgcaggtggttatcttctccctgtgttgctttatatcatctttcttctgtgtgtgtgtgtgtgtgtgtgtgtgtgtgtgtgtgtgtgtgtgtgtgtgttttgatggtattgctctgtcacccaggctagagtgcagtgatgtgatcatagcttactgcaaggtccaactcctgaacccatggatcctctgtctcagccttctgagtagctgggactacaggtgcatgtcaccatgcccagataattttaatttatttattttttgtagtgatgggtctcactttgttgtccaggtgggtcttgaactcctgagctcaagcagtcctcccacctcggcctcccaaagtgttaggattgtaggcatgagtcactgtggctggccttgtttttcattttatatggcattcattttacaaaaaatttatttgtttagaatccactttactctggtatgacctcatattaactatacatgtaaagaccctgtttccaaatatggtaacattctgagacattgggggttggaacatgaacatatgaattttggggggacaaaattaaattcataacaactagtaggcaagtactttataaagttatgacattaaaagttatttgctattgctagggtgttgataggggtgtgtctggtaagtaagaataaggatgatcttgtaagaaagacaatatcttctaggaagagttgtgcatcaaccttcattaactcagaaaatatgcttgaatcaaacgactacttatatatgactctctgcaatcatttatttacattcaaaactccaaggaaacattttcagaattattctatcctagatagcaaatgaaccaaagacactttaagaatcaatctcccaccccgtccccaaagaaatgtttggccttaaaaatcatgtcctactttcaaactccatacagtagtttattctgcactaggcaccatttaacactatcaacatcatgtaattctttgagatatagtaattatttattaaaaactggattccagcaaacatgcattctaaacaatgatggataatttttctatcagcaaagaaaagagctcgcccagagccaaaacagctttccccaattaaaagttgaggttgaattgctaatttcatttggattatactagtatctgcttgaaaatggcaggtttcattagttctcccagtattcttcagagaaggttaagaaacacattccctccacttcagatatgaaaactgagttgcccagggtgaagtcgttgtttatcttatgcacttagcaagcacaattgttcattctatacgcacagtgactgtctcgtttgtgtatttttcagctttgttacagtatacaaattggaaaacagagctgtgtatgacagcctagagcaagagaaaaagactgtgaatttatcataaagtcattcaggctctttacattcagcctggaacaaacaagtatttgataaaagaaaccagaccaatacaaaagaaacgtccagtccctttggaaagattttgtgattatgacatagcaggaatatccaatgagtttttcacatgatatgttaaataaaaaggtatgattacatatctttaatatgacagcattttcttgaaatattaatagaagtattgcactttagctttacttaatgtaagcaggaatgccaatgatgttggtttcaaattttaaaatcaaaaccaaaatatgattattcaggtatattttatgttaggatttgggataactgattgtgaaataagacacaggcacatgtacacacacactctctcaactcttactacacactaactattaatctccccccaaataatatcaaacctatggatatttaatggaatttaacctatttcttagcttattcaattgaagtgcagagatgtttggcatttttactaaaatcaaatatcattgccaatagtaatcaccatgcactgagtacttacctggtaagcactttttgtgtcaattactgtaacaagatcctgagaggtaagagaccaggctttttccttggctttatgtcccactagtctttgctttctctattataccatatttaagaagatatcatagtttttgattataggtgagttgtctgaggggtttattttgtcctgttaaatgctgggtctcatcagctaggaaagtgccttgactattgaatgtatttagtaagtacttgttaacagatccaccaaattgtggaatttagtgaacattggaatatgcagctataattaggtttacaatttataaacaataatgtttattatcttaatttatacttaataatattgagaaatactgcatgtacctacatctattagaagtcaaactgtccaaaatggcatgtgtgggaacacatgaaaagcctaggatttctataggagagaaaacaacagagtttgcagcaacagggagatgagaaggaggctgggaatactgactgtagcagcaaagcttatcctcccttcagacctggaggcagcttgatgctgctgagtgtaatggcaaggaactggtgccaaaggcatggatgtgtggcaatctccaatccaagctggaccagggtccatgtggttagtaatctagatggtggtttcctctgttgaagggtcatggctagaagaggatacaaagaaattttagaagtgttgataattctttgtttcttgacttaagtgcttcttacacttgtgcaaatgcatcaagctgtatgtttatgtgtgcttttttcctatgtgtattaaaattcagtgacaagttgtaaaaacaaattaatcagacttggaatcaaggtacacctctgatggaagaggaatgaaagaaaccaggaactgttattggaatagctctctagtaccaaagataattgtgggagaaaaccagtgggccaggtgaaatggtaaccagagagcttagcaaagggtctttaagagcctacttgcaacatatagggacattatgttactctttatgtaaattcagcatgatataagtacacgggatctactcacacttagtacatagatacttagtatagcacatagtattatttgctgatgaagagggtatttctaaagaaatatgtttggatgtcattgcctctggtttgaaaagaaatgaatgtatatgaaacaggcatcattgtgtgcagttggcatgcacagggaatgacaggtaaaccaagctgtggctactcctacttgcttttgattttgtgtttgttagtattatttttgttgttgttgttctatttgcaggatgaatgcctaaatttattaatcttatttttgtattataattgccatctatgtataattgatgctaacagagaaaatttccatgtctataatatctaccaattaaaattgagaaaatatagaaacaggcaaaaacatgaaaaggaaactcaaacaaaatatataaaattgtgtttacatgcatacaaatgtaaaatgaaaagagaaatacaaattaatcctctatggggatactatatctcaccaatcaggttggcaaagaccgaaaaggttgtttatacactcttttgggaagaatctggggaaacagcattctcatatactcctgatgagcatgtccaatagaacaatagctatagagggggattggcaatacccagcagaactaaaaatgcatttattcttcaacccaactatctcaatactaggaatttagtctaattatacagctccaataacataaaaagtcatacgcacaaagttatttcttgccattgtatttgtaattacaaaatattggaaactatctttatgatcaaatatagattggttgaataaactaggctacatatttgaaatagatacacagcagctgtgaagaaaaccgataaaatataagttgacatggggtggatttgctggatatattgtttagtgaaaaaaagaaaagtacaaagagcgtttattgtatgttaacttttgtttaagaaagaagaaatgaggaaacgtatatatggttgaagcatttctgaacatatttaaatgtactgtaaattgagcaaatgagtgatatgtcaattgtgttgggggccaaggttctcaccatgaaggaaataagaaacatacgtggaatgagagaagacaagaatgaagcctacttaaaaatatatgtgtgtgttaatgagtatatatatatatatatatatatatatatatatatatatatatatacacacttacatactacatgctaagtagctctgacagctggatggatctagaaacaaaaatattgcagtaacactaagcacacctaagatagactttaattattaatacaattatcatctaaaagaaatcagatctagttagaaaaattttaccaggttgtggtcgagaaagaaacttgttaaattaaacacaccttgttataccagaaagaaaggaaaaatgatggttaatacaaaattacataagagccaacttgaaataattcatattggtcaaacctggacaatttgaacaccaaaatagttaaggacagtaatgcattgcacacctttagagaaaaatagaaatgcttaagtctatagagatgataggtaggtaggtagacagacagatagatagatgatagatatagatagatagatagatagatagatagatagatagatacatacatacatacatacatacatacatacatacatacatacataggcaggcaatagatagataaaatgaggcagaagagaggcctcttgcttatagtagaatacgaacttctgactaggaaacgtggaagggtgctggaggtgggaactcaagtcatcatttgcaaccatcatagtaaatactagttctggcataagacattaatggtaataaaagtagaggatacggagagttttgatggggagaagtaaatttgtatagtcttaaagtgtctcttacaaatcacttattagttgcaagggaaatgaataatatttacacaagagaaattaaacatcttgagtgggtaatcaaaataaaaattacagatgagaagcagacactgtgcgcctccagaggcagtggactgagaaggacccaacaccgtgcatgtagtgtcccatgaagaatgtaagtggatgtaaacattatgagaaaacaaaagtcaaaccaaaattgaagaatattctatgaggaatgttctactaaaaagataaaggagaatacattgtctatgtatcagtgtgataagagacactaaaaggctaaggagttattctaggtaaaagaaaattaaagggacatgatacctacctgtaatacgtgatcctagcctggatcctgtcttggataagaaaagatgccctaaagacataattgggtcaatggataatattgggatatggaaggtttattcgatgtagcaatgttaaatttcctgaaattgataactatatacttacctacatatgtccttatttgtatgaaatgtacactatttggaagtaagtgaacatgatatgcaacttattctcacatggttcagaaaaaataatgtgtgtgttggggtggtggaaaaaggagagagaaggagagggagagagagagagagagagaatgataaaccacatagcacagagtaaaatagaagaataagaataaagagtaaaaggacaagtgttccttatactattattgcagcttttccataattttgaaattatttcaaaagaaaagttaaacagatttaatatttccctgaaaatccagcattagaaacacattaccacagcttgtattcgtttgtttgttttaacagggtattctttcaaaaccagattgccttatgtgagtatataaataaacatactaatcttaaaccactaattgaaatctgtattagtatatttaattggatctttccattaactagctaataagtggtgttctccagaaaatagagatttgacttgataaggcagaggaaaaagaagttagaccaagagaacgactgagaaacaatgggaggggcaatgagggacgagagagcctccatcccgtgtgggtgtctgaattgacaggagcacgtggaatataagaaaaaagacacaccaatctatcaatagacagtgttatctaggactattcctgatgtaagtgatgagtagtcagctgctgttttgtgtttggttctatatcatatgttcaaagatactaccaaagatgtacacatagaacactaaactgtggaatcatatttgtttcacaggatttgtaaggtgaagggggtgataagaatttcctgaaagtcaataaaactgtgaatatgctttcaggcatggagaactcaaaagcaccaacaagtcacacttatcagaataagtttgaaagtggaaagaaagaagacgtgacattagcttaggacaattggatatttcaaaacatatgtaggaaaaggtgctaagggccttgacagaaggaaataaatcacaattagatcttgttctggaaaaatctgctaagatctacggtggcaactcaagtctgaggaggacatgaaggttttctcttgccagaggagtacttagtgttccttggagagagttgtcaggcaaatatgatatacagattctctgcactcatttgttctgtgaagatatcaaaaagaacctgcctaaatgagaaagagatttttatctagtggaatgggcttgcactaaatgttgtctagtttccctgccaacactgacattcttgcattcatcctaaggtaaactgttttaaaaagtttgcaccaggcttcgtggctcatgcctgtaatcccagtactttgggaggccaaggcgagaggatcacttgagcccaggagtttgagaccagtctaggcaacatggcaaaaccgtgtttctacaaataatgcaaaaattagccagacatggtggcatatgcctgtagttccagctcctcatgaggctgagatgggaggatcacctgagtccaggaggtcgaggctgcagtcagccatgatcacaccattgcactccagcctggggcaacagagtgagatcctgtctcaaaaaattaatcaattaatgaactataaaatttagctaccccatatgtaatatcagttgctgaaaggtagtcatatttataaatcacatttcatttttttgcatttttattataatgtaagcttattatttaatattcttctcctttagatataatttgtcctacatcatttatttgaagtaatgttgtacatgtcagcataaatgcctttctttcatccttaatacattcagaataccagggagaatctggcattggagaaatgataatgtaagggttttacatgacacatcaggaaattcccaaactttcataagaaaggcccaagtgctgacactatatgttgactcaggtcctataaatgaaatcttaataaagcaattgagattgagaataaaggtaaaattttgaggcaatataggcaataacattagaatttcagggttacttcagcagagattagaaaatgtgtttcaatttcctcaacagagaacaagtcaaatcttaaaagaagagcagagtcaacttttattttaaagagcatcactaaactgattaatggcacttaaatgtgtctgttgacagaacaccagtaacagtattatgcattagcccctatagttattgaaggagctgcatattttttaaaattccagctattaaagtcaaattataatccttgttgggtgcagtggctcacacctgtagtcccagcactttgggaggccaaggcggttggatcacctgaggccgggagttcaagaccagcctgatcaacctggagaaaccctgtctctcctaaaaatacaaaattagccaggctgtggtggtgcatgcctgtaatcccagctacttgggaggctgagcctggagaatcgcttgaacgcaggaggcagaagttgcagtgggccaagatcgcacaccgttgcactccagcctgggaaagaggagtgaaattccgtctcaaaaaaaaaaaatatatataatcctaactctgagtctgagacctaccctgactctaagcttaattccacctccaacccaactcaattgaaaacaaaaatacaggaaccacaaatcataagtgattgaagaagagaaaaatattgcacgtggtatctcagtgagtaaatagaaggaaagagaaccaaagatagagtaaaaggaaatgtctaaattcagctgccgggctaggaaaatatgaaagagaaaaatttaaagaaaaccaatgtggtcagcagtaagaggaaacctagagtgggggaggaagaggatcaattgctttaagaacaagagacttgagattacctttagaggtgggttcagctcaaaatgtgaaacaagattttaaatagagtggtaaaaacagaatgacataaatacaaaaatgtggtaagacttttatttaacaaatatttatcaagtttatttttattgttcagatgttacaatgagtaatggatatatatagactccaccatcatgaccctcatggagattagagctagatagaatataaaggtgtgattatgcagtatgtttttaaaaagtggttgagggtggtgagacagagggagagaactaaggcagtggtagacaagaagcttgcacaccagggaggttgctttcttttttatcttttataggccaggcaaaagtggaacatgtctgtaggtaagaggaacagtgaatgcaaagtctctgagggtggcagggtgtgtggcctggagctgagaggacaaaggcatttccattgacagagatcctgctatgtggcaggcagtgtgccaaataccatttggttttatgaaagttctagaacagcccctgcagttcaataagtacacaaactagatagggacatatttatctgaaagaaaaatggatcatattgatctactcatccctatgaagactgaaaagaggatagtctattgtggaaaaattattttaaaaattaatgttagtttaaaatgtattgtcttaacctaaagaaagcatctacattcatttaaagtatttatcaaatgattgaaaaaaaatttcttggaacagaaaaaaaaaacgcattattgacattctggttttatgggtccaagctgttaaaatatgtataccagggtcttaaggatagaatgagccctagaataataataacctcctttggattaagataattaataaccatgatgtctatttgtttgtctgcttttgtaccccttcttcctactggatgccagctctcatatttatcactgatagaacacaaatggtaaaattataggctagaatttttttcttgttgtttgcttcttttcacattatatggatttccgttttaatttattttcttttttctttgtttgtttggttttttgttttttgagaccaagcctcatcctatttcccaggctggagtgcagtggtgtgatctcgtttcactgcaacctccgcctcccgggttcaagcgattctcctgcctcagcctcctgagtggctgagattacaggctcatgcccagctaatttttgtatttttagtagagacagagtttcaccatgttgtccaggctggtcttgaattcctgacctcaggagatccacctgcctcggcctcccaaagtgctgggactataggcatgagtgtttttccttaccctttcattttcttgaacacattttaaaatttttaaaaatttacaattacaatgaactgatgtttaggtgctcaacaattttgtacagttgtcttatttaataaaatcgatagaaaacttttagtgaagaataaagtattatactaatgcatcataatttctattaatctgacacttagagattgtgaatccaattcacaatccaagtgtacattgctgacacttggagattgtgaatccatctcttagcagggggtaaccataaaattcccctcctaatttaaaaactatcattataaaaaatcagcattcagtgagataggtctacaaacataaactgcttctcagtatcctacaggcctgattttcttcatcagccttgtcagggttgtgttacatcgcttcatctgactacatgaatggctaaagaaaaaataattatatgtaatttgctggattttggagccatggcgccttataaatatttaaaagatatcgtatttagcaatctgaacagagatgtatactgataatgcttgagaccttggcaactcaattaacctctgggcattggatttggaatggagggattattattcattggcaattgtataaccactgtaattaaaaagcacttgccaaccttttaattattaatcctgtggttcatcctcttgtataaaggctaacatgcccattttaccagttagtggattggggaaaatgaagggaaaatgatagatgcaggcgcggtcgatggcaatgttaagactttagaatgcaggactttttccacctgccagttcgttattcattctgattagaatcatttattctatcttaattaattctgtattttgagggttaaagtacttagcgtttgatatattgaattaattctttacttaaatctcatgttgcattccaaatacgttcaattttgtaacataaaaagagctgtagcatttggacctttcttaatgacaacaaaaacgaaaaaagtgtagttttggcaacttttggatcataacatgctatttcctgaataaatagtgataaatcacttcttacacttccttgttaaaaaaagaaaaagaaagagactcaaatgtccatcctatgacatctgggcacaaaaaaacaaaaaacaaacaaaaaaaacgctaatgacactcaatgcaaaatattcagcctccttctgaatgagaactaatctttatgcatactatttgaatgtgtaccctgggggaaaggcataatgttacttggctgtctatcaaagatatcacagacaactctcaaaggttagagcagatgcttttaatcagatgctgttttcattttttatctgagttttcttaaactaaacttggctaggaattcaaaattctgtgaaacatacatatgcactcatatttttgcacttgtgtgcagccagacacataaacatcgccctgtctgtatggttctttatggtacagtgttatagcagccactccagggtgtaatgtggtcattctggttcccccagttattaaaagtgttttgaacagattcagtaataaaccagtgttatagtcacttttgtgcttgagtcaaccttcatgcatatagatttccacttaatggcaattgtattggatttatatgttcttacagtgacctcagatacagaaataatgagtgatcttattaatttgggacctgtctaatgtgggttttgaaaaataatgatttgataacttaaaaactcctttagatcagtaattatgtcaaagtatagaatgaagagtgaacctgtatttaaagaagtgacaaaaaatttttcatatttaagtctttaaatgtatctcccaatagtaggcatttatgactgtactgaaaagtttaatgttttctcaaagaagtaaatagcataagaaaatagttttaaaaaggagctttattatagtattaactaattgtttgtttataagccttatctgcttcaacataatcatgctaccaagaactttattcaattgagatgaagagttatcaatagctgataattatccaagataagaggtatgtctttcatatgactctatgctttaattataacattagtcaaatgtccacatggtatttccacagttaacttgtaaaatgagaatagccttgattcaaaataactaattaaatacagaatgtgattcaataaaagtcactgattgggtaattaagagaagaattagaagacttgaatgaaaatatataatacttgtaatcctaattagtactatgctatttgcttccccttccattactagacatttaccaaccaagtatttaaccttgaaagaatcaaagaagcttttctgagctcatactagttcccaaatagaagctaggctatttaagatttctaaagattgaagataaaatacttgctagcatgtccttgaaatggaattatggacaaaaagtgttagttgctattatataatgaaaacacaaatataaggagtaaatccaccttaagcaaaatgtctaaatgcttagctgtatttatcaagtgcttttcaatattttttcttcctccttttctgccctctttgctattgatagaggttgttgttaaaggtatagttgttttcttcttcagttttatttttagaattaaaatgctctaagtaaccttttttggtggccattatttgacattttaaaatatgtacctttctatatgtataatatcattcagtgttttattcttctctttaataatgtagagcattagcatatttaccaagacataaaaattacaaaagaataaaattagagatctatatttataatgaatatagacacaaaaattaattagaaaagtaaatccaataatttttatataaagacaataccttatgaataagtggtatttatcccaggaaagtaagtttggttcaatattttaaaaaatcagtaatgcaaatcatcatgattatggcaacagatataaaaaaatcatttgactaaatctgacattcataaaatgacaaagtgttcttaacaaaaatggactggaaggcaactacctcaaattcataatggtcaactataaaaactcacagctgatggatgcagcacttaatgttaaacaatagaatattattgatttttgaatgagaaaaagatatgtttttacattttatttaatattacattggagattctagccaatgcagtaagaaaagaataaacagaagcataaagattggaatagaagaagtaggcctgtctgtgttcatagatgacataataatttatttaggaaatcctaatcaatcttaaaaacaaaactactgaaagtagtcaggctgggcgcggtggctcaagcctgtaatctcagtgctttgggaggctgaagtgggaagatcacttgagaccagccttggcaacataataagacctttcctctaccaaacaaagcaaaacaaaacaaaacagaacctgcagggtggcaggctcctgtggtcccagctcaagtggtcccagctcaagaggctgaggtaggaagctcatttgctcccaggagttcaaggttgcagtgaggtatgatcttaccaccacactccagtctgagtgacagagtctatctaaaaaaaaaaaaaaaaaaaaaagtataaatttaacaaggcaacaggttataagattaatacaaaaaattctatatgctagcatcaaatattcggaaaatgtaatttgtaaaaggaataccatttaaaataggaccaaagacttgaaatactaacagttaattataataaaaattatactgacattctttactgtaattaaaaatactctgtaagaaactaaataatagctaacacaatggagagatacataaggcttattaattgtaaaatatgttaacttgttcactatcttcaaattgagtaggtttttaaatttacaaggtgattcaaagtttacttgtactgcaaaaggcctaaaataatccaaactgggtttgaaaaaaattggaggaaatacaagaatttcaaaaattactataaacttataataaagatagtcttgtatagctgtaaatataaatatatagatgaagagtccaaaattgagtccacaaatagactcacatatatatggagaattaaattttaataaagccaccaatatgattaaatgcagaagagaatagtcttttcaacaaatggtgttagaaaatgatatccatatggagaaaatgaacactgctgcttcacattctacacaaaaatggatcatgtacctaaatgtaggcaccactagttttaaacctctagaagaatataaaggagaaaatattcagccttgggataatcagccatttattaggacaaaaaagtattagccataaaaatgataaaagcataacacagagaaatcaaaatcttctattcttcaaatgacacactaagaaaatgaaaatcaaaccacatgctgggaaaattcattcacaatacacaaatacagtaaaagccttgtatacagaaacacaatgacccgttttccttgaaaaggaatccttgtactagtcatactattgtctttgcgtctgcttctcagaagatctaaatgaatacattcttcttctatttcttatcacatatattattctcagaagatccacccatttctgttattattcagaggtgccatccaaacataataacaaaatgttttacctactgaattcagtgctatttgctgtatcattccaatgttccccccgacagtttctcatctgcctgttttactttttgaaacattgggatccaggcttcaggttgatgtatctaaagtacatatacacatgcacggaaagtccaagataaaagaaatattatcaataggaaatgaaaattccaaacctttaatattaggtaattccatataagcctttataataaaatatttatctcattgttttccaaaataatttttatttacattattttttacatttcagtacatggtaaagtttagaagatttgatatttgagaaagggtaaacagtctttagctcctgcatattaataatttatttaaccactgacactaaatatgatgtgccaaataagaaaacaattagcaataatattaacattcccactgttttctcatggttaaaaataaaaagttgtgctttatttctaatttgtgatggaaaggtatgtccatgacttcacatatgattgtacctgcataacacatttggctggcacggcaagtgggagctgaaatcctttttttcaccatgtttcactatgtcaaatttaacttttgacaatttaattggaagaaatccatgtactttcttaaatatgtcttgaatattcagggaacattatttgtaatagagcagagttggaaacatttgtctatcagtacaatatttctgcaatcaattacagtatactcacatgatggaaaacaatgtacctgataaaagtaaacaagatagatgtataatataccacggtagaaacataacttcgatagggtctttcttctaaaacattgtaatatcatatatattacatatcattttataaacatagattatttttatatgtagatgcatataacaacctagaaggatatatggaaatctcttttttaatcttttactttaggtttggtgggtacatgtggaggcttgttacataggtaaacacgtgtcacaggggtttgctgtaaatatttgatttcatcacccaggtattaaacccagtgcccaatagttatcttttctattcttctccctcttccaaacttctgtcctcgagaagaacccagtgtctgttgtttccttccttgtgttcataagttcttatcattaggctcccatttctaagtaggaacatgtggtatttggttttctgttcttgtgttagtttgctaaggatgatgacctccacctagtccatgttcctgcaaaagacatgatcttgttctttttcaatggctgcattatatttcatggtgtatatttagcacattttctttatccaatttgtcattgatgggaatttaggttgatttcatatctttgctatcatgaatagtgctacaatgaacatcacgtgcatgtgtctttatggtagaatgatttatatacctctgggtatatacctggtaatgggattgctgggtcgaatggcagttctgttttttagctctttgaggaatcatcatgctgctttccacaatggttgaactagtttacacccaccaacagtgtataagtgtttccttttcttcacaacctcatcagcatctgttattttatttactttttcattgtagccattctgactggcgtgaggtggtatctcattgtggttttgatttgcagttctctaatgatcagtgatagtgacttttttttttcatatgctcgttggctgcatgaatgtcttcatttgaggagtgtctgttcatgtcctttgcccactttttaatggagtcgtttgtttttctctcataaattttaagtttcttatagatactgggtattagaccttcatcagatgcatagtttgcaaatattttctcccattctgtaggttgtctgtttactctgttgatagtttcttttgctgcagaaacgctcttaagtttaattagatcccacttgtcaattttttcttttcttgcaattgcttttagtgtctttgttgtgaaatatatgcccattcctatatccaagatggcattgcctaggttgttgtttaggtgtttatagttttggattttacatttaagtctttaatccatcttgagttgatttttgtgtatggtgtaaggaaggggtccagcttcaatcttttccatatggctagccagttatcccagcaccatttattgaagagggagccttcctcattgcttgttttgtcatctttgtgaaagatcagatggtcgtagatgtgtgggcttacttctgatatctctattctgttccattggtctatgtgcctgtttgtgtaccattaccatgctgttttcattcctttagccttgtagtatagtttaaagttgggcaacgtgaggcctccagccttattctttttgtttaggattgccttggctatgcgggctcattttggttccgtatgaattttaaaatacttttttctggttctgtgaataataatcttggtaatttgacagcatagcattgaatttgtaaattgctttgggctgtatagccatattaatgatattgattcttcctatccatgagcatgggaggttttttaatttgtttgtgtcttctctgatttccttgagcagtgttttgtaattctcattgtagagatctttcaccatcctggttagctgtattcctcagtattttcttctttttgtggcaattgtgagtgggattgcccttctgatttgcctgtctgcttagctgttgttggtacccagaaatgctaataatttttgtgcattgattatgtatcttacaactttgctgaagttgtttatctgctggaagtgcttttggtctgagactatgtgcttttctagatatagaatcatgtcacctgcaaacagagatagtttgacttcttgtcttcctatttggatgtgctttatttctttctcttgcctgattgctctggctaggacttccaatcctatgtggaatacaaatattgagagagggcatccttgtcttgtgtcagttttcaaggggaatgcttccagcttttgcccattcagtataatgttggctgtggttttgtcatagatagctcttattattttgaggtatgttccttcaatacctagtttattgagagtttttaacatgaagtggtgttaaattttattgaaagccttttatgcaataatttagataatcatgtgttttgttttttgtctttaattttgtttatgtgatgaatcacatgtattgacttatctatgttgaaataaccttgcatcccgggcatgaaacctacttgatcatggtagattcgctttttgatgtgctgctggtctcagttttgtattagtcaggattctctagagggacagaactgaataggatgtatgtatatttgaaagggagtttattaaggataattgactcacatgatcacaaggtgaagtcccatgataggccatctgcaagtagaggagcaaggaagccagtagtggctcagtccaagtcccaaaaactcagaagtagggaagccaacagtgcagtcttcagtctgtggccaaaggtccaagagccccttgcaaaccactggtataagtccaagagtcccaaaaccaaagaacttggggtctgatgttcaagggtaggaagcatccgtcatgggagaaagatgaaggccagaagactcagcaagtcagcttcttccaccgtcttctgcctgctttttctagttgcactgtcagccaattggatggttcccacccacaatgtgggtacgtcttcctctcccagtccactgactcgaatattaatctcttctggtaacactcagaaacacccagaaacaatacttcgcatccttcaatgatcaagttgacacttcatgttaagtttatcacaaatttgcaagtatttttgctgaggatttttgcatcatagttcatcaatgatattggcctgaagttttcttttttgtgtgtgtttctgccaggttttggtatcaagatgctggcctcatagaatgagttggggaggagttctccctcctcaatattttggaatagtttctgtggaatggtaccggctcttctttgtacacctggtggaattcggctgtgaatctaccaggtcctgggctttttttttttggttggcaggctatttattactgattcaattttggagctcattattggtctgtttggggaatcattattcctggctcagtcttgggaggctgtatgtgttcagcaatgtatccatctcttctaggttttctagtttgtgttcacggaagtgatcccagtagtttctgatggttgtttttatttctgtgagatcagtagtaacattccctttgtcatttctcatcatatttatttggttgttctctctttccattagtctagctagtagcaaacattatgaaaatgaatttagacaagatactaactttcaatgtgaatacttctatatattcaaagttttaaacaaatatgagtttacttataatcaaatatatgttttgtaaattgctgtgtggaaatcagaggctgctcatttctcattcaaactaacttaaagatactatgttaaatgttctacaatcataactttaaagttgttttctctaagagtttgaaaaagaaccagtatttttgaggttgtgtcaatagagtcatgattaataacaagcataataaaaatttttattaaaaataagcaattaaatattcttcttttactatattaatgctcctgagaattataactttctaaacaatttaaatgaaacatgagcttttaagcttatagtaggtgctcaaatgtttaggaaaaatgaatgccaaaaatagctatattgtttattcagtggaaggaaaaaagactaaacataatttttacacattgtctgtttatacattactttgctaaaaacttacaaatagatggactcatttattttagagatctgtgtgtgaaatgtattgaaatggattataacatttcccaatgggacacatctaccagcaaagcatttcaggagtgattttatgtatatgtgacgaattaggcaacttatgcttgaaaatatcagaaatattaaacaggcacatctaggggcatttaattcttaccaattttgttttttcctgtctcttaagaaataagagcagggtgtggtggctcacgcctgtaatcctagcactttgggaggccgaggcgggcaggtcacctgaggtcaggagttcaagaccagcctggctaaaatgatgaaaccccatctctactaaaatacaaaaataaggcgatcctaatggcaggtgcctgtaatcccagcgactcaggaggctgagataggagaattgctcaaacccgggagatggcggttgcagtgagcctagattgtgccactgtactccagcctgggtgactgagcaaggctccgtctaaaaaaaaataaataaataaattaaataaataaattaaaaaatgatatagctacatgagctcagtcatcaatgataggctagaaagagtaaattacaaataacaaaaattactatatttaacaattattgtaaactttgacatccatcttcttataatatttgcaataaaatatattttcaatgagatagtgacatggatgtatttttggttataaatcatatgatttattatttcaaaaaaactatccttaatcattaacagtaatgtctttacattgagaaactatgcaaatctcagaatatttgtctcctaacatgttttatgagcataacaaattcaaaaaacacagaactataactcttttgttttacaacttgatacatcacatattgctattctccaaagatttccttcctaattatgttttcttctacataatattaaagttcattgacattctcataatacacaacaggatgtctgcatgaaaattgcctgcaagcaatgttggctgatgggagaatgctagcttatattaaaaggtaactattatggttttatcaatagaaagaaaaagagttaattacattggtacttatctctttcccttttgggccagttaaattattgaattttttttttttttttttttttttggtaaattgaattcttcatgggaaggtacgtcatccacctgtatgaaaacagatatcacaagaaaaaagtatatatagaccaccccccaaaaaacaaacttaataaaactatgtatttcaaatagaattatttttttctggttgaaaaagaaagttggaaacaaaatctgtgacaaaacccaggctttgcctgtactttaacgtaaaccaatgctgcactttatgcttactattttgttgtcttgtaaggagaatttctagagggtggttgggttccatgcaacttaattgtaagtgtcagctgaaagacctacaaagacattgtcagttattgagtttcttatcaagccaataatgtggtacggctgttgtactaataatgaagttttaattagttctcaaaaatactgagagcttatttaaggcctccaaattggatagtgcatgcttagcttgaaggcatcaatgcatcccaaacatatcaaaataactgtcaaacacattgtatacacattaggagataatagctagaaggcttaacatctatcttagaaatactgtatgcacaaattgttcaaggaagttctttctacacttaaatgattgtcttcagaatattgtattttataatttaagcaaattgtcatgcaaatggttcagtgttatctgtttatctgagggtcagtatagttgagaaaattcattttagccaatgtttatcgttattccaaatgggagcattctctattcataactatcccaacatagcacctgcatttttacttataaatacttattgcttgtttccaatattttactgcatgagaaattgtgccagatccctcttccctaatccatgggtagttcaaagatactaacatttaagaaacagttgatttaaacttctaccattggagaattgttgatgtcttttcaatgcattgggtggatttagaccactgcattcttatatgcctgtctattaatgctatacaagatgtctggtttaaactaacattactggaagtaaccctttctaccccatcccatctccacccacacgtctacaaaaagaattttatgcaagacagattttgaagcacatagaggaggagctaacatgagttgctgctagaaaaataatagctgtgttatttgtactgacagtttgtatttcttctcaaatcatttattttcacaaaattggtctggctcttattttttcaaaggacgtaagctacttcattgttgttgttatggatttctgatataatgacattaattacttgctgtgtgccagggacttttttaggcttagagggtgaaagtgtagaactggaagtgcatgcgattcagaggctgcacagtgaccctctgtgggtaagaagtgggctcctagagtatttgaattatgaatgcaagtgggtcaagggaatgaggaatggggtgtatgagaagaataataagcatggagaataggacatatggcttgtttcggggaactacaagatgtttcctatttctgtatcacaattacatgaggataaagggagaggcccaaggatataatgattacaatttgagggggaagtgtttactacattcagagagcctgggtcatattctgttagtacatcatgtttttcgtcaaattttgagtgactattatgtggaggtggaggatcttcttttgatattgatttaaaaatattatttacaaagatattatatattttcttccaagaaaatatagcttatattatacctacaagagttcatgatttgtagggggcaccaaattaagtcggaaatgctaaaatgtcacacatttcaggagaaataaatcagaaagaggtgggtttattggtgaaggatcaatttgatgcatcaaaaagagggttactcttaaattctcgggagaagtgaactcaggaagaaggaaatatcaagtctgacgttaaaatctgatgccaggaaataggaacttgtatataaaagatcctgaatatagctgatgtttaggaaaagtttattaaagtgaattcacctaggatagaaaacaatatggtataattagtagttaaaatgaggatctattagaactttgtctagataaacaaaagaaattaattcatgtttattttttatttttattttattttatttttttgagatggagtcttgctctgtcaccaaggctggaagtgcaatggtgcaatcttggctcactgtaaccgctgtctccagggttcaagtgattctcctgcctcggcttcccgagtagctgggattacaggcacctgccatcatgcctggctaatttttgcatttttgtagagatggggtttcaccatgttggtcaggcttttcttgaactcctgacctcaggtgatccgcccaccgtggcctcccaaagtgctgggattacaggcgtgagccaccacacctggcctcatgtttctttttataacagaaaattgtaattgtgtgactgtgtaacaaaattgtaattgcagctatacttcagttcttcacttaaattgtttgtcaagttttgacatgattctttcaataaaattgtatgataacacgacttctcattctgcttctgtggcattatcacctgaaagtcatttctgcaaagaattatttcagagtcttatcagtttcccaattagcgcttttgtttattttatattcaaaccattttatttttaaaagcctattgtgcaatcattcttgccaatttctcttgatcagaataggtctaactgctttgcacatgttttgaactgttctacatcaacgtcattaactttggaaagacctccttcttttgtaaaatttgcaatttcattattcaatttacatttatttgcattataagtagcgaataactaagaatatattgacatgaaagacagacataggctgaaaggcaaagacaggctctagtgtaaaaaggcagaaaaggatgatttaatggcatctgagattgtaagtggcattttgttatacatattttcatgagaagctgaatttggttctctacacaaacttataactgaagggattcagataaataattctcctatatggagggcctctggaataaacaagattatatcttaggatctgactaaaatggcctcaatgttccccacagcttgattaaactttacacaagctgctgcttaaatctaggccctgacctcccttttcttagagcattccctttagaaaactagtaattgtaaatcctttctctgactctttgagatgtaaatcttttttgaaagtgctttgccagttttaaaacacgaaactgtctttctcaaaagacctggaagccagctcttcgaaatgtaaacatcaatgaagacagagcccctgtcttccagcttctgtgggatagcaggagcctacatttgaaggatgctttgctccaaggtgtaaaactacctcctaagaggcagtttgcttttggcgggggggcaaagccagttaggaaatactggtggcctaaaacccaggtcctttatgacctaattctagctttataaaaatttttcagcttggccaggtgtggtggctcatgcctatgatcccagcactttgggaggttacagcagaagggtcacttgaggccagtagttcaagaccagcctagacaacatagggagaccttatcttaaacacacacacacacatacacacacgcacacacacacacacacacatacacagcaaaaaaaaaaaaaaaaaaaaaaaaaaacaaaaaacaaaaaaacgagaagaagaacaaaaacatctttttgggggcaggagttgcagtacagctcactttgacttttggcttccctcctctcttacattaaactcctggcctgtttaactttgtttggcagattgttttggttttttgctttgacagatccaaataaaataattaaatcagtcaggactgagagatctagatgcatgttgactcttagggagttcatgggatcgtcaccaaatctattcttgcatcacctgaatcttcccaggttgaagatgagagcagacactgaaggtcatattcttgctgctggcttgtatttgctgccaagtcccccagggcatgttctttttccttctgtgaatcaggtcggatttcatataccattttgtgttatttattttggaatttttctcttaaaatagctcctccgtaaagaaagcatattgttcatatcattgtgattatgatttcagcaaaggagataaaactctataataaaataaatgtccttcctagaaaaatatttgagttgaataaaacttcagaatactgccaggaatattgtaactttcgtttgcctcaaaatgctattctgatccttcatctttcattattaatccattcaacaaccatttattaaacccttacatttgtgccagaaccttctagacatactgatttaaaacatgtattctcaagttgcaaaatcgccctccagatcaccctgggtcattggatcaacgatacaataatgtgtattgttgattatcaggtcaacaatgatccaatacacattattgggtcaaaattgttgacctaattcacattatatgtgtttttcactcaaaaagtctggaaggctcagaaaagactggaggaaatgcacattttttcctctgtcatacccatgcatattggttgttctagattagataattaagtagacttagtgcaaaaatcattttattttcatatttcactatttaggttattggtatatttgtaactttttacttttaactactgctttaagcgtttttcattgatgacattaagcatgtaagaaatgatcttaatggttattttgactatagatatcagtgtctttctcattatgtgctttgtataagaaaggacataaatatcaagcaagaaataacaaaagcattgcattcagaaacaagaacatacaagttaatgaaaagaaggtaaaacataattttttcgaccattaaaaacataggaaaggggccaggcatgatggcttttgcctgtaatctcagcactttgggaggctgagaggagaagatcatttgaggctaagagttcgaaatcagcctgggtaacatagtgagacccccccatctctataacaaaacttaaaattagcctagtgtggtgccatgtgcctgcagtcttatctgctggagtggctaaacctggaagatgggttgagcccacaaatttgaggatgcagtgagctatgattgccccactgcactccagccagggtaacagaacaagagcctgtctgtaaaatatatatatatataaaatatgtgtatatgtgtatataaataatatgtgtatactatatatgtgtgtgtatatgtatacatatatacatatgtgtgtatactatatatgtgtgtgtatgtatgtatgtgtgtatatatgtgtatatgtacatatacatatatgtatacatatatatggacttttaaacttttttagcagctctatggctttcagtgctatttggatatttactttgaatgaagcaagattatttgagaactgtttatatttcatgatgtcaccttccatgatagtttttctattataggagattctcagttcattacccgaccatgatgacaagtgaaaactatgaattattttcactaaatcaagtaatcgactttcataaaatacagttcattaatgtttcctcttcagcatattgttttaagatagtcctaagtcattttcagttctttaacataataaaatactcaatagaatacattaaaagaggattcagaacttgtattctttcattttaaaatgtctcctggaaacacaatttactttattttggtgtttattcatgggccaacgtcccctaattatgatagctgtatcttgaatactgttaatgcaaccacttcaatttgagtggtagatatcttctatttattcttctagatccactctccacattttttaccatagtatttggcaggctgctgacttctgtcagtgacattaattgacttcttgtccttgatcttcttcttccatttggccagtggcaaaccctgggaggagaggggaaggaagaaagtgatgatgtattatcttttttttttttctataatgctaacttcattttgctagtcacttaggaatatttttttacagctgaattgctgagtaagactctacattttccctttcccacaagtactcttgagtttttttttttaataagattataccagccctatgtttatgttagaaaagatgacctaaggtaggagttagaaaaccatatctttttaatatcataaagcagacgctgtcattctcttttgaaaaaattatttcactagtttaacttcactctctgaatgaagccctaactcttttaattgccaggaggcccttcataaattgacagcgcctgtttctctgaccccatttctgtggacctcccctgccctcactccactctaagtacatcagctttctcgctgcttctcaaaaaagatgagcttttccttgcctcctgacctttgcaactgtttgccttacctgccgatcttcttacgctttcttccaccctctccactccccattgaaatgtccaactcaaagcagctctgaccactttcaagaactcctagtatctctctaaccccttattttgttttactttgctataatggacacttaccttttgcgaactttatttgctcatttgtttaatgcctttcttcaacaaaatatcagttgtgagggaaaggactgtctgggttgctttcaatcacattttcaaaccaagaaacactccaggcttgtagtaactgctccataagtatgtgtggaatgaaatataatggaaagcagatgccttcataggttgactgaggcagtgtctgtgctgccatttcattgccctgtggcaggcatcattttcccatcactgcatacttgatttgatttactcttctgactattaattctagttactattatcaatagatgttggcatagatgataaacttcctttccactctttctacatttaaaaccattctggattttttaaaattagaattaaatgcatccagttatataagatattcccaacttttatatatcatgttagtaaacatgttttaaaattattttaatgttacatttgataagctgtcaagaggcagtgttgaacaactttatattgttctcttttctattaattatccttcattttctacaagatttaaataaaatatataatattaaattagcatttactatgttacagacactcttatgagtgttttacaggaattagttcatttaagtctcataacactccatgaagtcagtactctcacttccaagatatgggaattaaggcacaagtaatttgtctgacaaatgcctgggtccagaacctggcagggactgtggagctgagagccttctcccaaaatgagaacagcttgtttctacatcttagctcatgagctcacggtcagtgctcagtgaatgttatttttctttataataataaagaaaataaagattgtattagtctgttttcacactgctgataaagacatactggagactgggtaatttataaagaaaaagaagtttaatgggctcacagttccacgtggctggggaggcctcactatcatggctgaaggcaaaaggcacatcttacatggtggcagacaagacagaacaagagccaagtgaaaggggtttcccttttaaaaccatcagatctcgtaagacttattcactaccatgagaacagtatgtgggataccactcccatgattcaattatttcccacctggtccctcccacaacacatgggaattatggcagctaaaatttcaagatgagatttgggtggggacacagccaaatatatcacagataataatgaaaagtttatgtcctccacaaattcacatgttgaaagcctaatacctattgctatggtatttggaaacaggagcctatggtgattaggtcctgaagttggagccttcgtgatgggattagagcccttatagaaagaaattcataaaagctcctttatgctctctctttctgccattcgaagaacaccaagaaggtagccacctgtaagccaggaaaagggccctcactaggaacctgaccatgctggcaccatgtcggcaccatgtcttagaattccagctttcagaactgtgagaaataaatgtttgtttaagccaaacataaatacaattaaataaaacttaaaattaagtaaataaagatcttacctgagtagaaaattctacacaacagtggagttgaaatatgaacccagaggccacagatgggagctttttattacttcattatgttttccctctttatcatcccaactaaaccatttaaggagtatattttctaatactttgatgacaattaggtgtgcaagtacaaaactctgctgtgctgtgcttggttttcccatttatatattagtagaaggagaaaaacattttgtcatctctttggaaactcaaacttacagagggctgaatatttgttttattatcttttaatctgttgtctacaaaatctcaggggatgaaatattatcctcattagattcacaaggacttactaacttcagaaatgtcttcagagatgtgtttgcagaattgtggctttgtgtttgcataataaaccagcagcatttaaatgacattcctaaatctgttgaagctataatgtgagcaaaattaatatctgagagatgtttataaggaattatttttgttaccagccaagtaattattggcattgagtagattccaggaaagtcttttaaaaatccttccagaattttgagccaagtctgcattctttgcactgccatccaatagaaccctatcacatggaacaattctaattccacacacgttactctagatcttaggtattttaacctacaggaaaagccaataaaactgtattggttttctcaagaataaactgaataatctcaaatatgtaaaccaaatttttcatgttttatttgtaaaagcaggttatagaattggatgatctctaatttttcttagagctttaaaattgtgggatttattaggatatggcaaatattttcatcaaatacagtatcttatggaaacccagacatcataagaagtcctacttacaaaatcatcttaaggccctgcctgatttttagcccagtctttaattattcatgtgtgttccatttatttatttattttgggtgaggaggtgggggtcaagaccctggattgggatgaaacttcaaatgctactattggttatgttttgctaaaaatggatgttttctgaaaacatgaaaaatttatgattttttgacacaataaatggaaaatatggatatttcaaaaactaagggaaaaaatagcaaaaaatatatacaagttttacccccaagagttatgatctctgtcacttgtgcttggtgaactgatccctataattttttttttttttttttttacaaaatataaaaacacattatcttcttttattatttttctaccttttattttagagtcaggggatacatatgcagctttgctacaaaggtatattgcatggtgctgaggtttgaagcacaaatatattcgtcgtctagatagtgaccatagtacccaacagttagtttttcaactcttgcctcctccttctctccttcctctgctggtctctagtgtctgttgttgccatctttgtgtccatttgtacccaatgtttagctcccacttataagtgaagatacgcagtatttggttttctgttcccgcattaattagcttaggataatggcttccagctacatccatgttgctacaaaggacacggtttctttcttatggctatatagtattttagtggtgtatataaaccatatttccttcattcaacccacctttgataggcacgtgggttgattccatgtctttgctatggtgaatagtgctgtaatgaacatatgaatgcatgtatctttttggcagaatgatttattttcttttgggaatatacccagtgataaggtttggctgtgtccccacctaaaatctcatcttgaattgtaatccaaattataatccccatgtgttaggggagggacttcatgggaggtgattagatcatggttccgccatgctgttctcatcgtagtgagtgagttctcacgacatctgatggttttataaaggcctttcccccctcttcaccctgcatttctctctcctgccaccatgtgaaggatgtgtttgcttccccttctgccatgattgtgagtttcctgaggcctccccagccatgcagaactgtaagtcaattaaacctctttcctaagttacccagtcttgggcagttctttatagcagtgtgagaacagactaatatactcagtaatgggattgctgagctgaatggtaggtcagctcctagtgctgtacaaaaataagtagcatttctgtacacaaataatgttcaggctgagaaccaaatcaagaatgcgataccttttacaatagctacaaaaagaagaaaatatctaggaatacaactaagcaaagagctgaagaatctccacaaggagaaccataaaacactgctgaaagaaatcagagatgatgcaaataaatggaaaaatattccatgttcatggattgaatcaatattgttaaaatgaccacactgcccaaagcaatttacagattcaaacctattctgatcaaactacaaatgtcactttttgcagaataggttatgtactttttaactatttggtgtgttacataggtaccgtaactgtaaatttgttttatgtagttgtttatatagttctaaataactaatggacttgaattattttagccatggatatgcatttgtacattgtatttttcaaaatttttatttatttcaaaactgaaatacagcatattattctttacaatgttatttcacaatattccctataaaggtgtttccaataatttcagagataacttttaaaattatatttaagctcctggcacatacttctgataattgcattgcctttctcttttctttagttgctagtagtaattctcaaaaaatacgtttttttctatgtgttcaaatttgcagttattgaggttttaaagggaagatttacacatgtgtgtgcacatgcatatttaaaagaaaacagtttttattttcattggaatattctcataagaaccaaataaactttagcttagaaatttaggacaacgaagagaagattttgcgagaactcagcaaatttaagtgtttctgtctctgctccattcctttcaaatgcataagtacatacagccaatacacacacattatcatttgtgaaatgccatcttgttaggttataataaatgtactaaagagttaagaacatcaggacagaatgtttaaaaataatggctctaaacaattgatcaaaacactattttagtataaaaaattagtttctccaatttctccaaaatcatcttatagattatttagaataatttcaagctgtttttttaacatcaaagagaatgttaatgtaagttgttccactttctgctaatatataaaataatcatattatgtttgaagtgtcatttattagtttttttggaagaagccatagtttatgacctatcttggttactattgatgttcaatgaattttaagcatgtaaatagggcattttcaatagaaaagttcatctgatttctaactattattttaccagtaacaaactccgtaatataattgtccctgggtatatgcaggggatgggttccaggaccgtctgcctataccaaaacccaaatattcaagacctgcagttagctctgtgaaatccaggtatatgaaaagttggtgctcctgatatgtgggttttggatccagaaaatactgtatttttgatccccacgtttggttgaaaaaaatttgcatataagtggacctgcacagttcaaatttgtgtgtgaggttcaactgtgcttcttttcttgcatattatttatttgcaggtacattgcagctaaaattggaggaagaataaatttgacaggtagcaatggaatagtggaaagagtggtccctattttggctgttactactatacagctccttctcttcttgggcatctcgaaacctcccagtgccatcttaagaactgagtgagatgtttcctactcagtatgtattgagtatcagctatgggttagatgctgttctaagcatggagagtacaatgttccttgaggtagatgaggtcccatacatatgggatttacattcaggtgatgaataggacattgcactacaggatggggctggagggcccactggagcataagtagagtgcaacagaagacttcgaggagaaagcccatgtctaactggggccaaaatgctgatgagcaggaattagtcaagcaaaattagtcaaggaagggaggggaagtagagagtaaattactttgtaaatgataggctgctactcaaaataaaaagtacaataattattatcattctaaaaacttgtagacaaaattataatttgcttttctagctcccttaaaaatttttacagctctcaatgtcatatatgcctttaaaggtaagtctctacaagcctaatcactgcatttgataagttcaagagtttataatcaatggtggtctaatgaaattttttaaatgcatgtgtatctcccagacccccaaactaaaaatttcatggaaaaatatgtttacatgttagatgagttatgttaactacttatgtttagccaactagttgtgtggtttcttggaaaactattttcagaggacatagaaacaatgtaaataaaatgaaattataatttgcttccgaaatgttaagttactcttaacgtctttggatatttacattgttgattccaataaaataaaaaacctgcagcttacatcaaataaatcttttattttttgcataagaaaatttttaaaaaatgaattattaacaagttagtggcaagaaacgagaataccagggatccagtagtctaatgtaaataataatataggggaatgtcacatgggtaattaactttgaggcatttcctgggatttaaacagtgttaggaaatttggcaaaacaagctcttatatagctgatgtaaaaatgcacacacgttggcattgtttgaattctgccacttcctctagtttgtccttaaaaaagcaagagcaatacatgataattatagttaatataaatggatatctttaattatttaagattttaatcttacagagaaagtttcagcaattatttttattgtcttcagaacttctttttgcaaggaaagcaattagttggacatggattgaaacgagccaataagaaaacttaagtgattctatttgtcatgttttcaattaccgtattgtcttggagtgtgctctgccagtattttaacaactgacttatcacttgaagtcaaagattcttttcagcatgaattgtaaactaagcatttcaataatatgtgagtgtattttgcacaggatagaacttgtcgtgtttcattatgctctttaactctgaatatatgtaagtcggtgtgtgtgtgtgtgtgtgtgtgtgtgtgtgtgtgtgtgtgtgtgtatgtgctttccctttacatttttaagatttcaagaatagactaattctagtacaaattactctaaaacgattccttgtaaagttaacccaattgtttctctggctgcttttataaaaatttgaaggtttattcacccctcaaccctgcaatcaaaactgattttaaaagagcatctgaagcctagagctggaggaatgttttttcatgtgttttattttggtaattactttcttaatttgtcaggatttttctgactctaaggttttcccttatgctatcaattttttgttcagttttcttaaaaaaaaaaaagaaagaaatatctttataccaagatagcaccaatctcactttcaaagctgccaaaatttgccctcctacattcttttattgtttttaatgtttaattctaaaacagacaaagaaaaaaattgcagcactataattctttttggtagatatctccaatgattcacatttgtgccctggtatattcaataagactactaatctttgcctcacagatccatggaaagaataacatgggaggctattgggactgcctggactgtatgtttttttctgtttcttaatctaatattctaccaatctctctttaaaaatgttaattgatgatcacatctttttctttttaggcatttcaaattttgtaacattagtattctgtatgcttagtgtgccaagtaggaatctgcttaaaatcatcaggaaattttcataccaacgtgttcctcagtaccaaaattgtacaatcatcacatggaataagtttatctagtatagcctcctatgtcatgagtgaattctctttatgcgtgaacacgaaatggatttttctgtatttgcttgactaacacaagtgttataaactcatcattttcaagcaactcttcttgctggaaaacttttgctaaattcctgtaatttgccagtgagtgacgtctgccctgctgctcagtggatcataggaaatagacctaatatttctgccatgtaaaaacccttaactcctttatggtgtgtctgtatcccctcatgcttctctccattccccagtctccttatttactcttctatccatcagactaagtattcataaaaatcttcatttttttctatctcagatatctagatatctacatagtttttttgtttgtttgtttgtttgcgacagtggagttttgctcttgtggcccaggctggagtacaatggcgcgatcttggctcactgcaaactcgcctccccagttcagacaattctcctgcctcagcctcccgagtagctgggattacgggcgcccaccaccacacccaactgattctgttttatgttttgttttgttttgtttttttgtatttttaatagagacaggtttctccatgttggccaggctggtctccaactcctgtaatcctagcactttgggaggccgaggcagcggatcacctgatgtcataagtacatggtttttatttatctcatttaattgtaattattttacattaatatcctgcagcctgaccttcattattaataagtatgagtaaagccattgaatcagtttttctttcacattaccatttatttttctgtattttttttctaaaatttctttcagtaagaaattttgttgaaatccaggcatacggtctatattcccctgtattttctctaattgccttgtcaaaacaaacaaaagaattaagttgagtctggccttaataaactcaggctggcttcctgatatgctttttttctaaggtgttaatgcaaatttagcattttattctagatgagattgtattcacagatgtacacttcacaggtcatttccttgaccaccctagcatttcttgtataacctacaattagtcaaaaagaatttatctaagttcttttcttatgttagggtgtccacttttagtcttagagatataaactgacttagggttgttctgtatatgtttatgttatctttgataaccttgatttttagctctgactaccaagtatttaagtccaaaatttatttacttagaaaatctagccaatgaattaatctatcatccattgacattagatcattagcctcaaggaccaggtttttgtgtttttttccctcttcttactcaaacagagttccaaatctttgaaaattatataatatttctttaaacaatgttatttacaacatggtatcattttatttaaccttcattaaatatactttggttttattttgggcagaacctgatgatatctgaatagtagaactcgtgtggaaattttctcaattttataacgtttctatttttttctctccagaatattttatacatatatggctaacaaattaattttaccttactttctatcacttgttaattaactttcatttaccttttattgatatattggtaacaattgtattttactctatcatttcatatgtaaggtaacttccacatcatgtgtttttccttatcaaaaatttaaatttaactatattctaatgctttcctttttagttatcattaaattgaaataatcaagaccaccatttcctaggacctttttcacttctattctgcctacccatttttttttcatcttgataagaatttggtccagattatatagtatatacatacactgaaatattattcagctttaaaaaacaaggaaatcctgtcacttgagacaacatagatgatctggaggacattatgttcagtaaaataaaccagacacagaaagacaaacactatatgatgttacctacatgtgggttaaaaatagtaaaactcacagagagtagaagagtggttgccaggggataaggggaaggggaaatggggatatgatggtcaaagggggcaacatctcagttatgcaaggtaaataagtcctggagagctagtatcaagcacagtgcctatagctaatgatactacgttgcatattacaatttcctaagtagatagttcttaaccacagagacacacagatacacacatgcacacacagaaaataatagagtgggaggaaacattgggaactgatagatatgtttattgccttgatggtgatgatggtttcaccagcacacttatccctaaactcattgcattgtttacattaaatgtgtacagctttttctatattaattatacctcaataaagcagtttttaaaaaagttttaattagttgctttttctgtttttcaaaaaatgttataagtatagctttcttatatatatttagatatttcttcctagggtcattgaatctaaaatatgtgtaaatcttctttgatacagagaaactccagaaatatggtagaatacagcaatagacttcaggacggaggccaagtgtaaatttaaactctactgtttattaaatttgtggtcttgggtaagtctccttaactctcagatgcaagtcattcatctgtaaacagtgagattcatagacgtgtcttcccaatactaagctgtattgtgatatgacttaaacctctatattaaaaatgagctgtaatttgctttaatttactattttattctgcatggtcttcttattttaaataaaatgtacatttccattattgttttttagttgaatcgaaaccactgaatcttgatcatatctaaaattttacttttacatcttcttgttaaaattacaataccttgttcttcatcacttattcctagtgtatagactacggagaacacagaaagttttctgaagctccttcctattatattatcatataaattaccaggcatgtctgtcttgatcatactttcttcatcaatccccatgtctttcttggtatcctgttttataattttatctaggacttttttctcactccgattctaatttagatttgagtattattgatgagattggaaattctccaggcaggcattttctttctcgtcctcattaggagctctcaggtgccctagccaagcgtctatcacttgggtatattcatggtacagaaagccaaatcacattatgtgctgccagccagcaactgagacagagatccaagctccacagcatcccttatcttccaaatttccaactttcattggaagcaaagatgaaaatgccacctgtgtcccaaggtccttcatatttaaaaagtgggaaaatgtattaaagatatgccctgattttgtcttctaccacgacacactcataggctatcttcagatctcgacagtattttatgtagaatgttattttatttcactctcttcaaagtagtcagttgaagctggtatcgctgtcctgaccacaagtgagaaaataagcagagttgtgaagtgctttgcccaaggacccacagatttttaaaagtagaccagatggagaatccagatcaggtttcagccttcatttccagccagcttttcaacatagacatggcaccactttttaaaattttcctgtcagctactgattatattgtgtatttcaaccagagatgccatgttttgaaatatttgtctatcaaacaaaccacatctgttgagttataatttattttccacttttgctaatcaagcatgtatagcttctcatcatcatttttgatgatcatgagctaaaaaacaagttattaaaaataagttaaataaacctaatcaaaataaatgtatcttggtatttacatcagtcattatacaagtaaatgcaaattttctttaggcttttaaacattttgaaaatgacaatggctttgtttccaacatgagtgaaccagtttaactgtggtttacatcagcctgtgtaactatgatcatacatcattacttgatattagccctggaattaaaagacagattacccagcaatcccatttctgggtatatacccaaaggaaaataaatcattctaccaaaaagacacatgaactggtgtgcttatcacagcactatcacaatagcaaagatatggaatcaacccaggtgcccatcaatggtggattggataatgaaaatgtgatacatacatatatatctcatagaatactatgcagccacaaaaaataaacaaaattatgttccttgcagcaacatggatgcagctagaggccattatcctaagtgaattaatgctggaacagaaaactaaataccatacactatcatttatacgtgagagctaagcattgggtacacttcaacataaagaagggaataatagctagacactgtggactactaagtggaggagacaggaatgggttcaagcctaaaaaactacttattgggtactgtgatcactatctgggtgataggatcatttgtacccccaacttcagtgtcacacaatatacccatgcaacacatctgcacgtatacccccgaatgtaaaagttgaaattatgaaaattaaataaaaataaaagacaaatttgcacgatgttttacccagtatgttagctgaaaatatgtaatgttttaggtgaaaaaagtcagaagttatgcaaaagataaattacacagaaattacaggcatacatgaaatatcagctctgtgtatttttttggcagtcccaagtacctgaatgaatatgaacagtttttgttcttattttctggtgaatgattttttacaataatatgacattatgaaggatcttctaacatgaacataacaacagcaaaaatgggcaaatgtctcaaggttgttaatgacaaatacgtggtggtaatcaatcagtgtcagctcccactgtcaccagctggcatagcaggcctcgtcaacacagcactctaagaaactacaatttacctatgaagttggcacaagaaatggtatccatttttttattcttgttataacttttgtatttctgacaatgtttgtgatatcattttacatgaacctcatacacattctactactcattggcacctcttcccacctattaatgttttggccaacataaaattactggttatctattgctgtatcatgaaccactgaaaaacttagtagctttaaacaacagcagcaatatttattttactcatgaatttacaacttgggtagagttggtggcagcagttcatttgtgctttgtgtgccatcagctgaaatggctcagcttagattgaaggaacttcttccaagacggcccactcaatggctggcaagttgatgctgttatcagctgagagctcatctggggccttactttctcctcatgtgggcatttccataggttactgagactttgacagcacagtgcctgatcccaagtatgaattttccatgacacaggaagtgaatgcagccaatcttttaggtccagagccaagaaactggtaacctgtcacattccaatcattccattggttgaagcagccacaaagccagctcagttttaagaggcagagacagacttctcctctcaatgagaagagagccatagaatttgtagccatcttaatttattatgataatgttatttttatctcaagtcaagagataagagacaaggaagtataatcggttatggtgactgcctatctagtcttcaaatatttagccaacatgcatcaaatttcttgccctacaggaagccaagaattatatcttagctgggcgtggtggcacatgcctgtaatcccagctacttgggaggctgatgcatgagaatcacttgaacctgggaggcagaggttgcagtgaactgagactgcaccactgcactccagtctgggtgacagagtgagacactatctcaaagaaaaaaattatactatatcagttctttaatgatttattttttacattcaaatgattcaatgttactcaataagtgaatgtttgcaaaattattccagataggtataaacttctgatcgtaatcttcttgaggactccaacttgatatttaaatctctatatgcagagacaactcatgtttttgtaaacatatataaattcataggaaaagccatgataaataatagtgacagtaattggtaggaaaaaatatatattgtttgtaaagatgttttatacatatggacttttgtggtctgatatgcatacagttaacaaatgcatttattttatatctcttgcattgttatctatttctgtgtcagaagaaagaaggcattttgccccttttgttctttctacctaaaaccagtatataatgagctatttcattttttcctagtcacgatcaaagcataatttcagtttaattttgagttttaaattttatacctttgacagattccttctgaaaagaatttatcgtgctgaagagagttataaaatgcagtgattaaatatatataggtaaatagatattttaagataaatctatcatatatctctatatagagatcatttattacatatatacatatatgtatatatacatatgtgtgtgtatgtatatatgtgtgtgtgtatatatatacatacatatatatatatggagagagagagaaatattttgtttttccctcaggagggaaatgcattttctctcctggagcagaagcatgtacaggttaagaaaaagatattctaagtgggtagaatagatgactgactattcatctgttctagcttccggtcctgcaagaagtttggtgaatgatagctgaatatttgaagactggatagaaagctaccataatcagccatactgcctgtctctttaggatagtcttcaaggaatccagccatttttcctacccactgatgttgccaccttcagcaattatatgtgtgtctatgggttgaggaataatccactaagcgcacatcagttaacaaatgggtgactttagaggaagaagtttcaatagaagaagtaagaagatgtcaaagatgacatcctgcctcttgtggaagatgggtacaaaccgagctatgtaaaaacctaggagagtaatattctggctatcctttaagactatgttcttgaaatatttgttaattagttatttagagaagacagtggatactgcctatagaaactgtgaaaggaccactggttgctcactgcagaggtgtcgagccacctgttgtccttcacttataacacacctgccatttcctggccatttcctaccatacaccaagcaacttttggacaatttcttccaaatacttatactgtttactggaaagggcgtaaaggaaacaatatattctctgtctcctatgtttccaatgacatagtaatgccttagaaatatttcagtgttttaggaaattgtttcttaacccaggttagtatacagaataagggccaaattcctttatatgggaaacaatacccttcgaaatctgtggcttatatttccaaattaatcttttgctcctcttcatctggcactctttgcttcagcatttttaaaactctgtgtgttttttgttgttgttttgtttttcttgtttttgttttgttttggttttctcttgttttaactagttgttttcttatgcttcaatcttttgtacatgaattcctaagcttgaaatgctgctgcccctgtggttcgccatgaaaaataattcaatttaaagtgataactttaaacaatttccttgacctgtgtatctcttttgttgggtgcttttgccttttggtctgcatttttttattaacttgtacatacctctgtaagaacagatagtgtaaaatgttctttaatatttaatttacttttctaattctttgaagaaaactggtgtttcatgtaggttaactttacattcccatcagctaccatacaatcgatatccaataaatatgaatgaacagtgtttgctgatggccgaccttgactgaagaatatttaataattgagtggttgagaattctgaaaaactttttgaaaacactatggaaattgtcagcctcaatgctggccttcataagcaagtactctttgcttaggttactacattctcccaaccatttgaaactgctgtaagataattatttagcatttatattatgcatgggatcccatctacagggacagtttttccttcttgtactgcagtatttcttatgctataatgaaagaaaaaattattctaaacctgtacgtttagcttaagattaatgtgtctttatcttatctaggtgttttaatccccttccagccttctttccctcccttcctacatccttcccttccttccttccttttccttccttccttttttctttccttccttattcttacttccttccccttccttctttccttccttccttccttccctcccgccctccttccttcctccgtccttccctccctcccttcctttctctctctttctctctttcttttttcctatttccttgcattgcaaagccttccaaataaaactaaatttaatcatgaaattcacacaggatatacagttacaaataatggattaggatgtaattagctatatgtgtgtgagtacaataaaatctcataatcaaattatgtgtatctgtagttgtaaaaacataacattgaaacaccatataaattaatttagagccatttttgatatttttgttagtatgtaataattgttcatatttatggggtacatctatgggatataatcacgtggaaatacataaaagtattgctagcttactgatggctcttagacaattacatggcaccatggacacataacttctccgaaaaaggagtttctcttttgaaatgtgagatgcaatgggagaccctcaaatggtcatatctccaaagttaactcattatgtcattgtctcaaagtacctgaataaagctattttgagcttcagtccccgacggcataaattctcattttcacatgagtggttgcaactattcatatgtactaagatttactaaagtatctttctgtggaggattattataaaatattgcattttctcaactactggcaatctaagtacaccatacttaagaagtcaagtaagagttttggataatcgttttccttcctccagaaactttatttttcttttaaatttaaggtgatttattgggatatactattatctaaaatgtcaaatgcagacaaatttaaatctgagaaacaaaataagcttcagagtggtgggataggatgcagaatcacatgaatccagaatgattgatttaaatacccagcataacctcatcttagttttgctataaatacaacaattaaaacaggctcatttattatcacccccaacccattccaaacttgcatacacccttttaggcaatgcctgattcctggtcttgcaggaaagacttcctcttcaactcttttacttgggtgatgcctactaatccttattatctccactaggcagtctccctaattccccaaccacgtgtacatttttttttctgttccccgtagtatcttgtgaatatctacctctacatttaacagtttgcattataataactattttttaaatatttctcagtcactatactctgaactgttgagagctatactgtatgtctttataaatagaatcaatacaattttgttggctgatcaacaaaccaggcaatatcaaatattatgttggtgcaaaagcaattgcaaatttgccattatttttaatggcaaaacccacaattacttttgcaccgacctaatagaatagaaactaagcccaagcaaagtacaataagaaaatataagcttttgcttaaataattctgataattagtttattttcttctgttacaatataattttactttagtaagtaattttactttaataaaattataactagtaaaattataatgtttaggcaaatataaaatatttttaatgatgatttatttaacttattaattaatgagggaaattttaagataaccaaactgggctaaattgcaattaaggatttagataaagagtatttaatatataatgtaagggcaatattttgaaatttcatacaaaactgaatgatgtctgacagagaaaccgtatttctctgcatattgccctggacagaaattagtttcatattgaacacaagtaacctcattttatgagggcatctctcactagacaaaagtcaaaacgtcactcttactctctgccccacagaggtgtaacataatctagaaattggaaaatcaagcccatcattacactgagatactactcagtgtctattttacctgttttcaacttttacgtaacttgtctgacatttaagttgaggttctcgaattcaaatgccaacacatatcagaaggcagttgaagtgcaacaataaggtaggccatgtttgaacttggaggccagcatattctggtgctttaggaaaatcctgatatcagaattctagtgtaaagacttgtgattttaagatttggtcagtaatttaaaatattttaagactctaggccaaacaaagctctttatggttcgtggaggccaaaagccaccagctcgagacctacgttgtagaatccaacaggcaatccagcttccctacagaaactggattttatacactgatttcttgctcagtacgcagattttttttttttcttggcctttaggaaacacttctgctgtggaaaccttttgagagctaaacttttcccttacaaatttgtctctgccctttcttagtacacatcagtgatgatatttttctctagagcagtatcttaaaaagtcaatagcctaccacccactctgcagaatcaattgaccatagttaaatttttaagttagcctcattttttcaagactatcagagatatatttgtctaagtttaatgtgtttttttaaaaataattttgtgtttccttaggaattagataagaaaaattgttggagcatgcctcatttatccccctagaattttaattaaggaatgtttatatatatttttaatatctaaaaacaattcagtgaatgccgtttacaaatggtttgtgatatatacatttcactagcattccagaaatgtgttaaagcttctcttaatgattcctaaaataatcatagaataatatacatggacatcatagtatattattttgatcttttgaaaagataatggaaaaattgatatgcaaagttaactacaaacagtatataacttattgtcaattctgcaattatcttctggattttaatatataaatacacaataatttctgaagttttagaaatttacaaattaaaaaatagagatcacctgctgtgacagaattggccaggaaggtaaaattttaaaaatagttttattgttttcaattggtttcttagtgagcacaaaaatatggagcaaagacatcactcaggaaggatctaagctatatatgtattgattaggattctcaaaatacagaattttctgaacatttgctttccctagttaaatgagagtttcaaccactttattttaaattagttgtgcaactggtatttaaaaaaacaataataataataaaaaaaaaaactcttcttactgcctaaggaaatggcatctattgtgtgtgtgtgtgtatgaataatctaattgagtgtataaactaccacattataaccgcaagctgtattgaaaaataaatatcagctataagactatgttaacttttgtctttgtggtacctaatctccaaagatggcctcagtgacagagtcctcacagtcttcatgtttttgtgtggtttcttccgatactcaatttgtgacttgtttaaccgattgagtacatgcaatgaaaaaaaagacactttgactcttgcaggtgtagaccttaaaaggggccagccctctctactttttaacataatgtctgatctgccactttttttctcattaaaaaaaaaattgctatctctaccttcttcctcccattgcaaacgccactgaaagtgatttttgtcaaatttacctgtcatctccttgttttaaattcaatgaaaccatttaagtgcataaattattcaacctttgtgtggcactggaaactttcttttattcccagtttcttaaaatagcctctttagtttcttccagtttttgtctttgtccagttgttctcaccctgtttgtggattaccctcttccagagaatgttggtattctcatagatccactatctgctttctcttcttattccacacattctcaagtaattttatctaggcccatggctttaatctcatgttgctgacttcccaaattccatctccattacaatcccatttgcttagttccagaatttcttacccagttgccaacaagacaagtttattggacttttcttcggggtcctgaaaccagcatactcaaatcgcattcattcctgtcctcagcacattccaggtgagagccccgaaacctcttcttattctagaaatagaacatctagttgaataagccagaagccaagattcattcctggctcttctctctttcactttccctgcatgcattgaacctgtattttgtgccctttgttttaaatttcactttaacaattcagtttatttctacctaacaacttgtaataaaacaggttggtgtcatggcagagaatgcagaatagtcagtagttgagttctgctcaaaccaattccagatagataggctcacggaagaagaaccaggaaatccaagggataggacaggtcctcaaatttttctctgcctcagaattgtctcagtaatatgcattcaccaacatctggaggacccaaagttagctaaggagcagataatctcaaggaatctttgtcagaaccatcctccaaaacaagtgcttagcaaactgctctatgtgacagtgcattatgataagagcaagtggccctgtttatgggagcttttggatattaaccagtatctcatcccttaaagatagatgtccctataagtgattgttgaaggtggaaagttagaagtaagcaatagtttgagactattttaagtttaccctcaacgagctggaaatcagttatattttatttggtatttactcatttttcaccattatgtaattcaagctataatttcagtactacttgttgttaactacttgctatagacaagtagataagtaaaggcctaaacagtatctcaaaactaaaagaggagatttcctaagtatactgtcaggagcttcctggccatcgggatattttttagtgttgtcctgtagcatagtcaatcaccaaattctgtcagttctgtcatcacaacatctctagagtaaatgtaatacattattcatttttctgttttagtttaagccttattacgatccaactcaaattactcgaataattttctaaatagccttcctgcttctagtcctgaccatctgcaagtcaattcatttgaaagtttttcaagagggaaagcagtttacttaaccatgtctccactccacagcttcaccccatccccaactgttctaaaccttgctctgctctctaagataaaatctaaatgtatttgaatggctgatagggccttatccagtcaagccctggcctatcttgctagtcccatctcctgccactatttctattcccacttcatcatccactcctctcccactcccagtcccatacctcctgattcattctgcttaattcctgtgtttctccccagactccaatgaggcagtacctctgtcagctttctctgaacctcattaggagtctacagagttacctattcatattgctatccgagcgcagaatacttactgaatttcattacactcctatgctcacttggctctctcttctacctgcaccgagtctcttgggaatccagaccatcttattcattcactgcttagcataattcctgtccctagtggacacgtaataaatatcagttaaatattcaatgaacaaatgaatcctctgtcctcataatatactgctttattttatattctaagactatgcttcagaaaatatagaaatcaacaatgctattctgattaaagtagtaataataataataataataataataatgtttctttatctctggacctaagatgtcaacacaggtaaaacaaaagctattttttaagatattaaacttaggctaaaaaacagaaaaatccacttaatgcaaacagcagctacttatcaaaatataaataaaggaatattatggagaaaataattctctagtgtgcttaattcacccgagcctcaacagtttctgctgagtaaaagctataatgcccaatgaagttttacatttccatagaaaacaaaaattatttccagatgtttgctaagaataaaatatctgtatgtatgcataattggtatcaaaaagctagcaaaagcaattaaaatagctttctgtataatttctcagatattatgaatacatggatgaatacacagggaaagaattaaagagcattacactttgtcaatgttctaaataatggaacatgcaatatatgtcctagaaaatggaatttgacttaaacggcaaaataaaagccaaagaggatgaaataaacagaatcactttctaaaatttcatctctgttctagattccttatggaatttgcagtaggaaaaacttaaatatgcaatgagtatattaaaatccaaaggaaatatcagtacttacttggattggatatcaaaaactaaaagacaaagtcagttgtattagatggctggggaaatatcaggactctgaaaaaaattatttttgctaacaattgtattgtttattcttctacttttactaatgtgaactttgaaggagtatatttgttgctctttgagccctttacagtttttcttgcatatatgctcctttttttttttttttttttttttgagacggtctctggctctgtcacccaggctggagtgcagtggtgcgatctcggctcactgcaagctccgcctcccgggttcacgccattctcctgcctcagcctcccgcatagttgggactacaggcgcctgccacctcgcccggctaatttttctttttttttgtatttgtagtggagacggggtttcaccgtgttagccaggatggtgtcgatctcctaaactcgtgatccacccgtctcggcctcccaaagtgctgggattacaggcgtgagccaccgtgctcagccatatgctccattttttactttatcttcctcaggagcagtggctggcagtgagtgtaggggagattgtggctttcatcatatgctctcctgaactactcataatttctcacttttaatccctcttctgaatctaaagaatgcagtgcttttgaaatatactttgtttcttcatccatatttcaaagaagctatattacagtaacgtacatttcttctagtacttaaataactggaacttatatgacacttgggacaaaactggttcatactgaattttgctataataagaaaagagttatggcaagtttccaccacattgtaatcttatatgtagaaactgtataaagggtatgcaaaaacagtatgcagatgaaaattttcacaattcatatgcaggacaaccacctgtggctttcatcactttctcttcatttaagctaacttcccttgcaaacttccatttccactaatgccagagacagtttaaacgagccagtgaacgttaacctagtctcttctggttaactggagccctttcttgtaaatgttccgtctcatgagctgctcctcactttcttatccccaccaataaagtagctgagagcatgtggctgccattgcagcctcagggcagtgaggatgaaatctctgtttcccgagatgggccctcgatgacatggtttttccgacgtgtggtaaggtcatgaaacacatgcccagcaaatcacatgatgtcattgtctcctctctaaccacactgactcagtgactggtcagaactactcgagtagagcatgcagactgcctctggactaccagctgattttactggtcctcaaatgacatatctaccgatattgggagcaagagttggaacacatttttatcaacttcacgttggggcaacattcaagactgtgatctatgggcttgtaccattaaacagggtattgttcagttcaggtaatgccagactcacttctgtggattacacactggccatgcacagtgcgatcaaatatcggaccttgaggggttggataaaatcctgttttgtcaccagagatagcttgagaatcattttcttatgagatatacccattttcacagctgtaaacaccattactatgctgaaaactctctaatttataactctaccccagatctgtcttctgagctcccaactcagcaaattgcatactcaataatttcatttgcatgtaataagctccccaaacttaatatgttaaaaaccaaatttctgacccccactccaacaaaataaaacaaaatgaaactaaaacctgatccttctcagtctttccatcttagaaatgacaactttgttcttttattcatacaaaattagtgaattcatcaagaagatttttatcttttattaccaccctggtccagatctgacctctctctatcctcctgttgcaatctcctttagaaccttaggcaaaggaatcagcggatctcacagacctagagaggagaaaggtggtcaccagaggcctgcagagagagaggaaaggatgggcaaagagaagatattaatcaaaggttacaaagattcagctagactgggggaataggtttggctgatctcttgccccgcatagtgactgccattagtaataatgtatatctccaaattgttaaaagaatagattgttaacattttcaccccattaaaaaagataaattggtgaggtcatagaatatgttaatttgagtttttctctactatatatgtaaatcaaaacatcacattgtacaccgtaaatatacataattattatatgtcaatttaaaataaagttaaatttcttttaaaagtataaattagataacgttaattcaacactcacaacccttcattgctttccatgttacttattaaatagctcaggttctcaaaatagcccacaatatcttaatgatttcaccaataagcaagcttttcagccaccctgcctctaacttactcgtctccattcacactggcctcctggttgttactctagcatagcaagcacacctctgctcaggaaccttatatttgctgttgcttctccttggacctctatacacgtcaccttttcagatagaacatccctgaagaccctctatagaattgtggccccatacctgtactcggtccctgtaatctcgccacgaaatgtggcaggtttacataatactgtacccttagtgtctagaacaatgtcaggtatttattgagaagacattcaaactttgttgaatgagagaattcatctttgtttgtttgtttgtttgagacagagtcttgctctgtcacccaggctggagcacagtggcgcgatctcggctcactgcaagctgcgcctcccaggttcacgccattctcctgcctcagcctcctgagtagctgggactacaggcacccgccaccacgcctggctaattttttgtatttttagtagagacggggtttcactgtattagccaggatggtctcgatctcctgacctcgtgatccgcccacctcggcctcccaaagtgctgggattacaggcgtgagccaccgcgtccggccgagaattcatcttttgagcatggggctcagctcttgtcactgactgtgaatcgtattgtgctgctcacaaagttcaatggttttcttaatgtggaataattttatgtatgagcagatagaagggaaccaagagtaacatctcaagctcacctaccttgaaaagtccctttgtccttacaccttaccaccgcatactggatgtggcaatgaagtagaacaccagcctagtgttcctcaacctcagcactatgacatttggggacagataattccgtgtagtgggagattgtcctctgcattgttgcttagccgaatccttcccataggcctaacaggtgccagatactagtaacaatgcctacctccgcccctactcacgttgtgacaatcaaaaatgtctcctgaacttatcaaaagttccctggagtcgggagggggaaattgcctctggcctagaagatcttggatgcctccttagcctttgagggatgtgaggatttcatcaggagttttataatttggccttcacctaccacacctttctgcctgagactcagagaactgggaatctgtcctcttaggggctccggttttatccacattctcatcacctcacctttaatttccttgatacagaattctttctacattctcttcctatttggaaggacttcccctttcatcctcttacgagttggttccagcagaagtttggagtaaaattctttgatcagagttgcctgagtctggctcttgatttataaagaaagtgtatagaatttagaaaatattttgatcttccacagagactagctttccccaagtctttttcattcagagactcaaagaagtctaatgtgacagtcaaacaacttttctttgtagctgtcatttgccctccttctaaagcatgggacctcagtgggcaatgagtgataagccagtgggtgttactgtattagcagaatgaaacctataacaatttttaacttaatacaataaaatttggtttacgaaggaggagccaagatggccgaataggaacagctccgggtctacagctcccagcgtgagcgatgcagaagatgggtgatttctggaaatcatctgaggtaccgggttcatctcactagggagtgccagacagtgggcgcaggccagtgggtgcacgcaccacaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgagctttcagaccggcttaaaaaacggcgcaccacgggactatatcccacacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagccaggaagctggaactgggtggagcccaccacagctcaaggaggcctggctgcctctgtaggctccacctctgggggcagggcacagacaaacaaaaagacagcagtaacctctgcagacttaaatgtccctgtctgacagctttgaagagagcagtggttctcccagcacgcagctggagatctgaaaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaatagaaaggacatccacaccgaaaacccatctgtacatcaccatcatcaaagaccaaaagtagataaaaccacaaagatggggagaaaacagaacagaaaaactggaaactctaaaacgcagaacacctctcctcctccaaaggaacgcagctcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaaccggaagaaagggtatcagcgatggaagatgaaatgaatgaaatgaagcgagaagggaagtttagagaaaaaagaataaaaagaaatgagcaaagcctccaagaaatatgggactgtgaaaagaccaaatctacgtctgattggtgtacctgaaaatgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccgaagttgaaatgaaggaaaaaatgttaagggcagccagagagaaaggtcaggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaagcctgccctaaaagagctcctgaaggaagcgctaaacatggaaaggaacaaccggtaccagctgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctctaattaaaagacacagactggcaagttggataaagagtcaagacccatcagtgtgctgtcttcaggaaacccatctcacatgcagagacacacataggctcaaaataaaaggatggaggaagatctaccaagcaaatagaaaactaaaaaaggcaggggttgcaatcctagtctctgataaaacagactttaaaccaacaaagatcaaaagagacaaagaaggccattacataatggtaaagggattaattcaacaagaagagctaactatcctaaatatatatgcacccaatacaggagcacccagattcataaagcaagtcctgagtgacctacaaagagacttagactcccaaacattaataatgggagactttaacaccgcactgtcaacattagacagatcaacgagacagaaagtcaacaaggatacccaggaattgaactcagctctgcaccaagcggacctaatagacatctacagaactctccaccccaaatcaacagaatatacattcttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaaatcaatgaatccaggaactggttttttgaaaggatcaacaaaattgatagaccactagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggacacattcctcgacacatacactctcccaagactaaaccaggaagaagttgaatctctgaatagatcaataacaggagctgaaattgtggcaataatcaatagtttaccaaccaaaaagagtctaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaacagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaactcacaagggatgtgaaggacctcttcaaggagaactacaaaccactgctcaaggaaataaaagaggatacaaagaaatggaagaacattccatgctcatgggtaggaagaatcaatatcatgaaaatggccatactgcccaaggtaatttacagattcaatgccatccccatcaagctaccaatgactttcttcacagaattggaaaaagctactttaaagttcatatggtaccaaaaaagagcccgcatcgccaagtcaatcctaagccaaaagaacaaagctggaggcatcacactacctgacttcaaagtatactacaaggctacagtaaccaaaacagcatggtactggtaccaaaacagagatatagatcaatggaacagaacagagccctcagaaataacgccacatacctacaactatctgatctttgacaaacctgagaaaaacaagcattggggaaaggattccctatttaataaatggtgctgggaaaactggctagccatatgtagaaagctgaaactggatcccttccttacaccttatacaaaaatcaattcaagatggatcaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagagctaatatccagaatctgcaatgaactcaaacaaatttacaagaaaaaaacaaacaaccccatcaaaaagtgggcgaaggacatgaacagacacttctcaagagaagacatttatgcagccaaaaaacacatgaaaaaatgctcatcatcactggccatcagagaaatgcaaatcaaaaccactatgagatatcatctcacaccagttagaatggcaatcattaaaaagtcaggatacaacaggtgctggacatgatgtggagaaataggaacacttttacactgttggtgggactgtaaactagttcaacccttgtggaagtcagtgtggtgattcctcagggatctagaactagaaataccatttgacccagccatcctattactgggtatatacccaaaggactataaatcatgctgctataaagacacatgcacacgtatgtttatcgcggcattattcacaacagcaaagacttggaaccaacccaaatgtccaacaatgatagactggattaagaaaatgtggcacatatacaccatggaatactatgcagccataaaagttgatgagttcatatcctttgtagggacatggatgaaattggaaatcatcattctcagtaaactattgcaagaacaaaaaaccaaacaccgtatattctcactcataggtgggaattgaacaatgagatcacatggacacatgaaggggagtaccacactctggggactgtggtggggtggggggaggggggagggatagcatttggaggtatacctaaggctagatgacaagttagtgggtgcagcgcaccagcatggcacatgtatacatatgtaactaacctgcacaatgtgcacatgtaccctaaaacttaaagtataataataaaaaaaataaataataaaatttggtttacaatcttcaagaacattataaccattatatataatacatggtaattttcaagtatctcaaacacacatagaatttcatagagaggtataaatatttatgccaaaacacatggtataatgatttctttcctttgattaagaggcatttttatagtgatcattattaaatgaaataaatatttgcatgtggtacagtatacaatcctttcattacgaaatgttattttaaaagtatgtattgggtcctgaatcacgatgttttaaaatgtttgattttaatgagtcattgaatatgtattagcttttatgagatgcacatatttggaatatggctgtattcgtcagcataaggatgatttaaattttcttaaaatagactattaggatgcagatgttcttgctgacaggtgcttctaaagcattaaaaatacatgtaaccacagtgcttttgacaatgtaattctgttgccttcacacctattaagttgagcaatttcccttatttttctcaaacatgcatactaataaagtcatctatcagtgtttacatatatctaataattggaaaattacattttttatccataataagaaaaaagataaatacaattttgtgggaaatgctatgttagctctcaaataatgtaagtttagcagggcctcagggtaacaatgttttaaattaatcttttggtactatacatcaatttatattgaaatcatcaatttatattcaaatacctgtagtgctaagaccatgttttatttgtaatatcccctttaaacctcaagaaagagtccttattctaatctcataatttagtgataaaatgtatattcactttcccatttgtggcataattttcttagatgtcaaacattatttttctagactgtgaaaaacaaaggctttagtactatttatttgactgcgggaatgaaaataacattgttgagtatctgccctaagccaattactgtgctaatgacttttcttttagaatattgttgcctctttattctcttaatcattttaacattctttattttgacccactgcagtaacatttgatatactcatatgttatacgacaagtaaacatttcatttgctcccttcctttgttgatttcataatttcatgttatatgtagatgatgtcttcaggaaaattaatgactcctttattggttaatggagtttatcacttttcataagacaagtttaagtaatgtctatagattctgggttagataaatcagcaaagtttcatagagaaagagggcctgaacctcgaaagttaattatgctttagaaggcaaaaatgagcagcgggtcttttcagaagcgcatagggaatatgtaggattccctaggtactagtagttggccaggttagctgacgtgcatggtatctgtaagagagctgcgaatatggaaagaggatgaggctgcaacattggtgccttcttcattcagagaaggcactggaatgccaagctaaggggtttgtgattttcctgtaggtcctagaaggtgaaaaagtttgatgaaaatttttacacagagaagagaaagtgagtttgttatttcaggctgctataacaaatgatattagactgagtggtttataaatgagagtaatttatttctcacagttcttcaggctgagaagtctaaaaccagggtgccagcatggttgagtttttggtggtggccctctttcggcaaggagactgccaacttcttgttatatcctcacatggcacagagctcaaagaagcaagctttcttgggattctaaggtcttaatcccatgtgtgaaggctctacccccatgacttcatctaaaccctattacctcccaaagcccctctcctaatggcgtcacatagataagtggggtatcaacatatggattcttttttttttcaataggtttttggggaacaggtggtgtttggtgacatgaacaagttctttagtggtgatttctgagattttggagcacccatcacctgagcagtgtacaccgtacccaatgtgtagttttttattcctcaccaccctcctaccctttcccctgagtccccaaagtcccttgtaacattcttatgcctttgcatcctcacagcttagctcccacttatgagtgagaacatacgatatttgattttccattcctgagttacttcacttagaataatggtctccagtttcatccaggttgctatgaatgccaatatttcattatttatggctttttaaaagtaatgtttttttaaaacattatttatgctttatggctcagtcgtattcatatatatatgaatacacaccacattttctttatccactctttgactggtgggcatttgggctggttccatttttaattgtgaatggtgatgctataaacatatgtgcaagtatcttttttgtatagtgattttttttccctctgggtaggtacccagggcacgattactggatcaaattgtggatccacttttagttctttaaggaatctccacactgtttttcacagtagttgtcctagttttccttcccaccagctgtgtaaaagtgttcccttttcaacacatccacgccaacatctattatttttttttaatttttttattatggccattcttgcaggactaagagggtatcacattgtggttttgatttacatttccctggtcattagtgatgttgagtattttttcatgtgtttgttagccatttgtatatcttcctttgagaattgtatattcatgtccttagctcactttttggtgggattgtttttttgtctagttgatttgtttcagttccttgtagattctggatattagttctttgtctgatttatagattataaagattttctcccactctgtgggttgtctcttcactctgctgattatttcttttgctgtgcagaaagaagctctttagtttaattaggttccatcaatttatctttgtttttttgtttttttgttttttttgcattttcttttgggttcttggtcatgaagtctttgcctacaccaaggtctagaagggttttcccaatgttatcttctagaatttttatagtttcaagacttatatttaggtttttgatccatcttgagttaatttttgtataaggtgagagatgaggatccagttttcttcttccacatgtggcttgtcagttatcccagcaccatttgttaaatagggtatactttccccactttatatttttgtttcctttttcaaagatcagttgactataagtatttggctctatttatgggttctctattctgtggtctacatgactgtttttataccagtaccatgctgttttggtgactatggccttatagtataggttgaagtagggtaatgtaatgcctctagatttgttattttcacttagtcttgctttggctgtgcagattcttttctgatgccatataaattttagaactttttcttctagttttctgaggaataatggtggtattttgatggaaattgcattgaatttgtaacttgcttttggcagtatggtcattttcacaatattgattctacccatgcatgagcatgaaatgtgtttccatttgtttgtgtcatctatgatttctttcagcagtgttttgtaattttccttgtagaagtctttcacctccttgattaagtatattctaagtttttttgttcgtttgtttgtttgtttttgcagctatcgtaaaaggagttgagttcttgatttgattctcagtttcatcactgtgtatgtatagagctactgatttttgtacattaattttgtatcctgaaactttgctgaattcatctaccagttctaggagctttatgtatgagtctttagggttttctaggtatagaattatatcatcagcaaaaacagtttgacttcctctctactgatttagatacactttatttctttctctcgtctgcttgctctggctaggacttccagtactatgttgaatagaagtggtgaaagtgggcatccttgccttgttccagttctcagggcaagtattttcagcttttatccattcagtataatgttgactgtgggtttgttatatatggcttttattaccttaaggtatgtccttctatgccgattttgctgaggattttaatcataaaaggatgctggattttgtcaaatgttttttctgcatctattgagatgatcatgtgattttcattttaaattctgtttatgtggtatatcacatttattgacttgttgatgttaaaccatccctgcatccttgttatgagacccacttgatcatgatggattatctttttgatatgctgttggacttggttagctagtattttatcgagaattttttgcatctgtgttcattaaagatattggtctatagttttccattttgttatgtcctttcttggttttggtattagagtgatactggattcaaagaatgatttagagaggattccctctttctctttctctttctctaaaaatattgtcaataagattggtaccaattattctttaaatgtctgattgaattcaactgttaatctatctggtcctggacttttgttgttgttgatgataactttttaattaccatttcaatcttgctacttgttattggtctgttcagagtttctatttcttactagtttaatctaggagggttgtatatttccaggaatttatccatctcctctaggttttctagtttatgcatgtaaagattttcagggtagccttgaatgatcttttgtatttctgtggtagcagttgttttatttctaactgagcttatttggatcttttctcttctttttttggttaatctcactaatagtctagaaattttatttatcttttcaaagaaccagctttttgtatcatttatcttttgtattttttgtttgttttgatttcatttagttctgctctgatctggattatttcttttcttctgctgagtttgggtttggtttgttcttgtttctctagcctccttgaggtgtgaccttagacagtctatttgtgtctttcagactttctgatgtaggcatataatgctatgaatttccctcttgtcactgcctttgctgtatctcagaggttttgatacgttgtgtcactattatcattcagttcaaagaaatttttaatttccttctggatttcattgttgacccaatgatcattgaggatcaggttatttaatttccaggtacttgcatggttttgagagtttcttttggagttgatttcaaattttattccactgtggtctgagagagtacttgatataattttgattttcttaaatttgatttgtgtcttatcatatgatctatcttggagaatgttccatgagctgataaatagaatgtatattctgcagttgttggttagaatgttctgtaaatatctgttaagtccatttgttccagggtatagtttaagtccgttgtttgttgactttctgtcttgataacctgtccagtgctgtcagtggagtattgaggtcccccagtattattgtgttgctgtcaatctcatttcttaggtccagtaagtaattgttgtataaatatgggagctccagtgttaggtgcatgtatacttaggattatgatattttcctgttgcactagtgcttttatcatgatataatgtccttctttgtcttttgatatggtttggctgtgcccccacccacatctcatcttgaattgtagctcgcacaattcccacatgttgtgggagggacccagttggaggtaattgaatcatggggtgggtctttcctgtgctatacccatgatgttgattaagtctcacaagatctgacggttttataaaagggagttttcctgtacaatttctctctttgcctgctgccatccatgtaagacatgactttgcacctccttgctttccaccatgattgtgaggcctctccagccatgtgtaactgttagtcaattaaatctcttttctttccacgttacccagtcttgggtatgtctctatcagcagtgtaaaaatgaactaatacgtcttttttaactgctgttgctttaaagtttgttttctctgatagaataatagataacccagtgctcttttggtgttcatttgcatgaaatacctttttccacccctttaccttaagtttatgcaagtccacatgtgtcaggtgagtctcttgaagacagcagctacttggttggtgaattattcattatgccattctgtatctttaaagtggagcatttaggccatttacattcaatattagtattgagaggtgaggtattgttttattcatcatgttatttgtttcctgaataccttggtttattttcattatgttgttgttttataggtcctgtgagatttatgctctaaggagattctattttggtgtgtttcgaggatttttttcaagatttagagctccttttagcagttcttatagtgctggcttggtagtagtgaattctttcaaaatttgtttgtctgaaaaagattatctttctttcatttatgaagcttagtttcactagatacacaattcttgcctgacaatgtttggtttaacgaggctaaagataggactccagtcccttctagcttgtagagtttctgctgagagatctgctgttaatctgataggttttcctttataggttacctcatgcttttgcctcacaacttataagattatttcctttatcttgaatttagataacctgatgacaatgtgcctaggcagtgatccttttgcaatgaatttcgcaggtgttttttgagcttcttgtatttggatgtctagatccccagcaaggtcagggaagttttcctcagttattccctcaaatatgttttccaaacttttagatttctcttcttcctcagaaacaccaattattcttaggtttggtcatttaccataattgcaaacttattggaggtttgctccttttttaaaaattcatttttctatttctttgtcagattgggttaattcaaaagccttgtctttgacctctgaggttctttcttctacttgtttgattccattgctgagacttgccagtgcattttgcagctctctaagtgtgtccttcatttccagaagctgtgattatattttattttttgctacatacttcactggagagttttccattaatatcctgtatcatttttttgacttctttatgttggatttcacctttctttggtgtcttcttgtttagcttaatagttgaccttctgaatggtttttctggcaattcagagattttgtcttggtttggattcattgctggtgagtaatgtgatcgtttgagggtgttaaagaaacttgtttttgccatattaccagaattgttttctggttcattctcatttgggtagactatgtcagagggaagatctgggactcaagggctgctgttcagattattttgtcccatgggggtcctcccttgatgtggtgctctcctcttccccttagggatggggcttcctgagagccaaactgcagtggttgttatttgtcttctggatctagccaaccagtagagctactgggctccaggctggtactggagagtatctgcaaacagtcctgtgatgtgatccatcttcgggtctttcagccatggataccagcagctgctccagtggaggtagcaggggagtgaagtggactctgttagggtccttggttgtatttttgttacatgctctggttttgcttttgctcgcctccagccaggaggtggcacgttcaagagcacatcagctaaggcagtataaggaggatcaggcagtgggcggggcatacagctcccaagagattacatcctttgtcttcagagttccttgactgtcccatggagcctgtagcagcagtctacctctttcaaagggtctgtggattcttttggctttcctggtatgttcctgcagtagttcttggagcacaagtttacaatgtgggtctccacatgctgctctgtccatctaagtgggagctgcaagttggtccttcctcctatctgccaattttcctccattctcaacatatggattctgaggagatgacaaacatttaatacataataataagatttaataaaatcatgattttataagcagatagaaaagcctgacaaggggaaatattactaagagagtacatctcaaatgttaccataaaaatgtgaaatactggccaggcgtggtggcttatgcctgtaagcccagcactttgggaggccgaggagagcagatcacctgaggtcaggcgttcaagaccagcctgggcaaggtggtgaaactccatctctactaaaaatacaaaaattagtcgatcatggtggcaggtgcctgtaatctcagctattcaggaggttgaggcaggagaatcacttgaaactgggatgcggaggttgcagtgagctgagattccacgccattgcactccagcctggaagccaaaaatgaaactccattaaaaaaaaaaagtcaaatactgaaggtgataaataggttaattaccttgatctaatcatgccatattgtattgaaaaataataacatcactttttgtcccataaatatacacaacaataatttgtcaatatataattaaaaagaaaaagtgatttctagaagatgtttggaaggaaatcagatggtaaatcatatttactatgtctttaataatttcacactgtagccgtttcatgttttaaaaattgtaataaaaataaaaagtatagttctatacttaaattttttcattgaatgttgaactgtccactatgagggttgtggattttagttaatctttcactttggaaatgcctttgcagactaaattttgtttaagtgcacgagttgtgagtaagcctgaaaatagtttccttttttctaattttgcataaaagtgacataaatgccagctgctgcagctcagagcaaagaaaacagataatagatacaggaaccagtaaaacaatgctttcagagaatagtgctgtaaagaaaataaattaagataataaatggtagggcatattttagggcaatgttatgtaattagtaaaaaatggacattccactgaagctcaaagagctacatgttgtatgattccatgaatatatcttctagaaaaggaaaaattataagaacacaaaacagatcattggtttcctggggcatgcagcagcagaagaggtggactaccaagaggcacagtgaggtgttatgggagattagactgttctatgtcttgattgtggtggtaattatattatgtgtttctcaaaacttgcagaattgcaacataaaaagggtacatttttactataaattaattaggaataaaaactaatgaaaaggaaaaacaatgtcctgagaacaggatatatgacttgagatgcgaatgatgaatcccaggcagatggatctgcaagtgaaacctaagccagaacatccttcgtttgtttgagaaacaggaaggcaagagtcgtgtattagttctcatgcggctaacaaagatgtacccaagactgggtaatttattttaaaataggggtttaatcgactcacagttctgcatagctggggaggcctcataatcatggtggaaggcaaaggaggagcagagtcacgttttacatgacatgagagcttgtgcgggggaattcccatttattaaataatcactactacgagaacagtattggggaaatcacctcacgattcaattatctccacctggccccacctttgacatgtggggattattgcaattcaagatgagatttggggtggggacacagccaaaccatttcaggtggcctgagtctcctaaggaaagcaagggtgggaaataatgagatcaggtagcagatggaaactgaacacgaagacatagtactgtgcctgaaataagcttctgtgaattttctgctaatgtagaaggtcattctaggtcctagacagccttgaatctagaggaagaaagagatgacagaagctagataaatggagtaaagaaaaacatccgttgaatataaatccttccttccatggatgccactgccacccataatagaaaatttcatctcattgtaccctttcagaatgatagatatcacatcagacccacccagtaataatgccagtagtctgtttatatgacatgcacaatcattttaaaatcatacacatatatatataaaacaattgtctgtttaaacttaaagataatattgagatatattaaatgtacatttctgccctgtaattccttcacatgttatatgctatgggcaaagaaaacttaataaaggaaaaaaaaaaaacgccactttcagccttttcagttttctcttaggacaaaattgattttgcttttattgacattgtatagattgtgtcaaatttgcatagtaattctaagcctttccagttaattgacttttatatacaatacaaaaaagtccccccatgtcctgaacgtagtggtgaggcaagtcatttgagtgaacacctgcactcctgtatcaatatatatggttgttttgggaggttaatcaatcaatattttaaaataaaaaggtaaagaaaacaatgataaatatcctaaagacctatgaataggtgagaattgaagagaggcagtatggaattgcagtgtatagtgagaattctaaagttagaaaaacaggattcaactttcatatgccacatattagctctgcgattgtaaaaatgttacttaattcctctgattctaatttctcatttgtaaattggaagtaataataaaactatagggtttctttttgaaaataaaatgagatgcagcatttaacacattgcctggaacaggttaactgttagtttctattacttagagcagcacattgagataactcattaaaatatatctaatattttttactctacgggaaatgggagaaaaaaagacgagtatgtaaaaggttttacttcttaagtgtattactagagtaaagaccacaggaatgcatgcttgacaacataagggaaaaatgttttcaatcacattttaagacagcatagctgatgtagaagggtctagaaaagtcatgcagacaaggtcatgcagaaaattccagccttgactcttttggctgggtgatctggggcaagttgcttaatcttttaaagctcagtttcctctctgtgttttaggaataataaaagtactttccttaaagggtggttgttgagaattaaaagagaggatgtttagcatagtgtctggtacactgtcaaggtttaggaaatacagggataagcagaacatgctggtatgcatgaaggtagcatttacttaacacatgttcactgagtgtttactatgtatggggcattgtgatgaagtttgtaagaaacatcaagatgcacaaggcatcatctctgctattatacagcattcactactttagaaattgatcttcctgacagaagagattgggtttcgttctctgtattctcattgcttggcacagtcgctagcatataatatgtgcttagcaatatttttaaattgagtaactgtaatgataaatacacacacctcctttctaatgaaaactgagtttgaggaaagaaaaattgaattcccttcaagggagaaagagatctcactctttagtggctgttttacctgcttccaacagtattattgtttggctgcttttatttgttgtccgctactcctggtggattttgctcctgttattatcgcattcgtcattataattacttctgacccaaccacaaataggtcctctaatttgatcaagatctctctcgatctttatgcaccaagctcatttatttagtatattggctttcaaagtgtagtgcctggataaacagcatcagtatcacctgggacttgttagaattgaatattcctgggacctatcccagacttactgagtcagaaactcaggaggtgggtcacagaatctgtattttaatgagccctcccagcaatcctgatgcactcaaacatttaagaactgctttcatagcttcccccaactgttgtctctctcttaaagtatatgttttttttcttctgccgcggttcttggaataaattatagaacttgagctgaatgaattcttgtaactaaactgaacaatgacatccctgccatgttctgtcccaatagtgggttccacagagtgccaggctgacactcaggccttgtcaggtttcttgtctctagatccatttctgacctttccaagttgtcacctataaaattagattttttttaaatttttatctttctttaagaaagttgatcctggtgtctagaggtctaattctgcaccacagatcagtttcactgtctggtgacttaaagagtcttaatgctgttggactctgttatgttattccattcactgaggtaggcatggaatccctacagcctccctctctgattcacaaatcacaaagtatttagcaatatatggtagatttataatgttcataacagttagtcaatgtgagacattcagcagccagagttcactttccttaggaggtcagcagaggagacttcttggtgatgtcatcacacttgtcttgaaagacctttgagggccagccactattactaaagaaaaaagtataaggtgataaatagagtaatagtgagataaatatatcactctattctcaggagagtaggaagtcagatgatcttacctaactatttgacctgacactattttttgaaaaaaaattctaatcttaattgtagttctcatttaaagacctgaagagttttttgtttgttcatttgtttttgttttttatatttgtgcttaagctatttcaaagcttatgaatggaaattattttataaatcttttgattcatagaagtttcaacccataacactgaaggaaaatattggcatgccaagaattgtgattccatacaggaatagaatgtcatgcaaaaaaaattaaaaatgtatgttttctgattaatatgccatattcttattttcctggacctttaaaaatcataagaattgctatggatcagcctcacacaccactctttggatggttgtaagttctagtagaagtacatagtgctgacccttttaaaatttctctgttttacacagagaatataataatatatgcacccatattgacttctcttacattttttttctgaaaataatgagtacatctactgttgaagcaaatgcaaagattaatcacttgtaattttcccatcatatatataaatcgcacctttatttctggctttcacagaaagtaagtttcaaaatgagtttcaataaatacatattatcaaagttaaacatgagaatgaatttactttcattaaaaatcaatgttggacattattattaagaagagcaaggtgacaaaaatgtagtggaaatcaatgttggacattattaagaagagcaaggtgacaaaaatgtagtggaaacatccaaatagtcaaatgatctattgttatgaatttacctacgttaaattgatcatttgttaattatgttgttatgttaattatattatgttaattatgttgttaatttgatcattagtgagggaggaagatccagtagttaaagaaggcggggatgctaactgtccttgctatgtagtatgtcacaaggaaaactggtctcagagcaaataacattaaaagcaggcataacaagtgtcataccactctctaagctctattaaattccagatcctgttctttttgatgctctgacaacaccttgaatgtttacttgagatataattcataatattgtagcagcaacattcagctaaccttttggtcaaaatcagggcacatacaaaatctccaaataagcttccgaacacactgacaattcaattctcaaggttaaggtgacaatccagagggctgtaagttattgagatctctgggtccctctacttcattcttttgtgcagaagcaattgtatggcacttctatcttgtccaaactggaagaccagccgtttcactattcaatttgaaagtatgcttatgttatttatcaagcctctagccttgattggagataataatactcaaatgcttatagtagctgactgtggtacatggcctttggattacaattctttagttgctagctaaccaatctttcagaatattttattattaaataactaaccatgaattcttatatttctgattagtacgtttcaaattgtatattaaaaccaatctgctgtgtacatttgtgtgtgtgtgtgtgtgattcattgacaatataacaaaaattttaactttcttgaaaaggatactcttctcctctaacagtactcttctttagtctgtttttagctgtcagtactttgtgtagaaaaatttcctctgatatttgtttataattccaactgagtttatgtctgaatttgaactttttaaacttttccatgaattagactgtgagtttcctaggtagtaagcttttgagcacttatcgtgatgcctgacaaattacagatcctcaataagtagttgtggaatgaatgaatgaattcttgaacgggcctccttccacaattttagtactcagtctattacccaggcttgtgatctctgaaatattttgtagcttttgaatgttatctaacaaaacaatttttaaaacaatcaaaatatttaagtgacttttgttacagtaggaatgatataaagtctatgaattaaatttcacctaaatataaatattacaaagttgtaagggagctcttctagaacaaaaccaaacaaaaaagtagtttatctgtatacaatccaaaaatatggaaatcacttttcttgttcaaagataaatacattatcaaaaaatgtgatacattttagagcttctattgctcaatggatatgggaataaaataagaaaacacaaataacttcgattcagcctttaaccccgaagccacatgtttccactaacaagaagaaatccttgagagaaactttcagcaaaaagaatgttgacagaagagctttgagttagtcctgggtctttgcttaatgagataaagaagcaatcttggcagacaacttactgtaaaattccaacagtctttctcttttcatgtcatcaaaactttaattttctaaatctgtttactgggaagggcaaagagttctcctgtaagacttagatgtgtattttaagttccaagaactgatgagttataaccttgaaactgggaaagctttcacatttcttaaaatgtattgtagaaaactgttttttagtctcttaaagttgaaaactgtatttgctgaaagaggttggttttgcttaccatcatgtggcaatttatcattgaccatgacccagtgatctagctatgattaagtaaatctgatttaaaaagtctgcagtttctccagaattagaaatatatataatgatatttcccttgaaaaacttattttgtaagtaaaagcagtatctaatagattaactttaaaacataatgtaaaatctttttgtgtaaatacaatatacaatttgtataaagatatacaatatacaatttgtataaagatatacaatattactcctggaataatagcatgcatgcactgcctttttttcgttaaggtaacacatttctatgacatttttaagaagaaattgttttaaaatatctatgctaaaaacatcattacttttcttggtcctaaccctgatcaccagtctctggaagcaatcactttcactttaaatgtgtgtgtgtgtttgtgtgtgtgtatgtatacatgtatatgtcttgggcactttcttcagagaatttcacaggtgtaaatggaataatcaggacatatctatatctctttatatatttctatagagagagtgtgtgtgtatacatatgtatatatagttacagtgtatatatagagaaagttatataatgtgtgtgtatatatatatatatataaatatatatatgtatatgcatataattttccttataaaatatccctcctgtagtcctccatcctcctgtttctacctgcattcttcactgcctgggctggctactcctggtatttctctttgtcattgccctgattatgagaggctaaacaaaagtcatagatactttgtaaaacaatgaccagtgtaaaaataaaaagtaaacaagtgtccaaaagttctaatgggtgaataatattcaactgtattgttttaccataaattttgcaataaaatccctgtcattatcatttaagttcctctttacttactaacatttctctaaacagtcttgcataaaattgatttgtgtaattttctaagcactgtggatatggatatgtttccatggcaaaattttaatgttggtcgttctgggtgatgtgttcataggctattttattttaatgataaaatttgttcaattcgggactcgcagccaagatggccaaataggaacagctccggtctacagctcccagcatgaacgacgcagaagacgggtgatttctgcatttccatctgaggtaccaggttcatctcactagggagtgccagacagtgggtgcaggacagtgggtgcagcgcaccgtgcacgagccgaagcagggcgaggcattgcctcactcgggaagcacaaggggtcagggagttccctttcctagtcaaagaaaggggtgacagaaggcatctggaaaatcgggtcactcccaccctaatactgtgcttttccgacaggcttaaaaagcggtgcaccaggagattatatcccgcacctggctcggagggtcctacgcccacggagtctcgctggttgctagcacagcagtctgagatcaaactgcaaggtggcagggaggctgggggaggggcgcctgccattgcccaggcttgcttaggtaaacaaagcagccaggaagctggaactgggtggagcccaccacagctcaaggaggcctgcctgcctctgtaggctccacctctgggggcagggcacagacaaactaaaagacagcagtaacctctgcagacttaaatgtccctgtctgacagctttgaagagagcagtggctctcccagcatgcagctggagatttgagaatgggcagactgcctcctcaagtgggtccctgacccctgacctccgagcagcctaactgggaggcaccccccagtaggggcagactgacacctcacacggccgggtactcctctgagacaaaacttccagaggaatgatcagacagcagcattcgcggttcacgaaaatcctctgctctgcagccaccactactgatacccaggcaaacagggtctggagtggacctctagcaaactccaacaggcctgcagctgagggtcctgtctgttagaaggaaaactaacaaacataaaggacatccacaccaaaaacccatctgtacatcaccatcatcaaagaccaaaagtagataaaaccacaaagatggggaaaaaacagagcagaaaaactggaaactctgaaaagcagagcgcctctcctcctccaaaggcacgcagttcctcaccagcaacggaacaaagctggacggagaatgactttgacgagttgagagaataaggcttcagatgatcaaactactccgagctacaggaggaaattccaaccaaaggcaaagaagttaaaaactttgaaaaaaatttagacaaaagtataactagaataaccaatacagagaagtgcttaaaggagctgatggagctgaaagccaaggctcgagaactacgtgaagaatgcagaagcctcaggagccaatgcgatcaaccggaagaaagggtatcagtgatggaagatgaaataaatgaaatgaagcgagaagggaagtttagagaaaaaagaataaaaagaaacgaacaaagcctccaagaaatatgggactatgtgaaaagaccaaatctacgtctgactggtgtacctgacagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcaattcaccaaagttgaaatgaaggaaaaaatgttaagggcagccagagagaaaggtcgggttaccctcaaagggaagcccatcagactaacagcggatctctcggcagaaactctacaagccagaagagagtgggggccaatatgcaacattcataaagaaaagaattttcaacccagaatttcatatccagccaaactaagattcataagtgaaggagaaataaaatcctttacagacaagcaaatgctgagagattttgtcaccaccaggcctgccctaaaagagctcctgaaggaagcactaaacatggaaaggaacaactggtaccagccactgcaaaatcataccaaattgtaaagaccatcgatgctaggaagaaactgcatcaactaacgaacaaaataaccagctaacataatgacaggatgaaattcacgcataacaatattaactttaaatgtaaatggactaaattctccaattaaaagacacagactggcaaattggataaagagtcaagacttatcagtgtgctgtattcaggaaacccatctcacatgcagagacacacataggctcaaaataaaaggatggaggaagatctaccaagcaaatggaaaacaaaaaaaggcagggtttgcaatcctagtctctgataaaacagactttaaaccaacaaagatcaaaagagacaaagaaggccattacataatggtaaagggattaattcaacaagaagagctaactatcctaaatatatatgcacccaatacaggagcacccagattcataaagcaagtcctgagtgacctacaaagagacatagactcccacacaataataatgggagactttaacaccccactgtcaacatcagacagatcaacgagacagaaagttaacaaggatacccaggaattgaactcagctctgcaccaagtggacctaatagacatctacagaactctccaccccaaatcaacagaatatacattcttttcagcaccacaccacacctattccaaaattgaccacatagttggaagtaaagctctcctcagcaaatgtaaaagaacagaaattataacaaactgtctctcagaccacagtgcaatcaaaccagaaatcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaaaagaaagcagaaaagatccaaaactgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggaactggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacaccctcccaagactaatccaggaagaagttgaatctccgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacactgatgcaaaaatcctcaaaaaaatattggcaaactgaatccagcagcacatcaaacagcttatcaccttgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatggcaaaataataagagctatctatgacaaacccacagccaatatcatactgaatgggcagaaactggaagcactccctttgaaaactggcacaagacagggatgccctctctcaccactcctattcaacatagtgttggaagttctggccagggcaattaggcaggagaaggaaataaagggtattcaattaggaaaagaggaagtcaaattgtccctgcttgcagatgacatgatagtatatctggaaaaccccattgtctcagcccaaaatctccttaagctgataagcaacttcagcaaagtctcaggatacaaaatcaatgcacaaaaatcacaagcattcttatacaccaataacagacaaacagagagccaaatcatgtgtgaactcccattcacaattgcttcaaagaaaaaaaaatacctaggaatccaactcacaagggatgtgaaggacctcttcaaggagaactacaaaccacttctcaatgaaataaaacaggatacaaagaaatggaagaacattccatgctcatgggtaggaagaatcaatatcgtgaaaatggccatactgcccaaggtaatttatagattcaatgccatccccatcaagctatcaatgactttcttcacagaattggaaaaaactactttaaagttcatatggcaccaaaaaagagcccgcatcgccaagtcaatcctaagccaaaagaacaaagctggaggcatcacgctacctgacttcaaagtatactataaggctacagtaaccaaaacagcatggtactggtaccaaaatagagatatagatcaatggaacagaacagagccctcagaaataatgtcgcatatctacaactatctgatctttgacaaaccggagaaaaacaggcaatggggaaaggattccctatttaataaatggtgctgggaaaactggctagccatacgtagaaagctgaaactggaacccttccttataccttatacaaaaattaattcaggatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctagtatccagaatctacaatgaactcaaacaaatttacaagaaaaaaaaacaaacaaccccatcaaaaagtgggcaaaggacatgaacagacacttctcaaaagaagacatttatgcagccaaaaagcacatgaaaaaatgctcaccatcactggccattagagaaatgcaaatcaaaaccacaatgagataccatctcacaccagttagaatggcaatcattaaaaagtcaggaaacaacaggtgctggagaggatgtggagaaataggaacacttttacactgtgggtgggagtgtaaactagttcaacccttgtggaagtcagtgtggcgtttcctcagggatctagaactagaaataccatttgacccagccatcctattactgggtatatacccaaaggactataaatcatgctgctataaagacacatgcacacgtatgtttattgcggcactattcacaatagcaaagacttggaaccaacccaaatgtccaacaatgatagactggatgaagaaaatgtggcacatatacaccatggaatactatgcagccataagaaatgatgagttcatgtcctttgtagggacatggatgaaattggaaatcatcattctcagtaaactattacaagaacaaaaaaccaaacaccgcatattctcactcatagatgggaattgaacaatgagaacacatggacacaggaaggggaccatcacactccgtggcctgttgtggggtggggggagggggaaggggggagggagagcaataggagatatacctaatgctaaatgacgagttaatgggtgcagcacactagcatggcacatgtatacatatgtaactaacctgcacattgtgcacatgtaccataaaactttaataataataaaattaaaaaaaattgttcaattcaaattttcaacaatggacatgtattcgcatttataattttgaaaagaaaaaaatggacaatggtatttttatactattttaagctccccaatggcagacattattttcactgaatcatgaccaagtcaagttcagtgctgggaagaggggacttacattaaatatataatcagttacttccaggctctgcctcttattggataaggatagacactgtgacatcagagatcaccgtgctgtggaccgaacaaatgccatgtaaacagtgaccatgaccttttatgatcactgtctttctggaatttgacaaactcagagaaaagtttagaggaatgtatagactaaatagtccatttgctattgtgacattgatgatgaaacctttaagaaacttttgatttaaaatgtgttcatgaccttgtgttcataatttcacaattgagaggcgtccctccacattcttggaactgtgcacccattggaacctttaaggtaaatctaaccagggaagtttctcctcagaagaagatggcatccttgatgtgaacagcttttcccaagatcatgaatcaagacttctgtactatcttgagactcttatctttgagtaatttttccccttgtttaggcctctatgaacaatagaaatgaaaagaggtcttctgtgtgcacttactgggtatacttttacttgtgaaggatttggcagccagacttatatgtagataaccttatattttgatagataaaatatgaaagcccaatgtaggtgagagacttaaatggtacatacgttgcctcataatcagtcagaaacagaactttggttcactccctttgacccacatcatgtgttaaagagaaggttgccaggaggccttcactcttctagaagggcatcatttgttaggtactttttccatggtttggagtaaaagaagcaatgattagaaatgtatccctcatgataagctgtctagcaaactctactttaaaggctataattacacagcagattttaaattctcttgtgaaagttatgctaaataatcgaattgctttagattgctgactggctaaacagaagtatctgtgcagctgctggcacttatgtcttgtggagaaagcattgggtattacagacactcagttgtaggggattaagaagaggactacttaatcaagcgagtaaactctttatctagctcattctttgatctatttgattttaagtgatttggtttatggagaccctagtagggaccatactttcaactcttggtgttatcctcccgatagtcataatagaagtctccctggtgtgctgtatgctctcaaaggttttaaatgtttgcattcagacatctccagaatgtcaggtagtctctcttcaacagaaatgacaagagctgaaagaactatgcaaccatgggaaaaccgtaatctatgaatgaggtgctaagaccggaaacccaaaatgatggtaactgagagtagcattaaggccctaaagtttggtcacactctcacctaaatgagaacctgaccaaaaagggggaattcttaaaacaaaattacgggaggctattgtttggactgagctcaatcactaggcaccaacagaagaaactgtataaaaatggagtcacttgtgctaagtgtgacataatcaagctaagactttaaggaaacacatagatcctagaacagacgaggttttgtttttctcctgcaaacaggacgtttctgtataaggaggtaccatctactcaatcctcattcccaccttgcaaaacccactgttctactgttttccagtgggtttcaagaccaaataagtacatttacgatggtgatagtgacatcgatgaataaagttttggccaatctctcaaaattgagaaaatgaccaaaagcggggaattgttaaagcaaactaactgtggcctaagaaggactccttacttttatatctgagtccttgtggatgaaccataacctaacttaataggtagacaagattgaaaacctgacttagaagtatgggattgtcacaatatctgaatcttggcaaatcccagcagccatacttcaaccagtcatagactgctgagtgtttaaactgtgttcaaagagggcaaacactgaactgtaaccaatccagttgtttccatacctcacttccaatttctgtaggccacttcccttttatgtctatagatcttcttccaccatgtggctgtactagagtctctgtgaacctgctgtgattctggaggctgcctgattcacgaaggtttcattgcttcactaaactcctttaaatttaaaataaaataaaatgtgttcatgaacatgagttctaggttggttttggcagttttgtaagatcaataaaagcttcatttaatttatttgaaaacagtgtttaggaataccccaaagtatgttctcacatcgagggatttagaaagtgaaaaccggccgggcgcagtggctcatgcctgtaatctcagcactttgggaggccaaggcaggcggatcacgaggtcaggagattaagaccatcctggctaacacagtgaaaccccgtctctacttaaaaaaaatagaaaaacttagcagggtgtggtggcacgcgcctgtagtcccgggaggtggagtttgcagtgagctgtgatcacgccactgcactccagcctgggtgacagggtgagactcttgtctcaaaaaaaaaaataaaaataaaataaaataaaataaataaaagcgaaaaccgactgttaatacttgtacactttcaaaatgatgaatattttaaagtttaagttgttctcactagagttaactccaggatttctttatttctgttaagaagaggaaaccttgctatgggtagtgcttttctcacaagcttttctcacaggggcacttgcctgaaattatgtggtttattttggtttataaaaagtggctgggacaaggctgcaaaggttggtagtaaagtacctgacacctgccctggaaacttccattggctcttgctcttacttttattttattaaaaaaatgcacgtgtaagagagatggtgttgaatatgttgtaattataaataatgccaacctaaaataattaaaaagggttagaatctagtttaataagagtttattcaagcacaaagtttgaagacagccactcaggaagcacaggttacaaagactaaaagtcagtgttctgatggtagaagcttagggttgtttatagagacaaagtttaaggaagctaaaaagaatttcaacatctttctgtacaaggctggatgcatatttacaatgatctgattagttgagactgtatttttctttcaggaagggtatatttaacattccaccctgaagatgtaacagtcatgaggtcgtttgaaccatctggtctgagttaggtacatgacaataaaagaggtagttaatctataacaaagataagtgaattgaaggggtaagatgtctgatctctagtctcccctagtcatttacagagcaagaacaatgaagaagagagtaaatctataatctaagaagctgaacttgcacacatactatgtgactcatctccaaagcttaactttccccttggcgtaataaattaagagcgtcctaaaattacaatccacagataagtatagatacagcgctttatatgtgtgtgtttatatatatctctctgtatatttacatatataatatataagtagtagaagtagaagtagttttatatattatatatacatatatgtgtgtacatgtatacatgtgtgtatacatatgtacacatatatatgtatatataatatataaaactacttcttttgtacattgtattctgcttctaagaatgacatcactgcaaaaacaaatccctccactccacatccatgttacagtgaaacatttctcattaatgctccatcacttattaatttaaatgttagattctgtttagggtattatgtttataatttttattctgattgccatgtaaaaatatttcgttaaaatattgtaaagtatttttgaaatgtcttgctaatcttattattctgtatattccttattagcccatcagcttctcgagggacaaaaaattacgcatttcatttttattttgtgtgctcaaatctattgtcttattcatcattcaacaaatatttattgagcttacgatataccaagccaagcattagatattggtagtcccagaaatctaacaatcctgatgaattgagtgattattgaaagtgaatttacaaattcatcatccttctatctaagttttagtgcagaaagacattgtcaatgcaggctagcctttactgtaggacaaatggaaacctgacatttacaagaaaatataatttcataatgtatctaggaggaaaaatatttatcactgccaacccaggaaaaaatagaaaacttaacaaatgctaggtattgaccaaagaaacacatgatcaactgtaaatctacccccaaatgagaaaaaatgcattttttcttctactagtagctctaagcaagcggcagtctacaatgttttttcttgttctatagtatgtttcagaaactcacaataggagttcgttttgaattcttctgtgtagctcattttccatttggggaatctatttcttatccatttgtccacatctataactagcaaatagagaattcaatatagcaaatgtgcctacagtaaattcaaaattgcctctcatccatttgtgagcaacacataaataatgaaggcgacattaaaacttcgggtttttttatttttacttctttctctgaaatatcttttccagcaaaataaatggtttgaaataattatctatttagaagcactgcaatagctgtgggaatgtgattgccatttacctttcaggattttacggttcccatgagaagaagaaattttttgattccttgattctcttttccttcattatacttcattcttaacccatcagttttttaatttgcctgtaatagatggggctcagtgtctcaagagcatcccaattttatggttatagaaaccagacttagtagacaaaatgtttccttttgagcaaagacttagtggttttagcacctacaaaaaaactaaaggaataaaatggaaatgcaagggaaaccaaaatgcattaaaggttaaatttttcaatatttgtatttctttcttaacttggcacaaatgagattttttttcagttttttacattttatttttgactgctttgaatagtgtcggcttgccaaagtctcaccggactaatgcttacagcagaatttaacacattgccaaactaaccctgaggtgtggtttacactacagaaaagagtgttttggcacaattgccaatttagaaagtacgaaaggagtggcagaacttattgccatagagttagaattttacatctatactgcctattttttaaaatttaatatttcattgatgtcacgaaaaacattctcatgcgtcatattttggtccctttctttttttatttttattatttatttatttattttttgagatggagtcttgctctgtcgccaggctggagtgcagtggcacgatttgggctcactgcaacctctgcctcccgagttctcttgcctcagcctccctagtagctgggattacagtcgcccgccaccacgtccagctaattttttgtattttagtagagacgggtttcaccttgttgtccaggatgtcttgatctcctgacctcgtgatctgcctgcctcagcctcccaaagtgctaggattacaggcgtgagccaccgcacccagccccttatttttttaacagagtgttaaaggtggagtgtggaaggtcttaataaattatgtgtttgctgtgtgtatgtattaccatattacacatgcagtgataagaagccattctcatgataccttgttggccaaactgggttgaaattgaatttaagctccacagagattgtgactacacattagtgtagtaaatatatatatatacacacacacacacacacacaatatggtgtgtatatatatacacacacactgcactatatatatatacagtcgtatacatacagttgctgtatatatagttgttatatatatgtgtgtgtgtgtatatacatatagagagaaagagagagaaagagagagagagagaattgttatattatcttgctaaatgggccactttctaattatataattaccatctttgtctctttttacagcttttgacttaaattgtattttatctggtttaattctagctattcttgctcttttttaaagtttctatttgcatgagacatctttttccatttctgtactatagttaggtcctatttttttaaaccattcagccacttcttatcttttggttggataatttaattaatttacattcaaagtaattattgataggtaataacttactacactatattgttcattgtttcccagttgttttgaagattctttcttcttctcttactgtcttctttgtggtgattttctctagtggtacaattattttgttgctttttatttttagtgtatcaaagttatttgctttgtgattatcatgaagcttgcaaaagtcatcttacagttataacaggatattttaagcaaaagcaacttatctttgatcacaaaaaagcaactctacactttaactctacttcccctctacatttcaattttggatgtcacaacttttatcattttatattggataatccttaacaaattactgtagtgattactaatttaatagttttgtcttttaaccttcatactaatgatatacatgatttacacaccgccattatagtatgaagatagtctgaactttactttgtattttctcttaccaatgagttttattctttcagatgtttttgtgttaatcttagtgtcctgttctttcaactcatagaaccctctttatcatttcttctaacacaggtttggtggtgatgagctccctcagctttgtttgtctagaaaagtctttgtctcttttttatttctgaagaacagttttcctgggtatgctactcttggttgacagatttttttttttcttcagcatgttggatatattatccaaatcttttctggactgtaagatttctgctgagtgtgtctccagttaggtatattggaacttccttatatgttatttgctgctttagtcttgctgttttcagaattctctctttgtcttcaatttttgatagtttgattttaatatgtcttggggtattcttatttgtatagaatctgaatgaagaactttgaccttcctgtacctggatatttttatcttttcctgagtttggaaatgtttctgctcctatttctttaaatatgctttctattcttttaatatttctctttcctttatttaacttctataactcatatagttgcttttttgatgttgtctcataattcttatgcacactggaatggaatggaaaaataccttcaaaattctatgaagaaaaaatatagatgtaaaattctctacataactaaactatcagtgaaacagtgggttagatgaacaaatttatatatgctggagcctaaaagaaaaaccaactttactcacttactctccctcagcagagagaataagatatgtgaaggcgctcatcaaattcaaataaatgacattacagttattgaaatatataatacatgggagaatgaaagaagattgggaaaaaggagtgaggtacaaggactattacaagaatgtggctgaaaaacagaaaatgtttcaaaatgattgtaactgttattacaagctatatatcagttattattaaaaacaaaaaacttgcataaattaaaataaaaaggccgacactgcagtgggaggaaaaggacaatatatatgcaagaataacttactgaaaagacacaggagtggccaatgaaaaacaaagaatgcatgttcaacctatcattaagaagaataataaatgaaataccacaattacctattgactgagaatcaaatttatgtataatgccaatgttagtgtgttttggagaactgccaatgccaatgttaattgttataatctttccaaaatatcgacattgaatgttgcctgcatcaacactaaaataggcttaatctttgaccttactattccaccttttattataaatgattgggaatagctcttaaaggacattgaaatgtttctattacaacataatttatcacagtaaaaatttagaaatagtgttcatttttacatgttggcttaaaactgtaaaataaaatagagtgtacaattaacccttgaacaatgtgagaattaagggcacagacccccctgtcatgcagtcaaatacccatatataatttttgactcctaaaaaacattatagcctactgttgaccataagccttacttgtaatatagtcaattaacgtgtattttatgtttatgtattatatactgtattcttactttaaagagaaaggaaaatggtattaagaaactcataagaaagagaaaatgaggccgaggcaggtggttcacctgagatcaggaattcgagaccagcctggccaacatggcgaaatcctgtctctactaaaaatacaaaaattagccgggtgtggtggcatgcacctggaatcctagctactaggcaggctgaggcaagagaatcgcttaaacctgggagacagaggttgcagtgagctgagatcatgccactgcactccagcctgggtgacagagtaagattctgtctcaaacaaacaaagcaaacaaagaaaaagagagatagagaaaatacatttacagtactgtactgtatttatcaatactctaagttacatcatctgtttacaaggtgaattgttggtctgaagtagtagcaaccgcagctgcaggcttctgtctatggtacatatcatgccatttagcttttactggtgatgtcatgacttttctctgcttcttgggagcacttcgagcatcactagtggcaccttgtatgggccccatggtgtcattcaagatttacagtattgcactaaaaatgataagaactacaggagaactgagagaaattacttactactgcaatactcaattactggagagataaactgcttacatgaagatgattagcataacacagcattttaggaggatactgacaacaccagctcaccgcaatagcagtaactataaagttattactatagtttaatttgtactatagttaattttatagttatgatttaatactgcacctttacttttgtttatatttctctcaactgcaaatggtaccatatatggtctgcgtttctgtgtgtaagttttgataaatttgaacttttcatactagatttgtgtatcatttatggtagtaaattatgaaatagacgagtatcaacatatattttatatgttcctgacatggctatttttttcttaatttttctatatttctaggctgtgagattcatctacaggtttttttttttcaaattgttgcaaatctccaatcatttttcaatacgtttatttttaaaaatccatgtataatagacctgtgaagttcaaacccatgttgttcaaagatcaactgtagatttttttaattttacagttatcaagcacatttattatgtgttgcatatggtatattgaatcttaattctgtgttatatcttaatttttatgaaacaacctactgtagttataaatatgataataaattagaaaatattcataaaggaataatgttaagtggataaggtaaaatactaagcagcaacgatgacattcctaaacttgcaagattattaatgtagatatacatatgcatagaaaaatcttaaggctgcccaggcgcgggggctcacacctgtaatgccagcactttgggaggccaaggtgggcggatcacgaggtcatgagatggagaccatcctggctaacacggtgaaaccccatctctactaaaaatataaaaaaattgctggacgtggtggagggcgcctgtagtcccagctactcgggaggctgaggcaggagaatggcgtgaacccaggaggcggagcttgcagtgagccgagatcgtgccactgcactctggcctgggcgacagtgcgagactccgtctaaaaaaaaaaaagaaaaagaaaaagaaaaatcgtaaggctatgcatagcaatttaatggtagttgtctcaaggtggtggggttatgaatgatttatgttctgtcttttctgttggcatttctttttatatttttcttctgtgaacacctgttgctataaaaatactcagtgcacgtgataataaacatataaagcattctgtatagtctcactgacatttgaaaaaagcctctaggttttatttctcattgtgatcattgcaatgggcatcagaactgcatgtgtaaaaacgatcttgtctgttcttgttatcgtctgcaccctttatctaacatctgtatcactgcttagctggaagcatctcctttagcacggcactgccatgttttatgttctaatgtaaacttgtgtgacttagctatggttaaatagaaataactggtgtttcagcttgatttttgtaacagattctgaggcacgtttttctgtctcaacccgggaatatccatttctgcaccaggacaaattaattacaatactgatgtttaagtatttatggttagtcaaatcttgaatcaaatcgtaacagaaatggaaaacagaaaataagaagagagaggagaaggggaggaggaaaaaggcgcagcagcaacagctattttgagagattgggaaggatcttaattgaaaaaaattgttctttccccaggcttggtcggcgaatcacttaatccactcatcccttcgtcttttcatagaattaggaaagatatttagctcaggccctagaatcagactaatgctgactcgttcttgtctcgaagggctttctacaatttactgcattcagctccatactattaataataatgttgctgcttttcttaaaatccatgttggaaatgtaagaaaatgtaaagaaaattttatttcatatttcattttacatctccaaagcccccaccatctccagaaagagtacaatgatcattttctttgtctctttatatttgaacaatcatcacaacactaaaactacttcgccgttgtgctaagacctcctcctgcctagattgccaccatggcccaccttctccaatttagaagagggaaaggtggggccaaagagagacctttggtgggttttctaccaataagtttaaaaagatactgaaaaggagacccttccttccttcccttccttccttccttccttcctttccttctttccttccttccttccttctttccttccttccttcctttcttctttccttccttcctcccttttctttctctctctctctctgcttcaaatacactttttattcccctgtagaatcagaaaatatctgactgcttgagtctaaatctaccagactaaggaagcctcggaaaagcttttactatttcctcttccctgtctgtgatttttaaaagcatagaaataaaagttcattgtttttatgttatttgtctaaatatatttccatgatatattttaataaaacattccttaggtatttatagttataggattgatggaacagatataatataaagtaagtaaaaaatcttcatttcaaataaagtatccaaaacaaaaatttgattattgagctttaataacattttttaggtttaggggaggcttaatttggggaactggctattagaaaaaaattatttgaaattgcaatagataatgagctttaaaggtaaaaggttggtgcaaaagtaattacagtttcagtctgtgaatttaaaatcatgtataactaggctcaaacacatctttattaattaaaataggaaccattacaatcaacacattattgccaaggagaagtaaatttattcctgtagcgtaaaaagccatgcttcaggatttgatgaattcttggaaagcattttctacatcttgctggttccaacaactcaaaaactgcaattactttttcactcacctaatattagattagaaaaagatcattatttaaaactgataattgaaaaagagcaaatacaagcattcacaaaatccccccaaaaaagcatctttatagatatttttgttcctgtagatttagactgcatcttctttcattgtcatttcttatgacaattatttgcaataaaaatatcaatttatttatttatttatttatttttgagatggagtttcactgttgttgcccaggttggagtgcagtggcgtgacctcagctccctgtaacttctgcctcccatgtacgagtagttctcttgcctcagcctcctgagtatctgggattacaggcacctgccatcacacctggctaaaaatatgaagttagaaaaaaaaaagtttggtcattctgctaaagtggtggtgtacattttgagttgtcattttttaaatttttttctccagcttctcaaattgtcattagcaatgtcatataaatttgtaaatttttaagataattgacagctttgtgaacacccctatcaagttccttctctctttctctctctctctctctctctctctctatatatatatatatatatacatacacacacacacacatatatctttctatatatattgtatatatatactatatatatacatatatatctttctagatatatatagtgtgtatgtatgtgtgtgtgtgtgtatgtgtgtgtgtgtgtatatatatatatatatacatatatatatatatatatatatgtatatatctttcaaaatatttcaaagccaggcatggtagctcatgcctgtaattcaaacatgttgggaggctgaggcaggatgattgcttgagatcaggggtttgagaccagcctgggcaacatagcaaaaccctgttgctacaaaaaataaaataaaattagctggacatggtggggtgcctgtagtcccagctactcaggagactgaggtgggaggatcacttgaacctattacttcgaggctacagcgagctataatggtgccattgccctgcagcatgaatgacaaaggcagaatttgtttcagcaacaacaacaacaaaatttcaagttttataatatttgatgtagcccttaattttaaatgctttttaaaatttataacaaatttttctcaccttataatagcatataaaaagttttatgttacctttgttgatgttagtgtattttgtcaaatgagcaaaaggtacatttgaatgaaggtattcatataagttactacttggattatcaaaaaaagccaagcagctattctgtttgctatttatctttttctcttaataaatcccttgtttggtattatttaaaacaagggccaaatattttatgccaatttctttgcatattgcatgtgatattttctcctatgactctggggttggatagtggtgacacagaccatgttgcctgcaaagcctaaaataaagacagaaaaattatttttgacagaaaattaagttcatgatgtaagataattttgtggtaatttttgttataatttgttctcaatgttaaaataatttctgttaattttattgcttatctttatttgttgtgtcattttctattaattttgcatctaaatattatctctatacttttataaattaatgttagtctgacaaaaaaaatagccttcatttagggcctaatcaggagtttgaacttctcaattatatttaaatcaaacattccaaaacatatgttcacattacagtatataagtgctttataaaatgtatttccttcagtaaaacaataaattttgagtatataattgtgtatgatacattatgaagtagaagacaactctttggatgaggtgttgaattaaatacattccttgcaattttatacatctgattgttgcaagcattctccacaaattaacttgtggtggtgtacatgacaaagcttttttctttacaacacaggacacagatgttgggcctcatatgacttgttcctatcattatgcaacctcacactgtgtaattcatgtagcaatgctgtatagactggcaggtagacagaggagcaatttcaacattactaggctttaggggaagtgtgatggagaggaagcaggaataatacaatggttatagccagtcatgcttaactatattacttttgcaagttttatgaaaatacctgctatgagaagacactgcaagagctcctcccagggcctttaaccgactgtgtaagtgaggggcttaagcttcattttcttcataataggttcatctttgcatatcaggatacatagaaggaaagataaaacaattttgaaagccaatcaaagcatatataaagcctagatgggcacatattttttattgtgacattaagatagataggataaatgaaattgtcaagatacatgcaagcttctgccccagggcatttcccctatacggaaacagacctcagatcgcactcttccagcagtcttatcccctgatgtctctgaactacatcggtacttcagattctatttttatagttctttgcttttgccacaacctctcgtctgatttctccacgttgcctggtaaacctctatggtcctgaggttttgactctgatctgaaaactgtccctcttctgcaggtcttttttccatcaccatccttttcaaagctgctaatttagacaaatttcctgaggttctagtggaagtggggctacaaatacccttgcattatttagtcataattatttctgggaagaaatctaaatttcttgttttgttttctcagttatatcacaatgcatttgttgaattgaaattgtgatcttcaagcctcgttttcctaatttgtcccttaaagaagggaataggccaatgttctcatggtgccattgctttgatgttgaggcacttacagacctgatccaggactcttaacatttctccctgttcaaggtccattatgtggtgcagagccatggtgaaggatatgagcacaaagctctgtgggttttgttttcctttgtttttgtctttttaatctgtaaattgattcttgctaatcacttgaggaaaacaatgacataataatactatgtgcgaagaatttagcaaaaattggtgctcatctgtcaggaaatgattaatatgattccaaggatgaaatgtggaagcattaacaagagaaacaataacaacagtgatttttgccttaggtatcagaggccccaaaatacaaatttcctaaatccattagaaaaataattgccttaatatgaaaacatgtgcatctaacaactttctgaaataattatattatctgaaagtacatgtagatggtctggctttctttaaagatgtttataaaaattcaagataaatggttaataaccttctatccttgggaatcctaattttgccattctttatgcagacaattacttttctttctttttttataatactttaagttctgggatacatgtgcaggtttgttacataggtatacacatgccacagtggtttgctgcacccattaacccgccatctacattaggtatttctcctaatgctctccctccccttgccccccaccaccaacaggcaccgatgtgtgatcttcccctctctgtgtccgtgtgttctcagtgtttaattaccacttatgagtgagaatatgtggtgtttgttttctgttcttgtgttaatttgctgagaatgatggtttccacctttatccatgtccctgcaaaggacatgaactcattcttttctatggctgcataatattccatggtgtatatgtgccacattttttttagccagtctatcattgatggggatctgggctggttccaagtctttgctattgtggatagtgctgcaataaacagacttgtgcatgtgtctttagagtagaatgatttataatcctttgggcatatacctagtcatgggattgctgggtctaatggtatttctggttctagatccctgaataattgccacactgtcttccacaatggttgaactaatttacgctcccaccaacagtgtaaaagtgttcctatttctccacatcctctccagcatctgttgtttcctgactttttaataatcacctttctaactggcgtgagatggtatctcatcgtggttttgatttgcatttctgtaatgaccaatgattatgagctttttttcatatgtttgttggccacataaatgtccgcttttgagaagtgtctgttcatatccttcacccactttttgatgggcttgtttgattttttcttgtaaatttgcttaagttccttgtagattctggatattagccctttgtcagatggatagattgcagaatttttctcccattctacaggttgcctgttcactctgatgatagtttattttgctgtgcacaagctctttagtttaattagatcccatttgtcaattttggcttttgtggccattgcttttggtgttttacatatgaagagtttgcccatgtctatattctgaatggtattgcctaggttttcttctagggtttttatggttttaggtcttatatttaagtccttaatccatcttgagttaatttttgtataaggtgtgaggaaggggtccagtttcggttttctgcatatggctagctaattttcccaacaccatttattaaatagggaatgctttccccattgcttgtttttatcaggtttgtcaaagatccgatggttgtagatgtgtgacattatttctgaggcatctgtttgttccattggtctatatgtctgttttgttaccagtaccatgctgttttggttactgtagccttgtaagataatttgaagtcaggtagtgtgatttctccagctttgttctttttgcataggattgtcttgactatacgggctcttttttgtttccatataaaatttaaaatagtttttctaattctgtgaagaaagtcaatggtagcttgatggggatatcatttaatctgtaagttactttgggcagtatggccattttcgcgatattgattcttcctatccatgagcatggaatgtttttacatcatcctgataccaaaacctggcagagacataacaaaagaaaatttcaggccagtatccctgatgaacatcgacacaaaaatcctcaataaaatactggcaaaccgaatacagcagcacattaaaaacttatccgccatgatgaagacagcttcatccctgggatgcaaggctggttcaacatacacaaatcaatagacataatccatcacataaacagaaccaatgagaaaagctacatgataatctcaatagatgctgaaaaggccttcgataaaatttaacacctcttcatgctaaaaactctcaataaactaggtattgttggaacatatctcaaaataataagagctatttatgacagacccacagccaatatcatactgaatgggcaaaagttggaagcattccatttgaaaactggcacaagacaagtatgccctctctcaccactcctattcaacagagtattggaagttctggccagggcaatcaggcaaggaaagaaataaaatgtattcaaaaaggaaaagaggaagtcaaattgtctctgtttgcagataatatgattgtatgtttaggaaaccccatcgcctcagccacaaatctcctgaagctgataagcaacttcggcgaagtctcaggatataaaatcaatgtgcaaaaatcacaagcattcctatacaccaataatagacaaacaaagagccaaatcatgagtgaactcccattcacaattgctacacagaaaataaaatacctaagaatacaacttacaagggatgtgaaggacctctttaaggagaactacaaaccacagctcaaggaaataagaaaggacttttcttacatttctaaaggcacataagatcacagagacagaagatgtccagtagatttattttcattcctctagtacaaattttttatagacagaatcataggaatttctgaacctaaaaatattaatcttcatgccacctatttaaaggaaatgcaagcacatgtttattgtaagtgacagtcctctgagatgatagttgatctgtgttcatggcttaagattattatattcagtgagaatgaaattacttctattgaaatcttggaagtaaatgaacagatcatagaatattctagctctcaaggctggtctcagcaagacaatatctgggtagaaaaaacttgatggatagtcaaggatattttagatctgagtaatcaatagcaggtgatggagaaaaagagccatataataagtggtcttataagcatttttgctgctcaagaagtaccagccacaaagaaccaatactattttaaggattaaagttaccaaactatagtagaatgtatgtgtacttaggaatcacatatgtatcatttagtgtgtatgtcactagttctgcaacttgtagtttaaactagttttctcatgtttaacgagatgataaaaaaaactaactcagaagattgtagtataaataaaaagcgatgacatctcgttttacataaattattgcatttgtcattcattcagtaaatgctagctatttttacttttctggaaactagggaaaataacttctatataggtttgtaacgaattccaattacgaaattcgaaataagcataaaacaatacctcttgcatcatatataatcaaacattaaattaccttttgaacaaaaatctttgtttattaattttactggcccccaaatggctatgaacttgttgaaaatggagatatcacattcatctttttattccccatttctagtagagtacctgagacaaagctagcaaatgccgactgattgaacaattccagctctgttattaaaatcatcatataacacaaacttgtcaatggaaaagttaactttcagataccaaaaaaagggaaataagctattgcaaataataatcaggtaaaaaaatatttattctgtttcagcatagtgttataaatattgaaatgtaaattaaaggcagtagggcacacctatatcttgtttctagtttttgctgatagctgtatataatcaactattattgctttgataccaccatataacgtgggttataagattttcagataaaagcaactcttatttcatttgtttttcttgaattactccatataggaagaggctttggaatcgtatttcttgctttgaaattttatttcttgcatttatatgcctttgcaataaaatcgtgttaacttataatctctcacgcaatggtttctcctagtgtttaataaaatggtattaagggtaactgctactattttttctaaaattagaaggtaacattgaatggacacacagcagatacatgttacattctgaaatgtatgctttgctggagcagaatgaatgcaatcaatgtaatggaaatgctgcactaatggctcattaaacatggaaagtatgcatagatgaaaaaagtctgtgcatatgtttcagttcactgaaggaagcaatgaactataatgtggaaagaaaaggaaacatacttctttacgtaaatattcttacttctggaaaagaattgttgaatcagtcaggaatttgacagcaagatttcaactattggagcagacaactttatattgtaattgatggatctggtggacttttaaatattttttttccctattctgtgctttttcacattgtttctatatctttttgtttttttgcaaagttctttaattgatcaatattttcttttgtgatatgtgttttattgctcacaagaaaaaaatttctctatttaaatgttatactctcttacactttctttcaaactgtcacttataccactgcaattcaccccaaattattttagtatatgatgtgaaatccaagtctagctttacttttttcacctttattcaattgtcccagaaacatttatcaattattccacatttcttcactgatttgtaatatgccctttgtcttaaaccatgcaaagctccccagcatcaatagaaagagagaggaagtagatgataaccttttgcagtgggaaacaaaaaagatattttaaaactcttgtttgtgtttggaactgtcacctcctatgacatgtcaaacaaccttatttggcattggatagtgtaagtaattttttgccctgacaaaatatatttaggtacccacttgagcaaaacttataatatagatttaatcatatattcactgttatcatcgacttcattgtgttcttctacctctgcctgatgcacctcttgattattcagcattgttgccaagcatttgctgttagtagctgataacattcatcttcttttgctaaatatttctcatatacaagaagatttaagactgtttatccctgtagttggaagatttttcctctaaaagctgtttatacttttcctagcacgaagacctgcttatatgccacacaagtgtctcttaaaaagttagtcactcaatgccctgctaataggagtgaaaaagacactagaaacaaaaatcttttctaaccagaaaaccacttttgtataaattttgagctccttgcaccacagtgactacagtgtgcctcactaaggtaaacatagaaaatggtatcatttattgtttcaaattaatagggtaattgtaaatatgataagtttatcgaagatattacagaagtatacattttaagacaaccctagaaataattcttttaagagcatgttacaattattattttaaaatgcattactcctaccctaattttagttggaagagatgtatgaaaattacaatgattgtactgcatagaatatgtcatttttgtttgattttttaattagcagtttaatttgtgcagtgtcgaatataagagataattctgataggtttgtcatcacagagtctctggcagttaacatgaatacaaaatattaaatgtattacttaccgcagtaaacggtcactagtcagtaggttgataattcgcatcttgtagaacactggccatgactgatggatttttatcctttcttattatgtatacgttttttttcattaatagtgttccccctccaagtcagtttttatattcaatcctagcacaaatgattttaaaaatgaaagagatgaaggagatcattagattctagcagaggaaaagttgtaatacaagttggtttagaaccaaagtgctttctaactttcccatttgtttgttttttgttttatgtttagacttggtattaaaaaatgaagatgtaaacaattcagttaggaaaccttcagagatattctgcactgaccttcattagagtttgtgtagtgcatgaccgtggtaatatcaaatggttgcgtaagtatctacaaggccctttttcaaaaaagccatcaagttgcatctctctaattattgcaaatatcttgtttactcctatttattcactacatcacttgaagtttcctcttgaatctgagcatgtcctgtaggtctaccttagaagaaaggaaaagtgctgtcttccacattgggtttcagctgggcttacagccaagtgtacattgcaatttgcaattatctccttttcctgcttgtgctggcaaagagagggaaaattttaaatatactctctgtgaaaagagtgtgagatcagaaaacagacagtattatgaatacttaatgtatttcctactcaggacaatttccagcacttttcttttgggatttaggcttctgtgtataatatccccttgaaaactgaagaagtacaagtctccttgcttgtaagcgactaaatggctgacattctggatgcatgttttcatagactattgtgttttgagtaaatataaatgggatcactggataaatggatttggaagagtaacgaaacaagaatagcatgggggaattatctcacaggaacattaaacttaaggggatttaactgtattcccattaagagaaaaagattaaaataaaatatgtacagccacgtgtcatttagtgacagggataccttttgagaactgcgtccttaggagatttctcatcatgtgagcatcatcatgaacagtcatgtgtttctgaacaaccggggtatgttccaagaaatgtgtcattaggcaattttgtcatagtgtaaatatcacagagggtacttaaacagacctagatggtatagccccctacacacttagactatatggtatatcctatttttcctaggctataaaaattttcagcatgttactgtagtgaatactgtgggtaaatgtaacacaatggaagtattaatatatctaagcatatctaaatatagaaaatgtaatgcattgtcctaaaatgttaggatagctatgacttcaccaggtgatagaaatttttcagttcccctataatctatggaatcaccatcatataggcagtgtgtccttgactgcaacgttatgtggcatatgactgtacatctatgtaagttgcatagaccattttagtctccatttcactctgtgagaatgtatcctaaacggtaaatgcaattaagttttaaaaacatgttgcaagcatacacaaaagcatagagtaattgtgcaaattattttaaagttttccaggccatagatgaaaaggtaaagttcattgcttaggtagccagggaaaaggagagtgatagaaacaatggcagtcttggggtagacagtgaaatactgagagcctttgacagtcattgaaaaagaattggagcccgttctccatgtcgtgcttatttcagattgcatgcctgtatcaaaacatctcatgtactccataaaaatacacacctactatgtacccacagaaatgaaaaattaattagaacaatgaacaaagaataatggatttatatgggtgtacataaatccaagtgtgtaatagtttatacacatggacttatcaagaatgataattctttatcattcatgataaatgaaacaatctttatcattctaaatcaatgaaactatcaagaatgatttagatgtacagaatttatagtgaggcatgaccattagaatctagccagaatatagcgtacaatttcactatattaacatattcttgaaattgtctattcatttggtttctactggatggtacaattagagatgaattagggagggacaagaaactagcatttactgggtctctaacatgtgccaaaggcgaatggcacctcaggaaggtgcagctgcctttacgtgacatagggaagaaaacatttagaaaatgatatttgatcttccttgagaaatacaaatagaacctatccagatggaggaaggcagtgagcaatagcatgtttgagaacatacttttgttctcacacatcatgtaccaaacacagaagaaaatgacgcatctaaaattttttttaaaactacgctgatgcttttttttcttcacaacacatttttatggttttttttttttttttttttttttgagacggagtctcactctgttgcccaggttggagtgcagtggcacaatctcagctcactgcaagctctgcctccagggttcatgccattctcctgcctcagcctcccgagtagctgggactacaggcacccgccacaacgcccggctaattttttgtatttttagtggagacggggtttcaccatgttagccaggatggtgtcgatctcctgacctcgtgatccgcctgcctcggcctcccaaagtgctgggattacaggtgtgagccaccacggccggcccatttttatgtcttttaagctccaagttttcttagctattttcatctgtcatatatagcctcaatatattgttgcctggcacatagtaggcatccaattaaaattaattgaatgcatgactgaaacaagagtttctcttcattatgattcttaatttaagcttaaatttagaaatcctcttcttatcatttttcttagtttaactcaacactaataagattgtcgtttctatcatattctgtgtctttccccatgatttccatagctctttgaattaggataatgacttttttattttattttattttatttatttatttattttgagatgtagtcttgctctgtcgcccaggctggagtgcagtggcgccatctcggctcactgcaacctccgccttccaggttcaagcgattctcctgcctcagcctgccgagtaactgggactacaggcacccaccaccacgcctggctaatttttgtatttttagtacagacagcgtttcaccatattggccaggctggtttcaaactcccgacattgtgatctgtccgcctcggcctcccaaagtgagccaccgcgccaggcctaggatcatgacttttataacctgtagcgagaaaagatgcaaatctttctcttattggtatgattctgctcaaactcagatacacaatctagagtcaagatgacaccgtaaaattattttttttaaaaaagaaagaagcctgggcatggtggctcacatctgtaatcccagcacttcgggaggctgaggtgtgtggatcacttgaggtcaggagttcgagaccagcctgaccaaaatggtgaaaccctgcctctactaaaaatacaaaaattacccaggcatggtggcagacacctgtaatcccagctacttgggaggctgaggcagaagactcacttgaacccgagaggtagtggttgcagtgagctgagatcataccactgcactccagcctgggcatcacagcgagtctcaaaaaaaaaaaaaaaaaaaagaaagaaataagaatacgaactgcaatcacatttccaggctgattgtaaaataggaacagcacacttgagccaaagcaaaggtttcaagaaggataaggtcaaatgcacagaatatgggacttagattgtcaagctgaggttaaagtcagtaattattggagagacctagggattccaactttagactaggagcatctaggctgtcataagtaagaagagagcaggggctttaaaacttggctgtcacaggtagcatttcttttccccttgaccctggggcacaggttgtccactcgcaaatgttttcgtgtcacctgacactcaccttctcttctcgccagtcttgcaggccacaccttactcctaccacatcttgccctaggttttccttttcttgcactgaaagttctcctaacttatgccatcctactggggaaaaaaataagtttctttttctccctgctacataactacattacaacacttaataatcccattcaggtccaaaatgcacatctttctctttgcaaatagttactatactttctttaaacattcttattacttattttgagaatgtttctattttctcagttttagcatttcatgagtctttgacagctgggtctcagagagaggccagttaggaattggacaatcgtcttaagcaggctctgggtttcctgtacttttctgtgcagtgcctgtgctgattaaactatgacctgcagtttttctttttacggagttcatagtggtcatttgaaatatgatgtggcattcagaaaaattactctttctcctgcagtttctgtgaatatattttacactgcagcaattgtcatacaaggcatataaggatttattcaaaaatttatcaacaatctgagatgcattggtaagaattacaatgaaaatattagttgttctttatatcactgcaaacaatagacaaatccttacatgcaagaaaacttgctatgatgtttcaatattgtaatttcagccaatctaaggctaaggttctccaaagtttaaatatggtatttttttttccttttagaaaatccccatacatttaatagcccagttataaacatactgcccatgtaggtctcctttacttgtgacctctagctgtgagagaatccttaggttccagagaccagtagttcactgtgtgctaaaggacatgctttagctactcctttgctactccttttgaattctttctccttttctaagtgggcagctctcacccgctcattctctgggctttgcatttagaatgattggtcttccccactattattttagacaattacatttatcatgagaaattaatccttgagggatcaatgatgcgtgcttttctctggctcacaggaacaaaactattattcattttccacttgacataaagtgacccgtgaacccatttacattttcattcccctgctggcagtaccagtgaagccctttgtcagttatcagctagtagtgacccctgcaggcacagccaccactcagcccagggaggactgcttccggggcaggtcccctaggtgccaataaagaatgcaaccattagcccacatgtagggacctaaataacgctggtcagggtcttgggtctacctatgtgaagcaaacaggcaaatattaacaattttgctgtgacctgtatttgagtgataaaggtgtaattcgaagtgaagaactatgagagctggggcatttgtcattggaacttttccattttctctctaagggtaactttctttcatttttacaccctctaccctgaaagttgtcttcagtcttcagtcactgcccctgtattccatgccattatattatgtcatatattggtgactcctgtccctggaaaatttaatgagaaatgggaacgaaaataatatcgtcatggtggaatgacaggcggctgatattgttgagctagggaatgcttgcaatgctgagcacagccacatgtgccagaaatagggaaatgtatgacacaagacacagtcttgaggtgctcatgagctattaggaagttgcagcatgatctcaccatctgaaaatgaaaaatgaatcattctctggggaatgagctaaatttgactcctgaaatcaccatggtgccagggattacggtctctgaatgtgctacagacttggagtgactaatgagctgcttgaggtcatagagagacttaggcaattaaagacaattaatgcacattatcttgcttaaaacatagaaaatgatactccagttacgcagtggttacttttgtgacctgtttagataactctaaacaccatatttctcctagattttataatcttgttgttcattcagtataatttgttttctaacataaacttgatctttactgttgtgagattcttgagaacagagacactgtatgttatttcttctttatattcccagtgcattaagagcttccaaaacagtagatttttgctaaataagataactgttgaacaaatgaaagaatgagcaactgtagagctgtgttttgtgcattttctttaacacagtctatttttactgctgccgatctttactgttgctgatcaacctgagttgagttcatatttgagtgcaaaattcttcttctgactaagtaaggaatacttgagatgatgcaggattgaaggttcctaagtttatcagtaagggagtaagggagtcagcatattttaacccactttgggtaaaatatgacattgaactaagagacaaaaaactacaatgaaattagttaacatagtttttttgtttgtttgtttgtttgttttttgagacagagtctcgctctgtttccgaggctggagtgcagtggcacgatcttgactcactgcaacctccacctcctgggttcaagcgattctccttcctcagactcctgagtagctgggattacaggcaggcgccaccacatccagctaatttttgtatttttagtagagacagggttttgccatgttggccaggctggtctcgaacccctgacctcacgtgatccacctgcttcggcctcccaaagtgctggcattacagcatgagccatcgcgcctggccaacattatagaattttaaattaaggacatctgaaagataattgagttcaacatttcacattcaccctagactgctctcccaagatcaggagctactggagattttgaaggaaaacaggcctattcctaaaatgtaaaaagtgagcatgaaaattgcatctgatgatgacattcaggagaaacagttagtgtgcctatgcaaggtgatccgtgtgggacagagccaggactattacgaagcacttgatacctcaccacggaggactgatgagaaaattcattataaagagtttggctaccgcgaaatgtaagttgacttctaaataaagaattcaaatgaaataaaaatgatcgacaaaagttgactagaagttctctaaaatatatctatttctaattttatttcatttgataattacctaaattactctgaatcctaccttcaattttacttgtctttgtttgaacagtaattcttttgtctcaaatgtcatgtatctttgcttaatgccatgaaatttagccagtcttaaaaatctttgatagaggaaagaaaaatgtcctaaacatgtgttatttattttacttcctgagtctcaaaatgtgttttcatattgtgcttcaagtgtcatggtttagtttttgccttactcatttttaatatatctcatttaatagattaatattatattcccttgtaacctgcttatttcaagaataaaacacaatgtcttaaatagtaacacaattaattcagatttttttgacagcacgatgtatagtgcctaaatatattcagccagatttaaaacagggcataataagtaaaaaaaaacaaaatttcatagtgttgaaaaatcgatttggtgtttaatatttatttagatttataaaaattgtttcatattgtcccttgttatcactaagcaattaaagcattgctatctgagtagaactgccttggatattgtgtagcttatgaagtttaaatggctcaacactgtaggattctgatttgcaaagaaacagtctgaaagctcatcttcccaggctggaagacactggtttatttatttcactgtattaggcaagacaggatgatttttttttttatgttgagtggatgccttttggaagattagaaaactctgaggaagagggttctgaacaacaagccatctcaatttactgatcaccagcagtggaggcaaaaaatgagaaaatccatgagtttcctcttgatctattaaagtcctatttgtgatccaaatcagaattggaaactttcttcatagccttagtccactgtttctgaattaaaatcacttcatcatggtgttattttgaatactgtgatcttaattaagatccaaaccttagtgaacatttggaaaacaatagaatttgctgcaaagtgttacaaaaacatgcaaaatttctaatcattgtcacttactaatgaagtttatgtttctgtaaaagaatagcctgtaactaagtattctttggggttgtctttaaaactgatttgtttaaatttaaattcccagatgtcttaatagaagacagtaaagtcctaaaacaaaggtattcactgtgttcagctccttaacaccaagtacagatcaatttgttagctgcagtgttggatatcttccagcactaaaactgacaaggtgatattaagataaaatatattacctcctttcagtgttaagatatcttaaacctggaactggactcagaggaacaatttatgtagaaatggttttccatgagtgtagaaatagtttggggcaaatgttaaatttttgaacaaatgtttcctgaatctcctttttatgtacagcaggggttcacaaactctttctgcaaaggaccagatacaagtattgtaggctttatcggtcagccaaacgatgtcagtttctgtctctatattcaaatctgcccttgtggcatgaaagcagccatggacaatacctaagcagatagtcatggctgactgttccaaaaaaaaatgttatttactaaaacaggtgactggccagagttgaccaacccctaatgtagaacattgtgttgagaatcgtttaggaaatgaatttataaaaaaaacaaaacaaaacaaaacaaaaaacagtgctactcccctcctggagcttatcatatgatataaatcaaagaagcttatgcataaatacttaaataataagtaaaacttgaaatgtacaagagaagaaggtgcatgataagagtcatgtaagaacggcaggaaggtggggtccatgtgtacagaggagagggggtgcaatcatttaaaactaaggaagaattgcaggcactcaaagctgtcaagcagtaccctgatggatggagactgccctgtagagaagagagcataatggaaccctgggagagccatgttctttccacccatctcacagtctttgggctgctttgttcttctctaaatgcagagtaactattcatatcactgtcttatagaggaggatgctaggaaccagtgttggacaaattagcagagtcagaactcacattgggtttttcttacttcaaatccctcaggattttgcacaatacattcttgcaggtcattcaggcaaggtgtattaaattgcatttttcttgaatggcgtacactctagcctaactaaacatgggtattttgttgtactaaataggagtaaaggttgaaaattttgggtacaagcagaagttggatggttttgaatgcaaagatgtttgaagtttaggtgggaaatagaagaggacccttaaaagttttaaattatagaataagataattaaaatgatgatttatagagaggtgaatctgctgaaatatccaggctatagaaaaccgttatgtagtgcttgactaaactttattcagagggataatgactaagaattagacacatcatggaaacaggtatgtgaggggtcgcacacttttgagtacaacaggtgtcatttgcaggaatatacacatgaccatggttttgagaaaccttacgctagactagcaagaacttcaatcttccaggtatctcctctaaaatatcattatggttgttcagaggtaacccttggcatcagttctgactctctcatgttctgcttctcttagtgaagtggaagtggatgtcacctttgtggctggacaccacaatttctgctccccatagagctccacagtggtgctccttgagcctctctagttgggtctaataatggaaacgtaaattatttgggattgtcattgtctctgtacgcaacttctactttaagccttatcagtctcactcttactccttctggtcttagtgtaacatgcacagagatgaacaggaagaagtattctggtagcatgattgggaaaattgtctactcatctgtgtatgctttatgaaaggcacaaactctctgagcccaaagggttatcacccatgcctgtacaatatttcccacttagacacacactcttacatgaaaattcatgtataaaatggaattctcctgccagggagcattcactgtgcccaagagctcaggctgtgcccagaaccagctgccgcctttgacgtaggccttagtgtggaaggtgattcaccagtttactcttttaatatctgcaatctggcctccatttagggctgctcaatccaccagatgaatatttatatctttgagctactattgagggtttcatccccagccatttctcctacagacaaatgattcttaggttcctgtgttacacagtatgagcaagtatatatggaggatggggaatgacgaacacaagcatccaattcacaatgcaaatgtactcaggaaaagatgatgcttgattattcattagcagggtttgagcttcagatcaaccagaccatatatcatagcagaaaaaccttttctgtactcctgcctcagcaatatctggattcaatatctagttcagcctaaatctattgtatactaaatagtgtaaaagaggtatttaatagataatttttaaaaagcaaaaccatgatcacacaacgcatggtagccccaaattgtaatttcttggaggtgggacacaggcagccaaaaggaagtgaagcacttggtagaatgtacatgaaacggtgcacagtagttgatgctgcttgggtgaaaggaaggggaaaaatctattgatcacagaagatcaatgtttagtgatctggttttgtgtgtcagataccttactaaacgtttttacattggacctcatttaatcttcatgataggcctatgtgtaacaaattgttgaataacttaaagatgtcaggtggaaaatatgatttcatttgttctttaataatttttattgatgtagactttagtaacattattacatattatgttcatatgcatgtaacctatatatttcctttcaaacaaaactatattcttgaaataaaagttaatactaatcctgtgaagaaagtcattggtagcttgatggggatggcattgaatctataaattaccttgggcagtacggccattttcacgatattgattcttcctacccatgagcatggaatgttcttccatttctttgtatcctgttttatttcattgagaagtggtttgtagttctccttgaagaggtccttcacatcccttgtaagttggattcctaggtattttattctctttgaagcaattgtgaatgggagttcacacatgatttggctctctgtttgtctgctattggtgtataagaaagcttgtgatttttgtacattgattttgtatcctgagactttgctgaagttgcttatcagcttaaggagattttaggctgagacaatggggttttctagatatactatcatgtcatctgcaaacagggacaatttaacttcctcttttcctaattgaataccctttatttccttctcctgcctaattgccctggccagaacttccaacactatgttgaataggagtggtgagagagggcatccctgtcttgtgccagttttcaaagggagtgcttccagtttttgcgcattcagtatgatattggctgtgggtttgtcatagatagctcttattattttgaaatacgtcccatcaatacctaatttattgagagtttttagcatgaagcggtgttgaattttgtcaaaggccttttctgcatctattgagataatcatgtgttttttgtctttggttctgtttatatgctggattacatttattgatttgcatatattgaaccagccttgcatcccagggatgaagcccacttgatcatggtggataagctttttgatgtgctgctggattcggtttgccagtattttattgcggatttttgcatcaatgttcatcaaggatattggtctaaaattctctttttttgttgtgtctctgcctggctttggtatcaggataatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcggagattcaacttcttcctggattagtcttgggagggtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttaattcttctctcttttcttctttattagtcttgctagcagtctatcaattttgttgatcctttcaaaaaaccagttcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttctgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatgtctgatcttttacatttgctgaggagaactttacttccaactatgtggtcaattttggaataggtgtggtgtggtgctgaaaaaaatgtatattctgttgatttggggtggagaggtctgtagatgtctattaggtccgcttggtgcagagctgagttcaattcctgggtatccttgttaactttctgtcttgttgatctgtctaatgttgacagtggggtgttaaagtctcccattattattgtgtgggagtctaagtctctttgtagatcactcaggacttgctttatgaatctgggtgctcttgtattgggtgcatatatatttaggatagttagctcttcttgttgaattaatccctttaccattatgtaatggccttctttgtctcttttgatttttgttggtttaaagtctgttttatcagagactaggattgcaacccctgccttttttttggtttccatttgcttggtagatcttcctccatccttttattttgagcctatgtgtgtttactttaaagttcatatggcaccaaaaaagagcctgcatcgccaagtcaatcctaagccaaaagaacacagctggaggtatcacgctacctgacttcaaactatactacaaggctacagtaatcaaaacagcatggtactggtaccaaaacagagatatagatcaatggaacagaacagagccctcagaaataatgccgcatatctacaactatctgatctttgacaaacttcacaaaaacaaacaatggggaaaggattccctatttaataaatggtgctgggaaaactggctagccatatgtagaaagctgaaactggatcccttccttacaccttatacaaaaattaattcaagatggattaaagacttaaacaatagacctaaaaccataaaaaccctagaagaaaacctagacattaccattcaggacataggcatgggcaaggacttcatgtccaaaacaccaaaagcaatggcaacaaaagacaaaattgacaaatgggatctaattaaaccaaagagcttctgcacagcaaaagaaactaccatcagagtgaacaggcaacctacaaaatcggagaaaattttcacaacctactcatctgacaaagggctactatccagaatctacaatgaactcaaacaaatttacaagaaaaaaacaaacaaccccatcaaaaagtgggcaaaggacatgaacagacacttctcaaaagaagacatttatgcagccaaaaaatacatgaaaaaatgctcaccatcactgtccattagagaaatgcaaatcaaaaccacagtgagataccatcccacaccagttagaatggcaatcaataaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcctattactgggtatatacccaaaggactgtaaatcatgctgctataaaaacacatgcacacgtatgtttattgcggcactattcacaaaatcaaagacttggaaccaacccaaatgtccaacaatgatagactggattaagaaaatgtggcacatatacaccatggaatactatgcagccataaaaaatgatgcgttcatgtcctttgtagggacatggatgaaattggaaatcatcattctcggtaaactatagcaataacaaaaaaccaaacactgcatattctcactcataggcaggaattgaacaatgagaacacatggacacaggaaggggaacatcacactctgcagactgttgtggggttggagggggagggatagctttaggagatatacctaatgctaaatgacaagttaatgggtgcagcacaccagcatggcacatgtatacatatgtaactaacctgcacattggtcacatgtaccctaaaacttaaagtataattaaaaaaaaagttaatactaaagaaagtcttttttccctaaaatattattgtacaaagagagaactcttaataaatgttgacctctgacagaagcttaatttatcctaaagcatttattaaacatctattgtgtactaaaaattggaaaggctttcttttgaggaaaaaataaaaaggcactatatttgttctcaaacactagcgatatgaataataggtgtctatatctgagaaaaatgcagaggaaatagaagggttatctaagtctatttgggctcgtatagcaaaattccttagaggtggatagcttatcaacaataacaaaaatgaatgtctcacagttctggaagctgggaagtccaaactcaggttgccagcgtagtcaggttctgctgaagaggcttttctagggagggtcctctggtgagggtccttttctgtgcagattgccaactccctgttgcatcctcatatgggagaagtggagaggggtcactctctggcctactataaaaaggcactcattccattcatgagaactctgcctgcccttgtgacttaatcacttcccataagaccccacctgctaatacccccacctgctaatacccatcatggagttttgaactacaatatatgaattttgcattcagaccataataaagagtatatttattgcttatctaacgctctgttttaatcctaagaaatttatatcacgcatctacttcgatgctatagctagactaatacatgttcatcttcgtgcattttcccatatatgctattttacttccatctgtacttgaattttcttagtggcttgggtaaagccttgacatgtacacttgttaaaatggcctcttgatgactgacaagataaccagctacaattaatggtcattgtaatgttgagggggaaaatcatccttgaagatgattagatactaaatgaattagcacacagcatatttaaacacaagtatcaagtcaacaaatatgattttatcaatctttaataattttactaacctttattaatgtatattctagtaatgatactatatactatgtacatatacaggtagcctagtatttcatttaaaataaaattgtattcttgaaattaaaatcaatacagaggaaagcttatttctctgaaatatttacaaaatgcacaaatttttaaatttcaaaatttaacatttgtgttttattttaatgaatacaattttcaagtatgttatatgtacagaatggaatacatagcacaaaagaattatttactatctgtgtatgaacctaaactgcatcaatgaccatataaagcaggtaatataatttaaaataaacaataatgatgtaacaaattttttcatatataaaatgaaaattttggagattaacactgcgtctgcctttgtgggtgatttattccacagagctctttcaattgtttagctgccttgaatcttgtagcttagttataaagagaagtttggaggtaaatgttctgcagcattcaaaaggcttccttgaaagccatttaatgcttgaaaaccttttattaatgtatttgaaaatagtcatgttggattggaatatgagagaaaaactgatttggttgattttcctggctcatcagttttgaggttattgtaactaacacacctcagtcagaggcactaatgaattaaacacacagtgtttgattctgtgctgtctaataccatagcaactggtcacatgtggctatttaaattagaaattcacattaaagtaaaaattcagtttctcagtcacactggttatgtttcgtttctctctctctcttttttaaaggaagttttgctcttgtttctcaggctggagtgcaatggcacgatcccagctcactgcaacatctgcctcccaggttcaagtgattctcctgcctccgcctccttagtagctggaattataggcacgtgctgacatgcccagctaattttgtaattttagtagagacagggtttcaccatgttgaccaggctggtctccaactcctgacctcaggtgatccacccgcctcagcctcccaaagtgctgagattacaggcgtgagccaccgcgcctggcccacactggttatatttcaagcactcaatagatacacatggtttgtggcaactaatggacagtgcagatgtagatggaacagatccattcacactgaaagtactattagccagtattattgtaagatgtacgataacctcctttgcaattttatttagtcaaaagatagtaaatgcagtgtaaagtcattagagaaatattgacttttaaggataattaaaaaccattaggataataaacctatgttaaggttattcctgattaaatcaataccatcatgagacatattccaaagatccactgtgagatgctttatggaaactctaatttctaactaaaaaggcatgatatgtgaacactcatagcttaataaaaattatagttaatatgaatggcagcctgtcatcataaacatggttagtaaatttcctggtatccctctcatattcttcccaattggcatcattcatgaagtttctgtgtgattagttccaactggatttccaaggtgatcccccttttctaaaagaaataatcataatctcttccctttgccacaatgatgacttcatgaatatgaattgagctcaggccccagtcctaccatgaattacattcctcctatgatgccgcttgattcaagggtgtacaagagcttcataaggtcaaaacaaagtgaagtccagcagttttgctttaggatgagggagatagattctcacttttaccggatgctggggtgtgtggactgatacccagaataatcatagttatgttgttgccctgaaaggtgctagcctgaagatgaagacatatagaggacaggggatgagaacatcacacactatcactaaaaatcagttacttgggctgggcagggaggctgaggtgggtggattacctgaggtcaggagttcaagaccagcctggccaacatggtgaaaccccatctctactaaaaattagccaggtgtggtggagggcacctttaatctcagctactcaggaggctgaggcaggagaatcacttgaacctgggaagaggaggttgcagtgagccgagatcatgccattgcactccagcctgggcgacaagagcaaaactccgtcttaaaaaaaaataaaaaataaaaaaataaaaaataaagtcagttacttatttacctttaactatagatgtcaaatttagagttagattttctgttatgtaaagtcaaaattattctgaaactcttaggtatgtgacgacttgtaggcaaagttatctctccaaattggaaattagtaatcttatttaaatagagtcttcacatttagtaaaagcatattgatgttggtacatttaaattgcaaaataaaagaatgacttactctttagaagcaagaataggactgggcacagtggctcacacctgtaatcccagcattttgggaggctgaggagggtggataacttgaactcagtggtttgagaccagcctggccaacatggtgaaatcccatctctactaaaaatacaaaaattagccaggtatggtagcagatacccgtaatcccagctacctggatgagaatcactttaacccaggaggcagaggttgcagtgagcagagattgtctgggtgacagagagagactctatctaaaaaaacaaaacaaagcaaaacaagaatagacagtatattcaccaggtatacgtatattaacttctattaatttaatattttcgcaaatagttgtttgaagtctctggtttaggatagaacagaagtacatattttgggtgatatctgaaaaatggactctgaagggagcacaaggagagagaatccagagtgaataagacagtagctcacggctgggcgcgttggctcatgcctgtaatcccagcagtttgggaggccgaggtggatggatcacctgaagtcaggagttcgagaccaccctggccaacatggcaaaaccccgtctctactaaaaatacaaaaataagctgggcatggtggcaggcacctgtagtcccagatactcaggaggctgaggcaggagaatcgcttgaacctggcagacagaggttaaagtgagccaagatcatgccactgcactccagcctaggcaacagagtgagactctgtctaagaaaaaataataataaacaaaaaaaatagtggctcatgtttcacaggcgcgtaatccacatcactgctgtgcattctgagagtgcaggcgtgaagtatagtcagttcgggattgtaatcagggtccttaactgaaagatctaagggaaactaagatgttttacccctcccaccctagacacacagacaataacagcggtgataaatttcaagatgaaatcacagatgtgctcctccatctcccattctcaaaattaggaaggctttattttgaggtgccagagcacacattaggggacatacaccttcctaggtagacatttcagatattttagagagcatgtgaattaagaacttgaagtcccaaaatagtgtttaaagacatatggtaactagcagaggcatgaaaacgctatttttatcagcaaatcccagggaaggatggggagacagatgatcctgtaagggagctaaatttcttacctttcatggcatagagtcaaccacttaaagtctaatgatgatgagcgaagaaaccggtatgtaattattgaggcatcattgtggacacaaccaggaaaataaaatctgaaaacaggagcccttaaaatacaatttgaaatatggtgtcaagtttgttggagatttgttaattcaagtggtgagttaacctaaaaatatcacagaggccaggtgtgaggtaaaaacacaaactgttttcctgcttctctcgcactacaacagtgggcacagaaggcgtctgtgtgtgggactttctctccatgtaccaagtaagcaaccagttctgcagtggacacaagctgactgtcctccagcccagttgcattctgaccctgtctatctggagagagcctcagatcccacagggtgagggctccatcccacaggcctgccctccacttcccatgccagttgcaagccccaggctcttttacctgtgcttctgactgaccagctgtaagtcagggatcccaccacctcctccttgggtttgattaatttgctagagtggcttacagaactcagggaaagacttatttacattttccagtttattatgaaagatatgacaaaggatacagatgaagagatgtctagggtgaggtatgcaggaaggggcctgaagcttccatgccctctttggggacatcaccctctaggaacctccatgtgttcagctgtccagaagctcttcgaaccctgtcctcttggaccttttatggagattgcattggacaggcatgattgaagcatggagaaatgtcattacacaagaagggtaaggtatagtcctcatagactgggtagcgaaacccggcaaagcctgtctgttctgtctgctctgtcgattcttcttggcctcgctgtgcagtattcttctctcccaggaatggggcaggactcctggaatgggggcctatgaacaacaatcagacaagcagatcagagaatttctttgtagccccctccaggacagaaaggcggaggaagattcctgccctggggagaaaaatgagtggataaaaggaagggaggagaaaggcagagagagtctgttttctgaggtttgctcctgaggtctaaagaaccccaacgttataacaaaggccacaggagttagagccagaacataaatgaaaatacatatataaaaaacataaaataataatgaaaaagggaggaggctactattgtttatgactcaatgtaaaacttgcagagagaaatgagtgaagaataatacttcaatcattcttctgtcttggtgttcacaacatagagacacacacacatatacacacagaatcagaatcagaatgaaggagacataaagataccatatgtgcatagatggacttcctgtaagaatgaatagagaaggaaaggaatagaaatgtaagagaatacaaacagttattccagtagagaatgaaacgatataattattgagtgatcgttcatggagtggttttggaagactctcaggaggagtctcctgtccttgatggcctattagccctttttgccacatgtgaaccctaacactctgaaggtgaaagataataacagacagtgttgagaccagagctaaaattgttgaacacataatcatgacagggtaaattaactatttcactttatcaaatgttttaataaactcttaaataatatgcattgaaaaactggcatttgatgtggaacattctcttagatactatattttataatttttaaatttatgtatgtatttattttggtgagcaactgaaaactgcaattgtcagtgaacttccaagtgaaatgcctttgcgctgtctgagttttagatcttcaaaagctcaaatgagtaatcctgtcaaattacatgggttgatatggaagagagataagtaaataaaactccactataatatttgtgtggtaccacacacatttggcttaaaaataaaaagggattgaagactgtgtaaagaaatggaattttttaaaagataagataggagtaaatatagaaaaggtcttaaatgacttcaggcagtgaagcaaaaagcacattcccttgtttcttcctgtagaatgataccctagaccaggctattagctgtggataggagccctttatagttcagcaaactattaatttatagtttaccctttcagctaagacattgaagctattctttaaaaatttgagataatttgactatttaaaaattcaactacctttgcaaaatcaaaacagatctgttttgtaagaggtttgccatttcagcatctcactgcaagtgataaggtggttcagtgtttaaccaaagatcatggccacttgacccggtcttcaacccagcgctgtgccaggctgcacatggagggcaccagctgagtatcaccagccaaaggactctttcaaatgacaccagaaaagcctgtcctgttcagaaaaatgacatttccaggagttggaataatgctaaactacatggtctgtaaagtttcctctaagtaatatctaaggcactgtgagtctagccttgggaacatatttgtcaaaagactatttaagaaggggagatttttcagtcctcattgtgttctctctctccctctctctagttaaatgtatatattcatcaggtatttgaactcattttgctaaacatgggacacagaattaataggcattaatattttgtccaaatttagataataagatcatatatatataatatatatatttaactctcctcttgctactttactaaatatatatttattaatagaaatgagtattacatgttaatctctgaagatcccaaaataaataagaaagtgtccagcctttcaagtagctctcagtgcattggggaaaatgaatgagaaaagtaagttctactgtagtattaaagcaagagtgtgaataaaattttgttacagttaaacacagagcacttttaaaagtttgagattttgagtaaggttaatttatggtttagctatacctcctgtggaagttctgaagatcttattgattttctacatttggacaaaacattaatgcctattaattctgagtcccatgtttagcaaagtgagtccaaacacctgagaatcaagtgactttcccccagtattgattttgttagtggtaacaatttgaagatctccttaactcttctgttctcccagttgtctttactctaaatgttgccctgtgtatttaaaacctctaaaatccacattccttcccatagcctgttccctttctacttccctggcctcgtcttatactgtgtatgatagccacactggccgccttctatttttacaaagattgctgtctcttttatacttgatgtttccctcttcctagaatactactccctccaatctttatatggctggctccttcttattatccagatcgcatctcaaattgtctccacagagagtgctttattgatactcaaactaaataacaacacccttgccccacaattacatttcattccatgtttttccattattacaatttaaggtttcacagcctttgtgtctgtaattattttatttgtttatcatctggtttcctctaattgaaataggtccgtgaaagcagagtgtgatctctccaatcctgtatctccaacactatgagcagtgttgagccataagtccaaaaaaatgtttgttgaaggaagaaatacttctagttcccacaaattatgcaaagggtaaagtaaaatctgtctaaatattatgagggcaccaagagggttacatttgtaaaaagaagaaataataactatgtaagctgaaaactctgtattactgactccttataagaggactataaaagagaagagtaaaatataaatcagatgatgaaggtataatattttcacatgttttgttaatatttagtttaacctaagtcatgttaggttggtgcaaaataagtgtggctttgacattacttttaatggctaaactgcaattacttttgcaccaacctgataaatgtaacctttttccaggtggatgtcctagttggttagtgatgctttttccattagatttgaagtcattgacgttgtccaggaaaagaaaagagcccaggacagagtttttggaggatatgaacaggcagaggaggatgaaaatgaaaagccagaaagattaataggaaatcaggtggatagggggatgtggtaatgttggtgggggttacctatgtagttctagtaaagaaaccaaaaggcaaaacagaatgtcagaagggggcaagtgatcaacactattaatgctatgaaaaagctaatacaggtaaggactgagctgtatgtgtcggtgaaactcaagctgctgtaacacataagtccttgattgacaatggtttgcccagtggaaggttgattctcaggagcagaacagtccaggtaatcttggttggcagggagctttgtaataattggagaccaggtgtggaatctgtttttgagtggctataacaggatacccaacactgggtaatttataatgaaaagagatttaatgggctctgcagactgtacaggaagtgtggtacaaacatctgtttctgctgatgtcctcaagtagtttccagtcatggcagaaggggaaggagaaacagatgtgtcacgtggcaagagaggaagcaaggtgggaggtgccatgctctttgaaacaaccagatctagcatgaactgacctatcaccaaggcaactgcgctaaactattcatgatcccttgtaatccaaacacctaccaccaggccccgcctccaacacggaattacatttccacatgagattctgaggagacaaacatcaaaattatatcatcgggttccttccttcttttggcctcactctattttagggttccagagtcccctacattcagctactgagtgtggaaaacagacaagagaagtcacaactgctttttctaccccttagcctagaaattatacacatcacttctactcatattccctaggcacaaggtcccatggttatgcaaaggagccaaaaaatgtagttggtagaagcagctatttcttggatatagatttatattatggaaggagaagcagaaataatgatgggcagtgacccatcttctgtgatactttagaaatttgtgcaactaagtcatttttcacttcataaatattgattgatctcctaaaaatataggactacatggtaatttgtgtctgctcccaaagagttataacttattggaagaaataagatttacaaatgaattatggtaattcaaagatatttctgatttattcgtgtaaattttgggatagaaaaatagatgagaacagtagaaaacaagtacatgtgtattactaacccagcaaaaatataaaccctttttactgctacattttgccattttcagaataaacttgcataaattctcctcattcttagctcaaactgtgctgctgattggattgaactacttgtatatgaatgtatcttggtgtgatacgtagcccattaaaaacctagtatggatttcttaactaaaatcctgtattcctaatttacgttgatttccatttttttaatctcaaagtaatatttcagttttattattgggtaaacaatgtgtattctggcttagaacactttaaagttatttcagaagaggtcacaggggaagaaagatccagaaaagtggaatattttcatgaatcattaagttaataactttggaggaggaaggtatgtctagaaaaggcttaaaacaaaacgattagacttactttaaatatttttatttcaaattaagtagatgaagatggtataaatcaggagttagcaaaccttatattgaaaagggccggacagtgaatactttaggatttgcagaacgcatataatcttcgtcacaaatattcaattctgccattacagcatgaaagcagacatcagagacagggcaaaagcataaaccagcgagtgttaatgtatttcaatagaagtttattaattgacactggactttgaatttcatacaattttcctacattatataacattattctttctttgattttccctcaccatttaaacatgtaaatggaccatgcaaaaacaggtggtgggctggtttggcccataggctataacccctggtatatagagccattaacataaaaatacaatttaaagctaatttagaaaattttacccaaagctgtgtaaattataacacattaattattatattctacatactcatttagggtggaactttataaaatatcttttaaaaatatataatatataagatcatgttatgtactacaaaattttaacacaaacattaacaccccattctttgtgtttttttgagaagtttttgttgttacttacacgaatgaagctataggaaattatcctaggtcagttcaacagaggagacattttcagtcttgctcatgtttagcactctttgaaagtcttgatgctcaattagtcaattagtagccgccagatggagaagggtatttcttcacaggaacacgtgttgctatgtgtgtgattaagagggtgaaagatgctgttgtgtgtcagacctctctgtgttccttttagatgtcactagctcaatcaccaagggcaatggaccataagatacttatgtatcttctgcttggcttcatgcttgatgcctctgatcagactcagtgtttcatttccagtatcacagatgacagagtaaaatgcaaaatgtgttgctgcacatgtcaaaaggtccagagaagaaaagacagctctacttttgcatttggattaacagcaattgaaaataaatgcccatttccaattctttgatattgtttaaatttatatgtttgatatctgtttgttattatctacacgtatccagggattatttgcctaagctgcaaaattggaaaaaaaagtacagatttagaaaatatgctgccaatggcttaattcagattcattgttaaaccacaatattaaagtacactgttaacataatgtacactgatagttttgtttgataattacctacttgaaatagtagactgataaattgtcccaattggagaagaccttcaaccatctatgccaaccttctagactgcaattattaattaatcatttctggaacaaaagctcctaaaaatggcttttaaaattgtgttttctgctgaaagattctgctgaatggaagtgggagtgtgaagcctaggaaagaatatattcatttcatgtttttgattagctctgaaattttatttaccctcttacctagaggaagagtgccagtgtatattccctaatcctctgctcaggaaattcaacactttctgcaatttgtacttgaaaaaaggtacacaattttagaaaacatagacaaaaaaaacagaacaaaaccaaacaaaaggcaattattgatgtgaagcaaaaagtattaatgcactaaagagttgcttcaggatgcctcccttgccccatcgctacacacaactaccctacaaacgccaagattcaaatgtgatactctcttccatattacatttgaatcttctttttccaggaaaagcagagtatgtatgggtgtacccatagtaagcatgagggcttccattgtttttccatttggcgagttgaaaaacaagtgtgctgcattctcctgtctgttacggtacagatatcttcattggagcactatttgtgaagcacacagttttcaagtcttctagagcaaatttgtttgtcaccatcagaagggctggaaataaaaatatgtttgcaattgacatagtgcaggaactggttaacagcttcaaagaatttataaagaatatttgtctctgaaatgttataaatacccatggtgaaaaagacctacttagaagatgttttctttaatattcattgtgttttaccaaatacagtgaggatatatgagcaattagaaacatgtgcctgcaggttggctcttgctttctttgcagacctactgcccttcttgttcttcctctccatcattttcattgccttgttaagatttatctggccaggcgcggtggctcatgcctgtaatcccagcactttgggaggctgaggtgggtggctcaactgaggtcgggagttcgagaccagcctgatcaacatgaagaaaccccatctctactaaaaatacaaaattagtcgggtgtggtgggacacgcctgtaatcccagctactcgggaggctgaggcaggagaattgcttgaatcctggaggctgaggttgtggtgagccaagattgtgccactgcaatccagcctgggcaacaagagcaaaaccccatctcaaaaaaaaaaaaaaaaaaaagatttcttaacctgcttttccctccgttgcttttgcctgtttccctttcctagttttcactttatttttttttctctctcctattctgttttttattctttgttccactttatattctcccttggtgtgaagaatggctgcagttttagtcatggctataagacaatgtcattttagagagctaatgtgtcctgtcattgaaaggatgagatgataacagaagtaagaggggctggtgtcctacatctccacggcaaggatttcgcccttctcccaatggtgtggttcattgaaatagctccacatcctcattaagtttatttttatagtatttctgtctctaatattttttccccatggaaagattaggttttctttttgagtccttctggctctcccattgtccctgtttgctggcagtggaaatgctataaatcagtattgaggtctggcaattttgcatgccgtcagctaaacataatgctgttgaaattcaagcacagttctttttaagtagacatttaattttagtagaatttgcatttgacagtttgaattcatgtgtttcagcatctgagtgaaatagccctctctgagttctaatggaatgaatttagtgaaattaaccttttgtcacaaaaacacactatcctaggcaaaagttttcacactgttttcagtcagttctatgtagttataatagaatgaatcttcctaatttaagtcatagaatgataaaagcagtgatgaaaagagaatgtacacctaggagtccttaattactctgtgaagtgccagcaataagtatgggacattgacgtgaaactccagttcattacatcaaaaaaaatattaatggtgagatgtctgacactgacaaaatacctagacataacaaagtgcttgtggaaaatgcttgaatttttttttttttttttttttttttttttgagacagtcttgctctgtctcccaggctgaagtgcagtggtgcagtctcggctcactgcaagctccgcctcctgggttcatgccattctcctgcctcagcctcccaagtagctgggactacaggcgcctgccaccatgcccggctaatttttttttgtatttttagtagagacggagtttcaccatgttagccaggatggtctcgatctcctgacctcgtgatccactcgccttggcctcccaaagtgctaggattacaggcgtaagccactgaatttttaaatttactcttaatatgtattcttgagctaattaatgagaaaattcaaacaatcatattcagtaaagttaaccatcaacacagtcgataagtttttcacaaatattctcccttttctttgaaataaagaaaccagatatagaaataagaagtttctattttaaatatttaatatttcttctggacaacattaaagctattaaacaatgccattggccaactatcaattgttaagtgtgtccaaaccctggcattcaatttttttccaagacacttaaacatttaaagtctgtttttaaaatcttaattatttttattaaaaaaggatttttttaagaaaaaatgattttttggtaacactttaggttgcaatttttttaattttaattttttttatttccataggttattgggaaacaggtggtatttggttacatgagtaacttctttagtggtgatttgtgagattttggtgcacccataacccaagtagtatacactgtactcaatatgtcgtcttttatccctcacccctctcccaccctttctccatgagtccctaaagtccgttgtgtcattctatgcctttgcattctcatagcttagctctcacttatgagagagaacatatgatgtttggttttccattcccgagttacttcacttagaagaatagtctccaatatcgtccaggttgctgtgaatgccattaattcattcctttttatggctgagcagtattccatcatatatatgtacaccgcagtttctttatccactcattgattaatggacatttgggttggttccatatttttgcaattgcaaattgtgatgctataaacatttttgtgcaagtatctttttcatttagtgactcatttacctctgggtagatgcctagtagtggaattgctggatcaaatggtagttctacttttaattattcaaggaatctcctcactgttttccacagtggttgtacttgtttacattcccgctagcagtgtagaagtgttccctcttcactccatccacgccaacatctatgattttttgattttttgattatggccattcttgtaggagtaggtggtattgctttgtggttttgatttgcgtttgatttgcatttccctaattattagtgatgttgagcattttttcatatatttgttggccatttatacgcctttgagaattgtttattgaccttagcccactctttgataggattgttcgtttttttctaggctgccactgttttaataaaatagtttttttcttttttactagatcattcttatgattcagttttactagcatttggcaattagcaattattgtatataaataaagttgtttcgttctctgaagaacctgcagagaaccctcgtctggagaaaaattctgtcaggtctaatatttgttaagttcttaacaaagaacctggaacacaggcaaagctcaataattttattaaattcaaactgcattcttgctggtgagcaaaaccagtgtctaaggacttacatgctacatagttctttgatgccaacattagatatagaatgattagcaaatacgttccaaaatgcttaattcttgtgaaaaatgtttcaaggtatacttgaggtattatccttttttgtaaaggccatttgagatgacaatttttgaactactttattttaaaagcatttattattaagaaattcattaattagtactcactgcaccctacttttagtcctgcataatgcacctgtatttttgtactaaaaggtaaatacaaataaatgaaaatgaaaatattgaactctaagtatgtcaggattcctatagacatttcacactctgagattatgcaaattatgataatcatgttaataaagatttggatgaattaattgttattcaaaatggattagtttgcaaaacttcaaattagtctaaaatggagagatttttctggcctcattctatcttcttcgcaggtctttgaagacagctgtgtagtatagttactgtgatgatattgtcacagaaataagttgaagcattttgtgtattttgtgtactaccaatgcctaaataactaactgaaaaatgtatatatattcatagaaagataccagggacaagtggaaagttacttaacaatgatgtgaactttgacatacttaaactctttcggtctcaaatttattgttcagtacaatggttaacaataaggtggttataactattttataatcatcctataacaattgagtgactgtaaaaatgaaataagataaactttcattaaagaacctagcatagtataatgacaggtacataaaagtcctcaagttttaattcttatccaaattcccgtaactctatttccaaggcctcaattttctcacgaaaggcctcttactttctgaaattctatgatttagtttttagttcaattaatattttagcaaatgagtaagttaatgaattaatatatttcctttagagtttactttctaatgcacatgctgttatggtcctatatgaggaaatgtcttttaatgtgcaatattaaaattcacggtcacataaaatgaataaagttttaatgtagaatataacatttttgaattctagaattcaacttaccagagaaagaaaatcttagaaaacctggttaaaatggcttttgataagcacattgaatataaaaacagggtatttatatatatatatggatatgttttctatcttattttcagatcgtaattagccactatataggttttgtccttcacagaggtagaaaaaatacatttaatcacttccaaaaatctgtttgagtcctgatagcctgatatcctttgaaatgcttaaactttgtatttggtatgattcgagatttcactaaattctctattgtccccacgaaaatgacttatttgggtagggggtatttcttatcttgttggaagctttataaaggatcagttattgtatctttgagctgatgaaatagtttaacactgctcaaaacttgtccaagatgctgatatgtatcttcagttagaccatttgaacacatgactaatacacagaccaaagagaacattgtttaaaagaaatcttatcaagaatcatgtaatagatcttaggctatttggatttcctcacaggaaaatagaagcaaaggcagtgacagcaatactcaaagtaggaattgagctctgctccatgtggataatgacaacatctgcatctgttgtgaacttgctcccaaatcggagccctgtgtttttcagcttcctgatgaacatttctactttgtactgcacaatcgcctcactgttaacattctgaaatccactcatttttcctctccatatttctttcttacacacctgttcttcttgtctgccagatgtttgctttatatcacaattgtcttttccccctaatcttggcaactcagcatcatctttgattctgttactgattgggtctgagatggagataagtatgcaggaggtttagcgtgtaggagcatgtaggggtgctcttgggatcactacctgtggaaaggaagggaaggaaagaaagaaggattgggaagagataaaacttgggatgcaatgtactcttaccaaagcctagagctgacctcgttagcagttttaaatctaggatgtcccttcagtactggcctgtgttggggtgatgggactgaggcttttgtctccactttggccagtcactggatacaggttgccccaggaaacaagtagtagatgtaggacaaagtgactttttctcagccaaagaaatttggctaaaagggctaagaagttcttcagtcaggaagagatcttgtcagcacataacagtatccactggagactcctttaacacaaacaaacaaacaaacccacaaaaagctattatacatgatcagatcttgttttcttcatgattttaaatttccaaatctcatctcttgctgcccaaccaccaatctaggttaggagcttatagtgcctaacataggcacttatgaataagtaggacctcctaaatcagatctatccaatccatcccttatccatcgcatttttcaacctcatgaaatgcttccatgagcccataattagcccgtttagtaactcgttggctctccattggcaacagaataaaatgcatttcttagcttatgattcaagaacaaccactgtctgtctaaataatataggtgttgtcaccccaatcttccaagcacatgttttgctttgttagtgccattgattttttttttttacatttaacacctaaaataaaagatctacttggcttatatggaaatcaaatatcacatagttatctggtcatatttacagggatattatgtccaataagccatatttacctacaattttacttaggtcctgtagagaaaaataaaaaataaaaaaaaaggggttgaggatttgcaagaggacatagttacacagatctaatgtacaatgatatttgaacttctgtggacttgttcttatgagtaacatcttccattttaattaaggtcagatgaaaactttggcattatccatgctgagtcctgagtctcaatcattcaatgaatgagttgctaggacacttagttcaattagctatgaggtatacacatggacagaatgttttacaaaacttggccctactgacttgagactctcacatgtattacaaaaacaagtgtatccccatggaggtctgactgtatatctgccttgtaagatcatggaatgttagttgtgtttaagttcctttaaccttctttctcaatttataccttgtttaccactaaaaatagacacctagccttagttgttttggttttaagattgtttcatttatgagtatatactattctgtggctgatttttttttctccctgatttctcttcccctgagttccaagtacttttcacaaagaaaaccttgttcataattaaacatttcttacctcaggcttggtttcagagagaaaccattcaatcaaaagagtgatggaattctgtcactctgatgttatttttagaagttgtttgggttttgattgacacatgttttgtggtctgtgtgtatgttgctggggataatttaattttaagacattaataagaaaagctcattgactcagtcaaagggaaaatgactttttgaagtcaccacacagttttaagaagggatcatagacaaggagaaaacggccaaggaaactttggtttagctggagtgtcgtgccatagtcagaggattctgggggaaatagaaagccctaagaattagttcatatgtgaaaccccacctgccattttggttgatttcctttcttatatcctataggcaaatttccagtgcctactggtttcagtttaataggtgagaaaagcataacacacataaataaggtttaaaaaacttttaaaggctcaagaaagaactaaatgcattcagaaaaaaagaaaaaattagatctagcccagtctgaaaggaaaaataatggcagttgaaatgttgaaatttgattgaaagatttgagatatagtatttgaaatatagtattctaaatcatttaatttagaataccattaatttttaaatattttgggattgaaatcagttcataatgtagctagagaatttaattcaaatgtaaaggaaggacacctgatatgcacttcaatatcattaaatttagaggtcagaatgaaggcagaagaagagagaaatgattctgcaggaccaacccatgtggtaacatatttatgcagaccaccccaacatgatcggaatattactgccacagtggggcacaccttgaaatatgatgaaatgtttcaaggttgttaaataagaaagaagttacgaacagaattgttttcatcaaattttcactgtgtaataacacattgtaaaaccaatataggagtggatttacaaattctgggcatacataagcctctctgatgacttagctaagctggttttgaaaagaaagtgcaacataatggtgaagattattcaattttgctcgtggaaacaattgggcacataatgaatcaagaaaaatgctgagatcgttgaacaacaaaactcaacacgatcattttttgaaatcttccgtgttgttatggtgatttgtgtatttagaacttaacaatgtgaatggcatgaagaataagtgattatgcattgctgaatgcctttacaagagttcgctaagaagaaattactgctttatcataaatgtattgttactgcttgaatgatgatagctgtatatttgtccctttactcactcagcaaacactattcatttcaaggttttggtgttacatcaagcaaaagactccaactgagaaatggtactattatatacacacacatctcccttggagggtttctgctatgaatcaatattatggaatgactgtgtagcataaacagtacatagcatcttttagataatcatatttagaaacagaaatccttttatatgtgtattgttatagtttcatgttaaagaaggtaaaaatcagcagaactacttttaaaaaaaatcttagagtaatacctccttcccatgagcgttagtaaagataggaaagatgatcgttttatgctacatattttcctattgccaggtcaagtattataaaatttaatacatattgttgtaggactttctccttagttcagctggaaacagtgttcttgtcacacaaccatgaaaaattaggctcacagacactttgaagggtgagaatggcagggtttattgggtaaaaacaaataaaaaggaacagggactctcagcaaagccggagtcctgctaccaggtttcctgcctcatagattgaatcccaggttccaccccagaacaggagaggccaggctcctgccccctgcaaatggaaagaacttaccggctccaccccattctccctgtacacaggccaattagagtttctctggggacccctttgtacctggctgtctcaatatgaagaaaaagtagtcatactaagattttttttttctagaaccaactatctaacataactgtcaataattagaaacaaaactgtacaaaaatacttattatataaatttttaaataaatccttgctaggactttgctctctgaaatttgaaagtatattttaaaacaaattaatgctttatctccttcctaggaatgtattcctcacattgtaacaagttgataaccagaattataattgctagtgaatccgttttcttattctattctctgctcacacatgttttaagatgccatgcggttaccagcagtgaatccgtatgggtctgcagcaacctcagttcttgcctcctccaaagaaagaattcaaccaaggaggcagaacgcaggagagatggaggcaatagagcatgagtaaaagtttatcataaaagctttagcgaaggaatgaaaggaaataaaatacacttggaagaaggccaagcgggtgacttgagagatcaagtgccctatttgaccttctgacttggggttggcatatttctagggtcttgcatctcttctcccctgattcttgccttggggtgggctgtctgcatgtgcagtgggctgctggcacttgggaggtgagcaagtgcagtgtgtttactggacttgtatgcgtgctcaggtgaggcattcttcccttacaaatcgaatgaacctagaaggtcatataacaagtaaactctgccattttgcttcttaaagctcatgcttgagtccactccctgaactcctgctgattgcatcaccagtttcaggttttttttctatctattgggagactgccttttcctggcgctggctgtgaccagttattattttagagaggcagttaacaaccacctgcccatcacctgatggtggcccgacattcctggtggagagcagggagagctccctcctgccccgctcaagccttgttactacctactgtaacagtgctatatagattgtcatgatgattttacaggtgtatacgtatccccaaattcatgaagttgtacatattaaatatgtacagcttttttaataccttattaaagtggtgtaaaaatagtcgtgctacatatgactattttgtcatggccactactgtcatcttgagcattgcaaattagttattctagatgaaacaaaaaaggcttgcctttgacaatttctcaacatgtttagtattttccaggttcaaccaataccactttgaactgctctaaatcaagtaagccagaatgtgtctggcagctgaactactgtgaacctaataaatattatcatcattttctattgctaatcaggagttgcattttaggcaatgcaaagtgggtggggtactcactttctgtagatgattcatggaactaacaatacataatacagcatcaaattaaaaacttatttaagtccaatctatgtgaaatagaacaagtgacaaatgacataggttactagtagtaagtggtaagggagctgggttttgatttttttttaaacaaattcttttctaatgcatttattgcaggcacagagcaagtaatcttaccatcagagtttttgtactgcactctattttccttttcaagaaaggaatttcatgaattgttttaagcacagctgagtgttattgttcctattttgtgcattactgttaaagttctcatttccttttcaaatgtgtaattttaaagacgtgatgaattcttaagaataattttatgatgattaggaaagcaatttttcgagctatatacaatttaaattttatagtgacaatcatgaaaaatagaaatacactttgcagcaaatttgcgaaattatttctgctaaatgagtgactcacataaagcaatttgggtttgttttattttattttttgtcattacatcatgcagctgttttcctctatcccaagaatgtaactagtgattgtaggatcatttcaaatactcaattgtaaaatggcagttttacatatctgtggtgatttaaaactctcacacacatgggtgttaatggaaactagttactttatgagtattaagataatttattaatcttaaatataacttttctcattgtggatgtttttggtgaacaaatacattacttcacagttatttttgtggtgagaacacttaatatcaactctctttgtgttttttaagaatacaacatgattattatctatggttgccatactatacaatagatctctcctcctatttagctgtaattatgtttcatttgagaacatctccacattcttccctccaaaccactccagcctctgttaaccaccattctattctctacttctatgagatcatttgttttttgattctacatatgagtgagatcatgtgacatttttctttgtgtgcctagcttatgtcactaaacatactgtcctccagattgattcgatttgtgataaatgacacgatttccttcatttttatggctgaacagtattccattgtgtatatatactatgttttaaaaatccattcatccattggtaacatttaggttgattccacatcttggctattgtgaatagacgctgtaataaaaatgagagcagatacctcttcaacataatgactttatttcctttggatctataccattaacaaaagtgttagatcatgcggtagttcaatatttaatttattctggaacatccatactattttctataatgactatattaatgtatattcccatcaacagttgataagacttctgttttctccacatccttgccaacacttgttatcttttttctttctgataatagccattctaacaggagtgacataatatctcattttggttttgatttgcattgctgtgatgaataatgatattgaacatttttatatgcctgttagtcctcttttgggaaatgtgtgttaatgtctttgcccattttaaattgagttatttgtattcttgctattgagttgtttcagtttcttatacattttgaatattgacaaaatttaacctacatttatcataaaagcactccatgaatgtatcagatgtgtagttaaccagatgtatagtttgcaaatattttctcccattcagtaggttgtttcttctgtcgattttctcctttgctatgcagaaacatttcagattttggtaattccacttgtctatttttttgcatttgttgtctgtgtttttggaggcatatttaaaacaaaacaaaacaaaacaaaacaaaccttgcccagaccaatgtcatggagttttctcctgttttgtttttgtttttgtttttttttagcagctttatagttttgcatcttatgtttaagtcttgttccatttttaattgattttatatatggtgagaaataaggatttagttttattctctgcatatgtatatccaatttatccaataccatttattaaagagactgttttttcccccattttgtggtcttagtgcctttgtaggaaatcaattggctgtgaaaaagtaaatttatgatttttttttatttctgtgaagaatgtcattggtcctttgatagggatcgaattgcattgtagatgactttaagtagtatagacattttaacaatattactactttcaatctacgaacataaagtcttcctttttatttgtgtcttcttcaatatgtttcaccaatttttcataattttcagcgtagagatctttcacctccctggttaaaatttttggagtatttttttatacctatcaaaaaggagattattttcttgatttctttttcaggtagtttactgttagtgtacagaaacactactgattttgatttttgtgttaatttttatcctgcacctttaataaatgtgtttgttagttccgacaacttttggtggagtctttagagttttctataaaacggatcatgtcagctgcaaacaaggatactttaactttttttttccaatttgaattccttatattacttccttttgcctaattgttctggctaggacttctagtaccatgttaatagaagcggtgaaagcagatgatatggtttggctgtgtccccacccaaatctcatcttgaattgtagcttccgtaattcccacttgttgtgggagggaccccgtggggagataacggaatcataggggtggtttcccccatactgttctcgtggcagtgaataagtctcacaatatctgacagttttataaggggaggctcctttcgcttggctctcattctctctcttgcctgctgccatgtaagaagtgacttttaccttccaccatgattgtgaggcctccccagccacatggaactctgagtccattaaacctctttttctttataaattatccagtctcaggtatatctttatcaacagcgtgaaaacaaactaatacagtggatgtccttgttttgttctagatctcaggggaaaagatttcatctttcccatttaatatgttagttgtgggattttcatatatggactttattatgttgaggtatttgtctatacctaattcatggagtgtttttatgatgaatgcatgttaaattttgtaaaaaggtttcttctgcatctattgaagtgatcatattatttttgttgtccactctgttagtgtgatgtgtcacatttattaattcgcatatggtaagccatcctttcatctctgaggtaaatctaacgtatcacaatgaatgatgttttccatttgctgttgaatttggtttactagtattttgttaaggatttcaaacctatgttcatcaggaatattggccagtagtttgtgttcagatttaattgtatcaggataatgctggcctcatctaatgggtttggaagtatttttttcctgtttcaattttttagaaaaatctgagaattgatattagttctttaaatgtctggtagaattcagcagtgaagccatgaggtcctgggctttttactgatgggagactttttatttctttttaatctccttattcaatattggtctgttcagagattctacttcttcataattcaatcttggtaagttgtgtatgttcagaatttattgatttctcctaggttatccaatttgttggaatataattgttcataatgttctcttatactattttgtatacctatggcattggttgtaatgtctgcttacttgtctctgaatatgtgttgagtattctctttttttcttactctagctaatggtttgtctacttcatttatcaattcaaaaaactaactcagttttgttgatcttttctaaggcttttgtagtctgtattttatttatttttgctctatctttattatttcctcccttccttcttattttagatatgggtttttttctttagtagttctttgagatacaagattaggttgttggagatttttcatatactctgatgtaggcatttattgctataaacttcttttttagaactacttttgctatatcccgcagaatatgttgtgttcccatttatatttgtctgaagaatattttaaatttcatttttaaattttttcattgtcccattgtttgttcagggacatgctttttatttccatttatttgggaattttccaacgttccccctgttattgatttctagttttatgtcactgtggtctgaaaagatacgtgatatgactttaatcttaaacttgtggaggcttgtttgatggtctaatatagcatctatcctggagaatattccctgtgcaagtaagaaggaggtgtattctgcagctgttggatggcttgttcttatgtctgtatacctgctatattcatttagtcagtaggacagtttcaacatgatgtttctatgttgattttcagtctggatgaactatccattgctgaaagtgaggtgatgaagtcgcttactcttagtgtatttcagcctatcgcttccattttattaatatttactttatatatttaggtggtcctatgttgggtgtatatatttataattattatatcatcttatcgaattgactactttataatgacctttttgtctcttttcacagattttggcttaaagtctattttatctgatataactatacctagccttgcactttaatggtttccattccctcatttttagtccatatgtgcccttacctgtgaaactgtctcttgtagtgcatttcaacatataattgagtcatttttttaaattcattcagctattcagtgtcttttcattagagaatttttttattatttatatgtaggaacttactgctgtctttttgttacttgttttctagttgttatacagattcattcttcctttctttcttactgctttcctttgtgattaagtaattttcatgaaaattgttttattctttgctttttctgttagcgtatctgttataggcttttgagttaatgttaccatgaggcttatgaaaatcatcttattgttgtaacaagttattttaacctgataacagcttaagtttgattgcaaaaaaaaaaaaaaagacaaagcaaaagcaaaaatgtttacatttttactcgactcctccctaacagtttgaatttttgatgtcacaatttacatcattttatattgcatatcgattaacaaataattttagttattattattttaataattttgtgtcttaactgtcatattaaaatgtttggttgctacaccatcatagagtaataaaatattctgaatttttgtgtacttacattacagtgagttttgtactttcagtgatttttgttttactcactggtgtcctttcctttcagcttgaagaactccttgtagcattctttgtaaggtggtgactaactctctgcttgtgtttgtctgggaaattatttatttatcttatttctgaaaaacagctttgcagggcatagtattttttgttgacagttttttcccccagcactttgaatatatcatcctgctctctcttagcccgtaagatttttcttcagatgtctgctattggcttattagagctctcgtcatttgtggtttgcttcttcgctcctgctgctttccaaatcctcttttttctttgattttgacagttgcagtataacttgagggtaatcttttttaaattaaatcagaatgaagactttttaccttcctgtaaatatttctatctttctccaagtttggaaagttttctccttcaatttttaaaataatattttacctttaactgtcattgcttttttttgaatgccaatgattattatatttgctcatttaaggttatcccagaaatcctgtaggctttctgcattttctttatttttatttcctttttcccctttgtatattttcaaataacttgtgtatcagtttagagaatcctcttccacttacgaagttcttctgttgatactctctatagatttttaaaatttcatttgttgtaatttttagctctaggatttctgtttgatttaatattattattatttcaatttattatttcctcatcatagtcacaatgttttcttcatacctttagctgtttttctgtatttttttgacatttgttgagcttccttaaaacagttatttttactttatcgtgaggcatttttcatacatctccatcttttcagggttagttgttgccaattacttttgtccctttggtgacttcatgttttcctgattattcttgatttttttggtcatgtgctgatgtctgcatactgtagaagtagatacttattccagtctttgcagtctgcctttgtctatgaatatccttcagtgttaagcctgtccagaggttaagagtgggccacctggtgtgatccttaagcccgtgaccactgcagctattgcagtactagggggtgccctatatcctgaaccaccatggctggtatagtgactggtcagaattttatggatacagagcctgccacaatgcagggctaaaagtccatgaattctataattagtgcggtgctagggtgtgcttgaagcccatagttgctgaggctagtgcagcagtgggtcatgtctaaatcccatgacctctgaggtctgcctgttgtggtaggttatttagaatccaaggctgctatagttggccagtagttatgtgaactagaatttgagtcattcttgcagggcctgggggttcctatcttgcactatggtgggtctaaaggatcaggctacagataccaggctaaaatcagagatcatgcaggtctacctaatgctggtttttactgtggtgggcctggtatttgtgtccaaggcaaagttctacgattgcttacctctctttctcccaagtgaacagtgtctctctctgctctgtgctacctggggttggaggttgggtaacatgggaaatgcaaaaatgtccgttctaccttttttggtgtgtcttttctaattattgtgctatgacaaggtacagtcatcttttacttggttttcgtagctcttgtgagatatttttacctatggatagttgtcgaaattgatgtttcttccggtgggtgatcactggagagtcttaattgacagtcttgctcggccctcctcaggtttgactattcttaatgtcctttttctattgggcacctttaaatggaacacttaaaacagacacgcatcttttaattattttacagatgagtaaaagaatcaaatgtgaatttattcaaggtaataaatattggtttaaagaaattaccatagatcttaatatagagaaaatcataattgtggcttacctataaagaaggcttggtgctgggcattttcttcttcattttttaaattctgtacgtctttccaacacaaatgccttctaaacactgatgatgctgtaattcttatctccagccatgaattcttcataaaatctgagacttatttccaaattcctctagttagaggactctagaaatcttaccaccccatgaggatagttataatgatctgaagtccaggttcccctgtaacaaagcttgtcaggtatttgaaaaaaaagaaaagatgtaacactgaataaaaaagaaacaaaatataaggaaaaaataacttggaataaatagaaattgtacaggggaaggaaagcttaaaaaattaatatttttagatagatccaaataatttatttaaaaatgctataataaatagtgtttggaaattaaaaataagacatggtaaattaaaaatgtaataggagacatttaaaaaaatagtcaatatgtttagagaaataaagttgagaaaggaaatcatccattaagtaaaacaacataaggcaatgtaatagaaatatataataggtagggtaataaagtgtgataacaaatattaaaataatgaaaattatacaaagagaaactttaaaagatgcatttattatataataatttactgtgagctatgtgttttcagaattaaaaataaaaagagaatgtccagccaaatggatgaacatacactcacatagagacatgtaattatgaaacttcagaaccataagagtaaaatgaaggttctgcagcttcctgtggggacaaaaacaacagcaaacagaaaatatatcacatacaaaggatcgaaactcaaaatggctttggactttccaacagcgatactggaagctagaagataatccagttgtgcctatagaattctgaaggagattatctccagtatagaattctatagtgagctaattattaatgagttgttagaatgaacacatacattctcagacaaacaaaacgtcacgaaatttaccccctttactttcatgccaagcaagctactagaggattatttccatccatttgggctgctataacaaaataccataaactatcaataacagaaatttatttctcacagttctgggggtcaagaagtccaagatcaaagtatgagcagattcattgtttggtgagggcttgctttctggctgatagatggtgccttctagctgtgtccttacatgtggaagaatctaacttgctctattgggtctcttcattagggcgctaatcctaatcatgagggcacttaccttagaaccttaacagctcataaactccccacctcccagtatcattatcttgcaggttagggtttcaacaaataaattttgggggacacaaacattcagaacatagcaaggatgttccttccaaaaaaaaaaaaaaaaaaaaaaagaagaagcagcaaactggaaaagaagacaaggatttagaaaaccaaaggactaacagaaaagggttgtatctctagcattatgaggaagagaagtcccagagtgactatctgtcctttcaaacaaagaaatgaataaggaagatattagagggagcataaagagagtgctacataaaaggcaaattaaattctgaggctgacaaaaaatgaaagtcctatattgacagctgtatagcatgactagagcagaatcaattccgatagaactgagttctccatgtaggattgcaagtagattacattatgtgattgatcttgtacgtaattataatgagagactactaaaacataagaataggcaaaccaaccccccccaaaaaagtagcaagttaaaaaggggctataaacaaaaagcgagaaaaaaataattattgtacactacactgataaattttgaataatacttgcaaagttatattaatacaaatatctaatattattaaaccaaaaaaggcaggataactaaactgctatgataaaaaatggggaatagaggaaataacaacgtaagagttaaaatctcaactaaaatcagtcaatagaaaatatttaaaattaataaatcaacaaatagatacgcatgcatattatttagagatatatataagatatatatacaagaatgccacagtaaagagtggataatggtgattttgagagataaagcaaagaaatgtctacttttgttaggaaccgtttaatgccatttaactggttgggtgcagtggctcatgtctgtaagcccagagttacgggaggctgagtgaggtggaaggactgtttgaggctgggagttcaagaccagtctggactaatatagtgagcccccatatttacaaataattttttaaaaattatccaggcatgatggtgcatatctgtagtcctagctactcaggtggctgaggcagaaagattccttaagcacaggaattaaaaattactgtgagctatgtttatgccattgcactttagcctgagtgacagagaccctgtctcagaaatttcaaaatatcatttaactttgtttttgcttgttaattaggtacaataacaatacattcaaaataagaatatatttccatgatatttggcgaggaaatatatttggttagatgtacaaaaaactattgaagaataaaatcgatgaattcaataatattaaaacttaaaactcatataccaaaaaaaaaaaaaaagaaaaagaaaaacggtaacaaaaataacaagaaaactacaggaagaaaatgaagccattacatagattgggataatataattgaaacttaaacaacaaatgaaatatttattttcagaatatacaaagttctaaaaataaaccagaaaataattgaccttgtagaaaaatgagcaattggtcataacagaagaaaaaattcaaatgtccaataaatataggaaaatttacaaatgcaaattaaacaaaaacatgacacttcttattggctatataggtaaaaatataaatttccggaataccaaatatttactggcaagtggggaagagaaattttgcctcatatactacttaaaagtctaggttggtacaatcacttttacaaatagttaaactgtcatcgtatggcggagttgaaagttaatattcctgataagataaatgttcctgataagagaatatttacactaacagaatcttagtttaattcacatatactgatctaattactgcaactcacacttttattattgcctttattttgtagatgagaaattgaagcatacagaattaattagcttctccaaggctacctagctagttttgcttgtgttaaaacgaatcaactagataatatggaatatactggaaaatatattgttgagtaagaagtaaaaacaaattgttgagagcacataacagtgataaatgtataaagttttaaaacacaaaataaagttttatgtgtatttaaataatacagtgacttattccaaaatcagaaaagcacagatgtggaagacacccaccaaactgaagatagtattggtctctccggaggcaggatcaaaatatcaggaagagcttcaaagctatgtcatattttattttttaaaatgatccaaaatatatggtaagattcaaatacttgttaaatctgggaggtgtgacatagttatttttgtattattctctctgattttctatccacgggaataggaatatttcataactttaaaaagggaaatgatgtaatcggtaacattgttgtctcctctttaatctcacagatattcctaggagcaacccttgttattttttatgatccatacacaataaccaatattttaaatatattatacaaaagtattgtagagaaggaaaaataatttttttctctaccctactgggttcctagctggaatagacccctgcaacaaaggacaaatgaagaacataaaagcaaaaagaagtttattaacttgtatacctcatttacatgtgggagatacccagaaaaatgagtaagtcaaagacatggcttagagattaggcctaaataccaccttcaactgaaacaaagaaagaaggatatgggccagggtgcagtgatggtaaggtgaccaagaaaagtatggtaatccatgataaattctattatgcagacttaaaccagtgccttctccactgaaaagagtctctggtgatttagttatccttttcttctgggtactgaaaggaagccacccttgcaaatggaacattcctttagagataagtatttctctttaaaaagagtaacttctacttcattttcagagcttctttgttgtctgcagtttctcaaaataatcagctcaaaataatccttatggagacatattttggggtatcctatcctggtttcctacagtatcatgtatcttattgtaggagggggatgatagtctttttattttacttattttagattctttttcttctactcatcatagagatggctctacccatctggctggagccctgtaaattacactggaaaaagacagattaacaagaaactaaaactaaatagaaatttattaacatgcacaccatgcacatgcatgtatataggagtacccagtaatgagtaatccaaaggggtagttagaatataggcttatataacatcttaggctcaaaaaagaaaaaagcgttttgggcttctgggcaaggggtactagttgggaaagtggctaggagaagtatactaaacaagggttgttttagtgaggtttgttatacagatttatgtaggtgtcttctcaatccataagatttaagagttatccattgcctgatatgggaaagggagatatcttttacaaatagaaatctcctttatacatgtaaatttattttacaaaatgaaaatttatgccctgtttttagagcttttctggtgtctgccattcctcaggggcctttagctcaaaataatgcatatgctaaagaggtgtattttggggttgcatattatgatacctttcaatataaatacaagaattaaatagatgacataaaatgcatattcagaaaaaaagaagattcctcctctcccacaagaaaaattaaatttattttctctaaactaaatcttttctgtattttgagttttaaagtgtgtgataataaggaaaatttatgagtataaaatatcttcatatacacttctagtcatcttccttttagactgtgagaacatgaggctcctgtcattttactatgtttccttgtaatgcttttgttactggggagtatggggtccttggttcctgtcttcttggaggaaagaattctgccaagtgacacacaggggcaattcagcaatggcaatgtttatttaaaggaaaaagtacatgctgaaagccgagtcagggtgggctgctccagaatgagatgcattgactgacactggggaaccccctttatgagagttttacatgaatatttacaaatgggcataaagaggtgttaccagtaagcacattttgggaggtctcaaaacatgtgtactacactagtacatatgtcgcatgtttcattagtattttaaatccccactcatgggtgtgttttttactattatgatgagcaaaatgttacctttagggtgagccaagtcaaaatgcacatgctcgctactggggaaagtccctattgaagtgatttttctgctagggccaggtaagtctcagtgagggctggataagcctaaccataagcccagatgtggctactgttaattctgattgctctaaccacagagcataaattttctttttgcattgattccaagtggtgcaaggtatttagagcttctggggctttctttcctgctatctgtctgtctatctacctgtctatctagctacctactctaatgcttttcttcatacaaataaatgcagtaacttgtcatgaaattttaaaaaataagaaaaaagccaccttttgtataattatagttatattattgaatttcattaacttcatcagattaatgtaaattaaatatctgagcatatttaatttctagtttcttggttgtgggttgtgggctgtgtaagtaagaaaaaagccacctttttttctgggtttcctataacctgactagaattactaaggtatctataattaatgtaaattcagctttcataaaattaaatatcttaaaatatctgagcatatttaatttctagtttcttggttgtgggttgtgtaagtacttcagaactatctttagtcacaccaacaaaagagaaaatcatactcactctccaataagtaaattacaaaaaaaatacttatttccttaatagcttttgacataataaaatacactaaaataaaataaatgaacttctctccctaatcatcaatggaaagaaaagctaagcttctaataaaataagtgcaagttcattttcctgtttcttgttaaaattatttaatatgacaagtgtctaatacattattgcatatcaacacaatattatccactaaggaaacacctaatttggggtggccccacgttttcaatagacccaattattcaacccctaacattctattcattatttttttaggatccattagcaaaatattctaaactatcatttgtagtaacaataaggaaagaccgtgacttgttaatcctggttataagcgtattgaatgacctactcaaggaaggaggagcagaaaataatgagaaccagctggttctaaatcttccattatttctaatatataaggagagaatgaactataatttttatggtcttcatctgacaatacttcaagaagaggtcgcttactatggtgattcattttcaaaatttacactttagtttactatacctggtgtgggaaccagtttgcttcaagaaattataattttaggaaatggaaaaaatatttttcctctattcatattaggtttattggttgggtccctgcaaattagactgaagaaagattagttaacaaaagaaaacaaacaaaataaaaaaaacaggagttttttaagacatacattgtgcatacacacgtaagtacgccgtcataagtaactcaaaggattggttacaatgtaggcttatatagcattctgacaaaaataattttatagataagcagcaaaacaaaagaaaaggactttgaacctctgcggccagcaaattgtggaaaggcaaatatgtagggagactaatggtagataaagcctagttcgtaaggtttatttatctggactttttctctgtaccttgttgtctcgggtgataaagtggttattctttttctgatacaaaaattgagaaagaggagagagacatagccttcacaaagagaagttgttttgtgtgttcaggtagatagggggagggcagagaggtcttctggtgtttggatttttttttttttcagttgccttaagttcaaaatatttttaatgctcaattgggctattttggggtaatattactccaaagcttttcattaaaaaatagaaaaattatacaaatgccttccaaagatctagattatgcatatatagaaaacacaaacacatacacaaacatacatataagtagcgcaagtttccatgtcaagtgtacctatctgtctttactttgttaaatgtatcacctcttgctaacatgtatgtcttactatttagtagtgggagtaattcaaaaacactaaggtcaatgttctgataatcatccgatttttccccattctgcttataaaacatcagatttataaaaacctaatgtctgattgagaaaaggactcatgaacaaaaatcaagccatataatgtctaacaaaattggtggttattatatggtagcagtttgacaaccgacagttttcatccagacttagtccgatatgtgcatttaccttggctgtagaactgtgttgtttatttcacttggagttgtgctgaattaataatttcccttcaaaagggtatcattagtagccagtggacttttcaagctgtttattttgaatttgcaattcaattgaatgaaaggaaatacatataaatatggatcatttcagataaaaataaggcttttgttttagtagggaaaatatagaatagcttaactcaacatctagtagaatatttatcaatctagttcccaacattaatgagagcttcaactagcagcaaattctatagacttccttctacctagagcttaagagataagtcatcagcttaaattttggagtgtgactgtcacaatgtttcaacaaaatcagtcagattctttagaagctacacagttttcacagttattaatgtatatagatgtatatgaaaatacatactgatgtaaatttctatgtagctctgcccagtggaagagcctaggagcaacaatgctccagtatgctccagtatcattgaacacaccaggcgtctatatcttggttcttttttttttttttttttttgagacaaagtattgctccatcaaccaggctggagtgcagtggcatgatctgggctcactgcaacttccacttcccgggttgaagtgattcttccacctcggcctcccgagtagctgggattacaggcatgcgcaaccacgccaagctgatttttgtatttttaatagagacacggtttccccatgttggccaggctggtcttgaactcctgacctcaggtgatccattcacctcagcctcccaaagtgctgggattacagacgtgagccaccattcctggcctagatcttggttctttagtatcatttttgattaatggattatgccttcttgaaaaaaatgatgaattttggttctttagtatcatttttgattaatggattatgccttcttgaaaaaaatgatgacttttggggctgaaacaagacacgtatatatgaatctaaaatatctatttgtgccagaaagtaaggaaataccagaggatgatggtaacctggcagaagtacatagcagtgagtttagaggggataccattggccaaatctggaacaatttgagcatcaaactatgtagtgatactaccgtattataactcactgaataaaataggaatctttcagttcatatagttatggacaaagacatgagtaaataaatggagagaagagaaagctttttcttgtagaagagtaccaactagtcagcgcagaagtaatgatggaatcaggaaatcaaaatatagcaatcattgtagtgataatcaatgctgctaagaaatatactggctgagaaaactagcaggttaaaatgtgatagggaatggaatatttacatcttctaaatgtacctccccccgccccaaataattcttaattgtaaagggaagaaatggtaccttccacagtagagaagctggcatgttatcaaagttagtatcaccataaatggaacaaattaatatcctgccccatctgaggaagcttcaccaccgtgtatttctgccaaaatacctaccctgaatttcatcctgaggaatcaaaagacaaacccaaattgatgcattgtcaatgggagaactggcctgtgatatagaactatcaaggctgggtgtgatggcttacacctgtactccctgccctttgggaggctgaggcaggtggatcacctgaggtcatcagttcaggaccattttggacaacatcatgaaaccccgtctctactaaaaatacaaaaattagcttgacgtggtgacacatgcctataatcccaggtacttggaaggctaaggtaggagaatcacttgaacctgggaggcgaggcgggggttgcaatgagccaagattgcaccacttcactccagcctggacaactgaatgacactccatctcaaaaaaaaaaaaaaaaaaaaaaaaaaggaacaaggttgtgagggtaacagaaagaaaagcaactgttctggattgaaagaggcataaaaactaaatgtgacatgggattctgaactggatccttttggtattgttggggctcagaaaaccatactcaaaagtgaaggcctcagaagcagcctcggaagcaaagtttatctctggcctcctattccgagccactcattctcctctgagacaagccatggaaactagaattcatctccccagagcaggtcttaggaaccagaagccctttttcccaaagccagccatacaagctaaaaatattgttgtcatattttcctgtcttatctgggtaagagctggccatagagaaagtctctgaccttcctcgtttgatggcagccattccagaaagtgtccagcaccatattcaggaggaaggaacaccgcatagagaggccaagaagaatccagataagcctggctgggtttccccacctgggtctactagaattagaccagatccttttgtctaatcacagttctgcatgcctgtccattcttcattgaacctaagcataaaaatggatacttttccctgttcctttaattcttcatcctgagggctcccatgttatgtaaaaccataatgaaatatatttgtgatgcttttctcttgttaatctgtattttgttataggaatgtcagtcatgacctttatgatggggtgggaaggagtcaccccttttctgctccaatattataaaaaatggtggtgccataattggggaactctaaataagctttgtgcattagatagtagtaatagatgtaaaaaccctcattctaaggtttgtcatggttatataagagcatattcttgtttgtagaaattacagagtaaaatactggggatgatgaaaagtcagccagcagcttacttttaagtgattcagaaggaataaaatgtgcttcatagtattcttaaaatttttgctgtaagtttaaaattgtctgaaaaagagaaaaatgagaaagtaattaggaagatgaagtagtacttttgaaaacgtactaatattaaggagtaaattttaatttgaaattgaacctaaatagtagttctaattgtggtcacaacttgaaagtaaatgacagattaattttagagagttttaattctatataaaatttaaaagttgatcagtatgaaacttgagaattgtgatatttgaggctagtcaagaatcaatgaaactaatttaggcttagaaatatctttgagaagttgtcatgccaaagcttttgaaaacataatttgtaattagattgaatgttttgatttggatataaaactgacttagaaataataagagcagagcaagtgaaagagctccccaatcctgcccaaaactatgtagataaataaataaatactgaggccttttgggacctgctagtattgcagccagtgtaaacacagatgtgtagtgatgtggaaaaatgtgtttaaaattgaatctccaagttgacaactcttatagatgataaaaatcaaattaatggatcaacatttaccaaagttcttttaaaaccattttgaccccccaaaatgacaaacaagcataatccaaatatgtgtagaaaaataattcaatgtgttttcttgaataatagtttattaaatattaattatatgatagcaagtatgttgtagaatgattaaaattaattttctaagtcattggtcctatttttgaatagattcaaatagatcaaggtaattttgacagaacgggtcaaccattttgctagtcactgagagatgtccctggaatgatggtttgcagttgtggtgtactaaatattgaggggtgtactagacctggagggaagtgaaggaaatattaaaacttccatttgtctttggaatgagaactaaacttttagctttgtgctaagtggtttcttcagtaaaatatcaatattttatttatgtttttcttacattaagcatccattttagctaacctcacaaaatatactgtccctaaaaactcagtcttcatgtaaacactttgataccagctgttcttccatctaaaattattttcttcctcctcattgccttttcttcctgaagatgatcctgtcttcaggatctagttctctttctgccttttcatggaacattgctacaatacttcatccgtgtccgtctatcccctctgaatatttacagcatatgttcttagcataatttattcagaaagtaatcatcattgtcttgtgacatataaggaagtattttcttaccgtttaactctatctatacttctgcaatacaatttgaggttcttgaaagaggaatcctgtcttattcctctttgggataaggggaatattggtagacccaatgtctaccatgacccaaatacagtgctaagagccgggaacagaaatctaattatttctctcttccgacatgctttgtgtttatatgaagttgtggacaagttaatgaaagatgcaaggtaaaaatatgaatgcacattagctaatttgtctatattagaagcacagtgagttatgaaatggaaaaagggatgtttgtggcatgagatcagagctctaacaatgcctctccacaaggagacttccagtgatgtttttctggcactcagcccttagatatcattgaattaattcactaaagcaatctgtatgctgtctatgctcattttaatgttaattattctgtgttccaaaacaaatgtattttctcagcaggaattaaaatttcaggaatataacataaaaaaccctgtatcgtttgaatttttcataggtttttttctaattaaaacatatattgttaagtgcatgtttgcttttctaaaataacacctagtaatttgtaatacattggtttgttctatgagtgtggtttatgatggtctaccttttatccactggtgtaatatcttacgttttatcagtaaccatggaaatgtttagtacatcatccaacaataaataaataggctaacttcccagaaatgaaagtaaataattatttatttaattcaaagtagagaacatagcatggatttaaaaatcttatgtaagatccaataatccaaatatttaatattttctctttggtttaacataatgttcaaatccgaaagcctgctttgctcaccaacacctcccacccaacaaaactgccaacatgccaaaccaagtggattgatttaacagcaacattaagctcccctgccagtgtttggtggaaaggcggttaatccggagtgaaaggcctcaaatcttgccaacaggaaacaaaaaaataaagaagaggccatctgtaatacatactcatagttagtcagtccctggagattcttcagctctttgtctgcagcattaagaaacacatgctaatatgttattctcttttgttgactgctctaattgagatgcctgacaaattaatacagaatattaagattattaatgccaaatggaaaaagaagccttactacaaaatgtcatataaaagttatttgtaaacgctaaggaattaatttcttaaattatttcagcaaatgttaactttaattgtgctcaatgaatgtttatggatgcttttgacacagtggtttttttttttttcttttttccctcagagtatatttttaggcagtttaggaaacaaaagataaatgaatgattagttgtttagtttgtctgattcaaggcatagattggatttaaaagagcaggaagcatgagctcttgaagtggctctgggcacactgccccaatttctggatctcattggtaaaatggacagagtagggttactgggggaactgtgataatataaagttcttagcacctgtctgacatttcttatttttagttatattgtattgttttgtcttcaaatgcagcagataatcattttttattctatagctaacatgctggcatcatccaaaaaagtgacttctattttttttaattaccattttgaaaacaccatgccctataacatctaaagacgcatttactttagtgagtgggaataatgataatataatcccatggcttattcataaaagagaaccttggagatgctgtggtaatgagcaggtggtaacaattcttgattatttatacatttttgaggatataatgggattgagtcattgaactgctgttgtatcaatatgtaaatttcacacatcagttttttttaaagctgttttcttttgaatttaagaagggtaaaaacacaccagaaatattttaaaagagaggcctcagatatctcttaaactatcatgttctgttcacattcgtcaccatcaaacttatattctatctctaatatatcctacacattggcacatggctcccaggaagtagtgtctacagtaagaaccgagaaggtaatatacttgctctcaatttcttccttcttaggaatgacaggcaaaataactgtcacttctgtcaagtagcaatagatactattatgaagtatatcgtgtggcaaaatctctgctttaactgagtactttaaaagtacttacctaattttcattgcttgagtactgtgctcacccctttgggaacaccagaaatttgataattttctatctgagttctaggagattgaaagctgtgcgacttttcaaaaactttctgacacatgagtgctaatttgagcagaatttagctagctctcacaagtgatgaaagcgcggaagaaccagtgagcactgtcagtcttttaatctagtatctgattgcttgtctaactgtcattggtgaaaagcaaatatctttgttcttcttctgagttcaagccggatgtgctcctgtatttagcatgacaggaaatctcaaacggcaaagaattacatggatttaaggaatctgatattcctgtattcaaatctcccctcttgttcatgatagagtcttctgtagaaaatctataaaatagcaagaattaaaaacatactataaagtatatgtttggcttatcagaaatccatacaaactactttttctcagggcctcttaataagaactggttccatttgatgagtgagttgcaaactcttgaaggcatattgacagatggtttcatctgaacaaactgattttcttgatttgccaaagtgcctaaaaattagttttcaaatttttgaattatatttaaggcattttgcttctgagaggtgacttttgacagacccatattgcttcttataagaaacttaggtgaataaggcacaaaatagtttctagaattacttaattgtttttcaaggaaaaatggggctcaaagtgaatgggccacagggaagttacagctggatcctgtagagatcactgagaaaggtctactccctaggtcactgtgcacagaaagacaggcctactgtgattccacagagaaaaatgtgtccggccaatggacactctgagcacataaactactgaaggaagagagattgatgatttgggatgcttgagaaaaattttcctgcatttattcttaataatatgttagtaatttaagctagtaaaaaaaaaaaaagaaatcaatgtaaaggatttcctgacttctcttttctactgcaaataaagtaggttgatacatttaaaaagggctattctccttctccttcaggtcctttatttctgcttcttcttctgtcatattttattttttttctcacgtcttttcccaccatcctcccagttgtcttccttcccaacatcgccatttatttcatattatattcttcagcattacacacacgttatttaactggaaagtataataactacagccatttcttaaaatacaacattaatgggatgtaatttgttataacatgccatttgaaaatactgcatttttttactttagtaggatttctctactagcaattgtaattattgtattgtgatgtttcctatgtatgctataatatatgctataactgcctaccttacctacagatgaaaactctacaaaatggtttctaaaagtatctcaagtaaaatttgattttgtttcaaattacctttaaatttttaacattcttaacttcttttttaaaaattacaatttttcataatgccaaagataggaaatagtgagtaaaggacagtaaactgatttatttagcgagtaaagaacagtaaacttatttttactaaacaactctttttacaatacactctcaagtctaaatttcaaaatgttaaaaaaatgattcttgtacaaatataaagtgagcatatatcaaagatttatttaacttattcatgaggaaactagcagaatactacagctggtttaaaaaataaaagatatgagagaatatgatcaatgaatgaaagattgttgagataaggttacttcaattagatacaaaattggctaataatgtcctataggcaataaatctgtaactgagccatcatttctgttggctggaaccactaacatctctatcagaaaaaaaatcttttgtaatttattagtcttctgtaagctgacatttatctgcggagaacctcagttctattcaatgataaaagaaaaatatgcatttctctagaaaatcagtgttttgtaaacaagtttgttagataattcttcagtatgataaggcacttagtaatctttttaccataatttcagttttggataatttatcttactaaactctgtgtatattccacataaaatccaataaaagtaccaattatactggttaggtacagaatttttcagtctgatagagagctgcaagacaagcccaatttctttcttgaaaactgaaacatagtgaagaagaatatttacctaactccttgtcctataatacccactctatgactctgtcatggcatgtgccctaaataaacactgtccatgtctgttatttgatttgcgtgagagaaatgtatcagattttaacccatattgcataaattactagggtcttaactggatgactggtttggatggggaaagggataagagaggaagaaagaatgaataggtgaaaatcttctcactctaatgctttattcagataaagttatttagttttgatagacaaactgaaattgtattcacattttttaaaagagagttttattcaaaaactgtttttggaaacccttaaacttctaaattaaaagtcatatgcaattgcaacaatttgaaaaactggctgcatgagccagttaaacaaatagtaaagtatttggataaccaggcactaaggagattaaataaagagccgctatgttctaaatgttgataagccaaagacaggatagtgtgtatgaacctgctagttcccttgaccaacaggcatctccttctaaaaaggagtttgagaccttatcttgagaataacaattaagggcagaatcagaactaatacctcagtgacaatttgtacaattaccagtgaagattagctgcccaagatgatctagatctccatactacaaatctcttttcagtgagtaatatcaaaattatctctgtgtaagaatgcgtgataagaatcaggacccaaagagttaaaaaatatagtttatggaaatcattatttgttgttttagtaatccctacattttctaagtagtactgagagtttgttgtccaattggaaattcacatttaaaactcttaatctcaaaaaatatatcactaaggaagtaattatcttctctcaagtgcagccagtttagctgagtgtcaaacagcatttctacatattatttttctctggtgtggtgctgtctccttgggcttgtcttataagttgtttcacgctttaacactcaataaatgcatgatagttgaccgaatgttaacttatgatatacgacatttttctctagatgtctcccaagttgggagtactaccaaaataattccccaaaaaagcaaaaataaacaaacacaaagtaaattcaaacaaaaaaaggccctgcatcagtatccatataaccttcctagaagggcttcctttataggttaaattttaattgtgtttggtgttgtgggtagagctgtcagtattggaatattcatcaggatcttgatattaaggacttattatttattactttattttatgctcaatgacccttctgcctattgcatgtaaggcagaaatctaggtagaaggaatgcaggtgaataaagatggttagtccctagtcaacatggttcaaacataatatgagaataaaacaagtgtgtgaatctttacagtacaaagcagaaagtactttgtgtaataatgatgtttcagagcaggaagaactcacaactaattagttctaatcaaaattggggtataaaagagatagttgctgatagaggtcatcaatgatacatagaatttagctagaaaaaaaataagtggacagaaatgtcctggctatagcaggtagcgtgagaaaatgaagaatataaaacaggattaagacaatggagtagtatagatatagtatggtatggtatggtatggtatagtacagtacagaatagatatagtatagtatagtacagtatattagtatagtatagctatagtgtagtatagatgaaatacataatgtttgtaggtgattgtagttgattgggaaaaatagattttgcacatatcatagatgatcccaaatcctaggatgagctattacacttgatgcaatcatcaccaacataccagtgaaggcttctatttatataagctgtttaaaaatatttaatagaatctatttttgaatatctttctgttgttctatagactttattgaactagtgtggaactggattttgaatgcctaattaggatgaatttcataacacaatagaaaggctacagggttaaagggtctagtctggaatgatagatgcgcacaaattatgtcttgaccttgattgttagttgtcttattgaaacactgtacagctcacaaaaccactgggccccatatctccttgttatatggagttctcctttatttgagttgatccacttaatgctgtcatctggaggaaaataccagactgccacactgtgctgcattcttagtgcatttgttgttattcatatacactccgtaaggcccagtttgataggaaatttagaccaatgaaataacacagctcacctcctgactcctataatgacccaggaatattgtgtcatcaacaacaggttttctaaataatattgcctttaaaaatactttttaaaatatatcaggggcttggaagtttgaacatagtttcagaagtcaattgaatatttccttcatcccagcataaatccaggaaaacagagaaaggcatggagtgggatacacatagtcagagaacactaaggttgggcaacaaagaaagaatgtagtttcatgttcttagaaatattattattaagatgcatttcttgttaccatttttcagtattttgtgattaaaataaatgaggcaacccagtacccgaggttttggatgcatgcttttgataaaaatcctgaaacgagtacatgattacataaggaatcacgcaagttcaatgagcatccaaaagtcccagaacgagcttgtccagcccagggtacgcaggctgcatgcagcccaggatggtttagaatgtggcccaacaccaatttgtaaactttattaaaaccttatgattttttttggcaattcttttttagctcatcagctatcattagtgtgtgtattttatgtatggcccaagacaattcttctttcaatgggcccagggaagccaaaagattggatgcctctattctagaagctgattcactctcagcatcccacatactcccttgttttttattacatattctatagacatcattatttcataggtccaattaaaatgctcagggcttttgttttgttttttagccagttctttgtatgatatatttctcagactaccactatcctgatcagtgtaaaagataagactattattccccttagcatgaatattttgtttctaataatttgctctaaggtcaaaatagtgttgtcatgtgtctcacttcactcacttttctcacagttataaaacaacctcaaggtttctccaaatcaagctgttcttacaacaattttcttcctcctcctactggtttaattcactttggaacttcaagatatttacacaaatattcaacaaacttaatcttattatgttttacctccttgtggtttttgttatttccaaatgttgcctcagtcatgtaacaccttgtttttctcctaagcttttaaccccttgaacatttgataacaatttcttatttgcattcatcaaacataaatcaatttttgacccatagagggttaaagatagaacactccaatcatgaaggacactcatgtacttgacatttatgtatttataaatatattttaggtatggctatgcaaccctattttctcttattttttattttttgtcatgaaaatatttttcaagtttttcttatttttatatatatgaaatattctatactcttttggccactttagctgtcctgtagaccctatctagaccttccggagttttgctatttctttgttgcagattgttgaccagaattacaaacagtatctcatagaaacactgatttctacaaagtgagataaagcttcccattttatttctttggtctgatttcattgtaagagttcagtgagtcattgcctgccaggagtcatctacagtgagtcctagatcagtccacagctgtgacgagttcactattccagaaatacaagtttgaagaacttcctacccaaccctcccttagaaaattacccaaaattgatcatgtaaagcccactttctgcttctccatattcatttttatggcaaagtttccccactggcctggattttcactatgcagaagtgttcagggttatctacaaacataatacctaaattgtatatatttataacacatatatatgtactctatatacacatatattgtactatatatgtgtttatgtactatacatatacgcacacatgtatatgtactatatatacacatacacaaacacatggtttttttttttttattactaacctaaatataaaataagatctctggagaaaattttgttaatgtgtttccatcatgaaaacacacaataaacttgtttattgttctatctataacaaaatatttaaactacttttatcccaattcgaatatcattcttgtggaatttgccaaagtatttttttccttcaaattggaaaacaaacatgggactcttcttgggagatatttatattcttaatcaaagaacttcattatattcatcaaacaccacagcgctggtcacttacatctgtctaatgaattatatttggtgttcattgactctattctttttaatagaggtcatggtttgttatctatggaaccgagaatcattaatcatgacttggaattaatttgaagagatgatttttaaaaacttgtcataggcctgccttttgcagtacagggttcagggttccttgcttcatgataaacatttgcataaaagattgaagcttttagaaccttatcgtgttgttcaaatttagggatattaaaagaggaagaagcctgagatgaacacgggcacggcaactgatagcttcatccactgaagagggattttccagttgcatgcttgtttctctccctacatgtgctaacatttgtttagaaattttatattatgttgagactaaaaaaaatcaactctgaggtataaattttgatagtgcaaggacccatttatcatgcttgacatataatcttttaaattaaatttttattgtgcaatgattacagtttcacctttctttgtaagaagactttagagagatgccgtgtatcctttttatccagtctcctccaatggcatcttgtaacactagagtcaccaccagtatattcactttgatgctttaagaatacaaaatacttccatcaccacaaggacctctcctgttgtcattttgtagcctcacatacttccacttgtattcctcctcaacccctagcaaccactaatttcttggcatcatgaaccagagaatttattcatcactaaatctgttctgccaggatctgccactcttcagccaaaactcctagttactcctgatgacttctaggcatctgccctccttgggcatcaagtttactgccagttgccttctgagtcacctgcagtcaccactggagatgtaattgagtcctcatgtgccaaacttatttggttttcaccttaaaattattttttaaaagactattattcccacattttccctctacacttggtttactaatttgcatgtgtagtttatagggccaagctggcaataagttactgttatactcctctctttatttcccgaatctcctattcatgttccagtttaaactcagctgggaacaccttgtctcattcagaacttaatcacagtctttagatatagtcttttttgttttctttatatgcttattattaacatgtagtatccagtatctaatccagtaacagtcacaaattggcccatcagtggcaagaaatttaaaaaatggacactatagtgaggactaaattcaaaaatgacagccaaactggattttctcaagcacattctgctaatttgtattacgtttaaagagaaaaaattacttttgggtaattgaacatctatatcgcaattgcaatggtggttacacgaatctatgcaactggtaaaacctgtttataacaaaaaaaaagtacataaaaactagttaaatcagaataaaatctgtagtttagttaattttattgtgacaatgccaattttctggctttcatgattgtaccgtatcgtgtagaatgttattattggaggaaacgggggaaggttacataggaactcaactgtattagtccattcttacattgttgtaaagaaatattgagactgggtaaattataaagaaaagaggcttaattggctcatagttccacaggcaggtgaaactgtaatcattgcacaataaaaatttaatttaaaagattatatgtcaagcatgatgaatgggtccttgcactatcaaaatttatacctcagagttgatttttttggtctcaaaatgatataaaatttctaaactaatgttaacacatgtagggagagaaacaagcatgcaattggaaactccctcctcagtggatgaagaggaatcatggtgctagcatctgctcagtttctggagaggcttcgggaaactgtcaatcatggcggaaggtgaaggggaagcaggtgcttctgatgattggactaacaggaagagagtaagggggaggtgccccacactttaaacaatcacatcacgtgagaactcactatcgcgaccaaggaggatcttgctaaaccattagaaagcacccatatgtggctgggcgccgtggctcaagcctgtaattctagcactttgggaggctgaggcaagtggatcacttgaggtcaggagttcagggccagcctgacttacatggtgaaaccccatctctactaaaaataccaaaaaattagccgggtgtggtggcacgcccctgtaatctcagctactccagaggctgagacaagagaatcgcttgaacccgggaagcggatgtttcagtaagccggaatcatgccactgcactccagccctggaaacagagtcagactctgtaagaaaagaaaggaaaggataggagaggggaggggtggggggcagggagaagaaaggggggaggggaggggaggggaagggagggggataggagaggggaggggaggaaggggagggggaagaagggggaggggaagggggaggggagggggaggggaggggaggggaggagggggaggggaggagggggagggggaggggacgggaggggaggggagggggacggggagaagaaagtggggaggggagggcaagggcaaagaaacctcccatatcatccaatcacctcccactaggtcccacctccaacgctgggaattacaattccatatgagatttgggcagggatacatatccaaactgtatcatcaactatttttgcaactactatgtgagtctaaaattatttcaaattaaaaaataaaggcaaaacccatcaaacttacagattattatgtgatttaaagttcctatctctctcattctgtatgtgtgtgtatacattacacgtatatatctcagatagctaaatgcatgtgcttgtttgacatacaggtgtgttgctgttgttttttttttttttaaatttttatatattttttaatttgttgagatcacccaaggtgaaatgcagtgacacgatctggactcactgcaacctccgcctcctgggctcaagcaattctcatgcctcagcctcctgagtagctgggatcacaggtgtgtgctaccacgcctggctaatttttgcctttttagtagagacagggtttcaccatgttggccaggacggtctggaatgcctgacctcaagtgatccacctgcctcagcatcccaaagtgctgggtgccaccgtgcccagcctgacatcgtttttatggatttcaaaatataaatgtatttacattgtttgaaagttcatagtgtatataaaattgaagataggatcctgagatacgtatgaaagcattataatgcacaggtgtttgtgtgaaacatagattgtatctgaggagaaagaaatgacagtagaatactaatatcaaaaatatataaataagatgataggatcccaaagtataattttgtttgctttttagactaacaaaatattaccacatctaaataaatgaaaaacatgaatgacatatgctttttccatcgatttaatttttgttaacaaatataaaatgttttagaattttacttatagaattcaaaaatgtttccttcatatttataataatacttaaatatggaaatgaatacatcatctcaaataacactgagttcattcttggaatgtctttttttttttctgttagagattttctttcattttctttttatttttccccaggatgctatcatgcctacgtttctcctggttagtttcacaggatattttccaaagagaacttgaataaaacagacttgattaccactgttttattctcaaaataagctaatggctattaagacttgttccttgatttgagggggctttttggtatacttattcaaaaaggcagattcaaaataagctctctacttctttattcctcagaatctctgtttgtatgtaattggctaacaaaacccattgcttattagctttgtctcagtgctaaaaaaaaaaaaaaaagtccttaaaattattgcaaacctgcatctgtcacacctgattactccaggaggaaaaacaaaacaaaacagaacagaaaaaaaaaaaaacaaaaaaaagaaaaaaaaaaacttgctttggataacattttatgacaatagctttgcatcaggggacttacttatcttcaatgtgtgctctattcctcatgtcactctttcttccccttaattgaggaaaatgtgttcagaagttaaagttgtggccatctatttaaagttttatattattcagcttagaaaacaaataaaattttcatacgtacaagggaatatagcatcactcaagtaatgcccatcacattgcacaagaagtggataatctttcattacaaaagaaaagatggaaactgcatagatcttctgtaaatcagaagctgtataaccagctacttaactcaaattctaaaagccacctaatgtttgtatgtggatgacaccaatataacaaacatattgcttcaattaagtcaattatgttaatttgttgaaaagaatctgttaactgaatcattcagtatcccttaaacaaaacatagggtgataattttgcaaattattatttcaacttattgagttggcaacgtatgaacaaaaggcaacctgcatctatgttttaggataagtaattaggttctcacagactgagattttcatttaaaaagatttcccttttggacagtttataaagtgaattggaagagagactggaagcagggagagcattctaagagctctcaggggagaaggagggtttggccaaatacagtggccagactcgtgaaaagccgttactggagaggcaggacctccagcacctgggacattgtgaatgtgagtgaggaagaacaagagccatggacatgacagagattctggctggagaactaggaggatggcagcatcagcaaatggtgtgggtggaaaatagaaaataaacacagttttgatgataaaaaggcattttgttaacatcttgtagccattcaaataaagatgtttaatagaaagttggaaattcaggcctagatctcaaaatccaacttagggctggagatgtggatatgggaatcagtctccaatatttagatgggaatgagacctcgtagaaggaggttgagttgaaaaagtcagccgttcttgtccaagaatacaaatgggatcacagtctcatggagaagaaggcattacaagaataccaactgcaccaaaaaggttccttagggttaaaactaataaagaaggcttagatttcactttattagtgcagaagactaattgtagcacagtagaagagagatggaaatgagcttctatccttgaaagtttggatatgaaattgtctcttcaagaagtttgggaggtcaatacaaaataatgcaatattgtaactgaagaagtgagttggaaaggtgagttagttaaaagacatttggtggagtttgttttctttattttttctctgaaatcaagactttaggcttgtttcattaaaagagttgaggccgagagagatgttaaggaatacaggggcaccgtagaggtatagctaatggaacaagggagaatagagttagatgagaagatgggattaaacagcccgagtaggatttgtcccctgttagactgtagaagaaggccagttgggtagtagactgtggctagaccacactttattaatccgtttgtcagtaaatacacatttgagatatttctagattagactgattatgcataaagctaccaggctctcaggaggtcagaaaataaatctaggtagtgaaggaaacagataataacaaaataacaggaataagcaaaatattcctgttgaacttacatttgaagacaaaaaagcagatgatgtcacttgtgagaaagtagcgagaacagcatgacctttaataatccatagaagaagaagaaaaatccaatgaagataaaggagaagcaatcacagatcaaatagacatatgcaaaataagatatgttcttttttttttttttttttttttgagacggagtctcgctctgtcgcccaggctggagggcagtggtgcgatctcggctcactgcaagctccgcctctcgggttcacgccattctcccgtctcagcctcgcgagtagctgggaccacaggcacccgccaccacgcccagctaattttttgtatttttagtagagacgggatttcaccatgttagccaggatggtctccatctcctgacctcatgatccacccgcctcggcctcccaaagtgctggaattacaggcgtgagccactgcgccgggcctaagatacattcttgagtgagaaagattccaggagaagatgactaagggagatattcaagaagaattttaaaaaagattatttcattatcatcagttacctcattatcatcagtgatttttctgatttgatttgaaagaagaaacagcaacgaacaaattgctaaagtttaagagagcatggaagaggagggaaaaactgagcaaacaccatctattagagaagttttgcagtgaaagggaatagaaaaccagacagtacaaatggagaaacataatgtaaaaagggttttttttttttcttcccaggaaagatgaaatccaaatatattggaaaaaatggcttctgtagacccaagaattgtcacttattttagctcttctatattttgaagaaacattacctggtattaatcatccaatagataataaaaatggaagcatatgaaattgaggaagagtaaaattgttaatgctcaaatcagacattacatttagtattagaattattaatatttcatggcataaatttatccaactaaagaatttcacattttgaaaaagataaaattgaaagatggtaatttaccttgctatcacaaataattctcacattaactaaaacttgataattttgttgattgtatgcttataaaaagctcttggttccacattcagaaaaatattttatcccaagtactttccaaagagtatatcatcatatttgctgccattaatacttaacaaatacctgcgaaaagcaatggttttggagggtaacctgagggcagtataatctatctgttcttctagatactgtaaacaatttctagagtaagcttgtcagtagggagctgaatatctatctgcatcaaaagtgttggttactgctataaatttgtgtttactgagctgaggtttggcatttttccatggggctacattgaggaaaactgtaatgtatttcctatgaaatttgttgctgtttttatatggattttcttgaacacttcattctttatgtagcatagtttcttttatgtgaggatttgggaagtttctttctgggctcagtaccttgagtattatgcttctgcaagcaactggttagattttatttaagatgagccttgaaactaattctgtctgcatttatgtgatatgccagaaattttaaagccaaatttttagacaccctcctatgcaacaattgtttttggtttttcatatttttatcaagctagtacatagataagtatttttaatcaatttgtagagaaataagttcatttaacggtaaagttctttttccccaatatcttcttatttcctgttccactctccctttatacttttatatcaatttgttcgcttataaatgtagaatttgcctattggttaatgacttcttgggtcaattactagttagctgacttacttttccacacatctgactacttttagaagttatattaaggccaggcatgatgattcatgtctgtaatcctagcactttaagaggccaaggtgggaggattgcttgagcccaggggtttgaggctgcagtgagctgtgattacaccactgcacttcagcctgggctacagcgcaagaccctgcctcaaaaaatatatataatagatatttttaattctctattggttaattttattacatttaataatatacttacaaataggtctactcttctgtcaaattttggtaatataatttgactcttcacttggaagatgagtatattatttaccacattatttcttctacattttcgtatccatttctacctccaaacctctgcttcttaggttgtattttaacattgccaagattgataatgttagatttgtatttctgtttgtctaaatatttatttaacatatcacaaaatggatagcatttatctaattattttcatcctttcttatggcttgacatgaaggataaagaaaaaattataggaggtttggaaagaaaaataatatatttgagtaaaatttaaaatagatttctgatgctatattagattatcatctgaaaaaatttatttgtcaatatcttagaaattcaaatatgcatccattatataatccagaaattcttctcctaggcatttgtaacaaatgctcacagcaattttatttgtaatagtaaaaaaacctggaaacatcccagtatctatcaatacaaaaatgggtacaggttatagtaaacttagacaatgaaatagtacacagaaaaatagaaatgtgctactgataataacgatatgagggaatcttaacaaaattgttctgagtgaaagaagccagtgatgtttgattactttattatgaagttcaagaaaagtcacaattggctgggtgcagaggcccatgcctgtaatcccagcactttgggaggccaagctgggcagatcacttgaggtcaggagttccagaccagcctgggcaatgtggtgaaacctcatctctactaaaaatacaaaaattagccgggcgtggtggcctgtgcctgtagtcccagctactcaggaggctgaggtggaagaatcacttgaacctgggagatggaggtttctgtgagttgagaccatgccactgcattccagcccggacaacagaaaaagactctgtcaaaacaaaaggcaaaattaactatggttatagaaatcagaaaagtgtatacacacggtgaggagtggcattaattgaaaagaatattgactgaggggattgatgagactaatttctgggataataaaatgttctatatcttgatagggagtgagggtcacgtgagtgatcacatttctcaaaactaatcaaactattcactggttttcagtttactgtattaaaaattattatcattctttttaaaaaaatgacgtattgctccctgaacagtctgcagtttcactgagagatcaaatagtaaacattataattttactattcattataaaatgtattatgatataggtaagcacagaatttcagaatgagcatcaagtaaccccactatgcatttatcaaatctgtttcactttccttctgtggcacatattccagtctcttggacactaaggttaagatcaatatgatacatgaccaatggaatgtatgcagaagtgatattttcttcatcaaatctggccataaatcctaagttcattcctatatgtttgtcttctgtttctgtggtggacttgagaatcagatgttgatgacaaaaaccaaatgaagtgagcccggatccctgaatgactatgtggaacagtgctcctctgtccttttctttctatactgaaatgtgatgtgggcaaaaatcaatcatgtattatagtaaaacgctggaaagaaggaaacaagaaaggaggggaggaaggaaataaagaagaaaagaaagatggaaggaaggaaagaaagagagaaaaaaaggagagagaaaaaggaaggaagttggagagaaggaagaagagggagtcagagagtaagaaaagaattgatggttcttctgccagtgacttagactggagataaataaactatgggaggcaataaagccattaaaaagacagtccacttgttgagtaggctgagaacaaatgatcacaaagaaggaaacctattgaataccatcatcatgtgatgcccctaaagaataaagagaaggaatcaagaatcagatttttaagattttactttattaattttcaaagtcaaattattgcttgcaaaataatgctgttcttaatgcttctagtacgattattctaaaatgctttcacaacattgacaacattaagaagacaagatgtatttatttgggtaaagagcagtagggtctagagaggatattgctgcatatatatatatgtatatatatatatatatatatatatatatatatatatatatatggaatatgttggcatgtctcacaatgtttgacatgattttgcaataaaaaagagtgtatttttagcatagttcaagtgaattacccaagtgaacaagctaaatttgattggggtggggggttaatttttacatctctcctggcagttctctcaagatttttccatgattgttttctttttatcccatgatctctgacatctagccacattacataattataacgacatccccctacaactaggaaacccttacacattaccctggtgtctttttgagtcagtctagcatgctctattttttttcctgtaagatattatcaaatatatggtttttaactaccaatggtaatagaactggtttttgtacatccagaaataacaagacctatgaaatgtagatagatgggaatttggaaatgcacatttatattcatttacttaagcacatttattgaccactgaacactgtggtcatcagatacacagggaccaaagaggtatggtctgaaacctcacagctgacttacatacttctgaatcagttagggagttaatcaaaaacataatgaagtaatcacaattgagtgaagaggggaaaaaaaaaaaaaaaacacaggatgctcttgatacaggcaaactcccaaattggggcttagccaggagagttattggcttcatacaggaaagaactcaagagtacaccaacagaataaagtgcaagcaaagcaagtttattagagtaacagagtagggaaaaacggctgctccatagacagagcaggacatatgcagagtagcacttgtagattgctggctagctatatttatagctactccttaattatatgctaaataagggccaggtaattcatgaattttctagaaaaggagtggggacttcctggaaccaaggattcctctctttttataccatgtaaggtaatttccgggcattgccatgccatctgtaaactgtcttggtgctggcaggagtgccttttagcaagctaatgaaatataatttgtggataacaaacaatgaggacaactagaggttgctttctttgccgtcttcgttttagcttgtttattttctgcatttgaaacaggagttttcccttttcctcttcacagggcaagtgataggggtgtggctcacttcttcagtgctcccctgctcaaacccatagggagagcgtgcagatgggcatgtcatggagctcaaaccccatggcggtgtctagggtttagtgtttacagctcctgaagccctagtgggtgtgtgttaccttgtgctctcttagttttgccatctgcaggtggcttgtgttaatcggttcaattagaccccctgccttactgcaaggacagagagctttctgtaccctgggttcttgccttggtgtatcagaaaaatcggatcacatgtggtcttcaagaatgggtgtaaggttttactgaatggaggcgggtctcagcgaggtggatggggaggtcagaagggggatggagtgggaagctggtcctcccctggagctgggccacccagctgccagactctcctccagcgtcccttggctgaatccggtgtgcttttccactcctctgctcctctcgatgtccagacacttgtggctgtgtccactagggtctcagggtttttgtaggcacaggatgaagggtgtggagggccagagtggtcttagaaaatgcaacatttgagcgcaaaaacagaaatgcctgtctgcacttagttccgtgggcacaggccccagggtggagccccaccaggaccctgcccttctctatccagcacttctctgccctcctcccatatcgcattctgttttgaccagatcctgctttaatcagtagagtcctgactggtgctcagaaaaaaagtcctgctgatctcctactatgaggcaccctatggaacgaggggattgaggggtggcgaggcaaggtccctcctgtcaggaagtgctgtctgagctgagtcctacaagatgtggaaggccagccagatgaaactaatgagcagagactccaggggaagaggccagattggaagggtaacaggtgcagtattttatgaaggtccttcttatcttcctgcctcagcagggaatatagctagtcctggaaactcacatcaaggccgcaaaatggaaaatctatttctacattttgacataagttgttagcatggggaaaataaaatctaaaatctggcaagaaataaaatttcaattaaagggaagtgattgtaatgatcacaggtttagtatattaacataaagaatagtcaatatgtgtttcaatgccacagagtcattttatgttttaagcaagtaagatctctcactttagggaacattcacgtcattctcacataagttcccacctatgagacctgttgtcagtagcgaaaagctcttcctagatttagttacacaatagctaattgttttaggcacttttttttagtcttaagtaaaacctttacatgaagatacagagtctcattcattcgctataggagcttgtgatcttttatgttaggtctcctaaaaagtgaggatttagttaggaataaatatacttattctcatcataaaataatttgtgttacacttcaaaccccataatagtaaatttgagaaaaaaaaaatgttagttcatgcatcatacatagcatacttctagtactttatatagtctcctccagtttgataaattatattttccaagtgattacaaaatacttttccaaagtttactggttcttaactgtcaactggctggaaagtcttagacttgtgcatcctgtctaacttgcaagaaagatttaatttcaaagactcttagtccatgggctggcaaactgtagcccatgggacaaatcttgtccacgcctgttcttttaaagtttgtgagctatgaataatttttacatttcacaagtgtattttttaaaaaaaggaagaataataatatgggacagaggagcatgtgacctgcaaagcctaaaatatttactgtctggtactttgcagaaatgctttgcttcactacctcttagaccatctgaaatattgttttagctagaaaaaacagtgcacctagtggaaaattttcagttattaaaacttcagggatgtttattctaaaattaacattgtggatgacttacaatatgttaaaaaagttctaaattttggtatgtatttgtacaatttataagacaagaactctaaaagtagaaccataggtttaacattttattatattgattttaactttccttaacatcaagctttgtgagatacatatatgctatcttaattataataataaaccctattctaagcatatatacaaatcactgcctctaagagagatttaatagccagaacatgaaattcacaagttgttgtaaatggattttttattctttcaatgataaatttggctggcattttttatgtatctgcaaagcacttgtatactatttgtctaaatgaaggtttgattataaagagtattgttctatgcaagaaagattcaactttgctttaagtttttaatttttgatgcaggtttccaaatcttaaagattgtataaaaactcagctgtgtatctttttttccttttcacacctatatgaaaaactgtaaatgagtttttaaaagagccaagtgatatgaaaaaatgctccttttcaagacctatgatagtttattctttactttagtatttactaaataagatgccccctagctgacaaattcttctttccttttaggaaacagtgtcattcaaacttttaaattacttgtattaaaactgcagaggactttgggtgctgataatcacaaaagaagcttgatttaggtaaatgtgtgagaaaacataatattattgattttgtaaaaatttgtagaaataaaaaataaggagagaagtaaaatatgaacactatattagatgtactatctaataaatagaccagatatcaaatgtgtatctaaaaagtgatatgataaaaagcatccatcagactttaaatttgatattcaaatatataacattaaatatcaaaaataaaatatattgtatataaatgggaagatatttatttctagttgacaatttgattctcaaatgaagagagtggaagaacttgttactttgtcccaagtttgtctttactaggtattcgacatccagttttgttttttttttcccttttttttttttttttttttattgagatggagtttcgctcttgttgtccaggccagagtgcagtggtgcgatcttggctcactgcaacctccacctcccaggttcaagtgattctcctgcctcagcctcctgagtagctgggattacaggtgcatgccaccatgcctggctaattttttgtatttttggcagagacggggtttcaccatgttggccaacttctctgagtctgtttcctgatttgaaaaaatagcatccctgacaattttagagttttctttgaggcacaaacaatacagactatactagaaccgtttaaataatagatatatacatgttagacgttgtttttattaaatcaacggctacatctccttttatgtttcctaccttatcaaatactgatatttatggagacatttcacatatatttacagctttgtaatcaagacaatcaatggttcacgcctatggtattcttttgaaatatttaaagcttcagttaggaaaatgtcttaaatctcaatatgcttggatgaaagaagtggaaaaatcacaatctattggcacacacctatagtcctagctactcaggaggctaaggtgggaggatcgtttgatcacaggaattcaagggttacagttagctatgactgtgccactgtactctagcctgggtgatagagccagaccctgtctctaaaaataaaatataacaataaaaataacaacagaagcacaaactattgattttgagaatcctgaagaaaatatatagcatgcatttttccataagtaaagcaaaggcaaaccttaggtaaagcactattattctaaacctcaaatgtccaataacatcttttaattttgctggtgaaatctcaaatgcagtatatctaaatcttcactaattatctttcccttcaaatattgttgtattagtcaatgttatttcagttgctcagaaacaaacaaataaggaaacagatcaaataatccaaaacaccttagcaagctctggatttagatttctcaaatgatgtcatcgcagatgtgcttactttgtctttctctgacttccactcctttgtaatatcaaaatggccaacagaagctcagtgggaagagcacctccattcctgcagttttgtttgttttcttttcactcagcgtgcattggagatcccaaggtgtggtagctgtcctgctgttcttccacaccaatgttccaaacctctcctccctgaacaacctctgaagcacttgtggccatattatttcatctatcattttgtattttacattatgcaatggtcttctactatcttcttgggaatttctctttactcagagagggggattttagtgctttcattgttaaaaattataagatgtataactttcttgcttaaaactctctagtagatttcccttccagcacacataaatgaaatctagagcgtgatcataatgtacaggccctcctcattctgtccttgacctctccatcttctcccctgttcattccttcttcacactcttccaacaatactgacttccttgctacccccacaaacaggcacagtatgctcatgccatttgcctttctggcctttgcataaacgatatatgtaattgtataattataggatttacatataaaaacatatataacaatatgtacatattacatataacatagtgtcagtattgtatgtgtaggtatacatatatgtgtatgtgtgtatgtgtatatatatagacacatattcaggttcaggagtacatgtgaaggtttgttacacaggtaaacactcatgtgacaggggtttgttgtacagattatttcatcacccaggtattaagcccagtacccaatagttatcctttctgctcctctccctccttccaccctccactctccaggagaccccagtgtctgctgtttccttctttgtgtttattagttctcatcatttagctcccacttacaaatgagaacatgtggtatttggttttctgttcctgcatttgtttgctaagtataatagactccagctccatctcattcttttttattgctgcataattttccatggtgtatatgtagcacattttcttcatccaatctgggttgattctatgcctttgctattgtgaatagtgccagagtgaacatttgcatgcatgtgtctttgtggtagaatgatttatattcctctgagtatattccccataatgggattgctgggtcaaatggtagtttttcttttagctctttgaggaatcatcatactgctttccacaatggttaaactaatttccatgctcaccaacagtgtataagtatttccttttctccaaaacctaaatgtaaaacccaaaattataaaaactctggaagacaacctaggcaataccatcctggacataggaatgggcaaagatttcatgccaaagacatgaaaagcaatcataacaaagcaaatattgacaaatgggatctaattaaacctaagagcttctgcacagcaaaagaagctgtcaacagagtataacagacaatctatagaatgggaaaaatatttgcaaactttgcacctgacaaaggtctaatatccagcatcgataaggaacttaaacaaatttacaagagtaaaacaaccctgctaaaaagtgggaaaaggatatgaacagacacttttcaaaagtggccaacaagcctatgaaaaaaagctcactatgtagtttaataatataaatgccatgaaaactgcaactctgtctacattgttgatttgaacaatatctgctacatagaagactctcaaatatctcctgagtgaatgaaaggtgaatgaataaatacgtaagtaaatgtatgaatgaagcattttagcagaagggctaaaactgagtctcattgagttaggtgcccacccctggtggtagggagtagtgtctgcctctctagcatcatatggattaagagtgaatttttttttttttttttttttttttttgagacagagtctggctctgtcacccaggctggagtacagtggcgtgatttcaactccctgaaacccctgcctcctgggttcaagtgattctcctgcctcagccttccaagtagctgggattacaggcgtgcatgaccacacctggctgatttttgtatttttagtagagatagggtatcagcatgttggccagactggtcttgaactcctgacctcaagcgatcagcccaccttggtctcccaaagtgctgtgattacaggtgtgagccactgcgcctggggaagagtagaatattaagagtgaactttttaaagaaaagccagatgctattactcaaagggaagaggttgctgagcagtcgagcaataaatgttcatcatatctttccctctcttcccttttctgtcaccaatgcctgcacactaatatcttggaataggttgattatatcttctactcccttctttcaagatgttaataattcttcttttgaaatatcaaatctgtcttttatttatttattgcccctaccaccacattggtgttgaccttcaattacttgttgctaatcttcttgctcccagtatgatttcccattaccctggatctcattaatatggcttttattgttatttcttaacaacaagaacaacaacaacaatacatgctatattattttgtctctaatcagacagaacctgttaaaagatttatgatttttttcaacataactactttctgccagtcagacttgtgtctttattcctattccttgtgtattcctgaacacccttggttcatgtttcccgagaatctacaatcttagttcaaaaattcattttaccaataagcgcatcaaatctttttgtgagagacatacaggggaaaggaaaagtattttttttaagtcctagagaggctacccatacaaagcaaaatttcagcataactatccctggactctgggtcttataccctaggtctgaaatcctcctttatgccaacctattcttcaatatatcctagcccctttctctcttgtctttcaaacaccactctgtccttctatgcagctgagctctaactctgtagaatttgcctgattacatagccttcagggaactccaaatatcggtaaaattactagttacgtaatgcacttccatagttccttttaatgctgccttttgcaatatctttttagattttattttaggcctcataagactgcagatgtcttagagacagtgtttcaggagagatttttgttgtttttctaaatattgacataaaacctagcaacatgctaagcatatagttaattttcaagttgaaattgtttggtggcttttgttgagtattatttaagatcataaattttggattaacccatatccaattgtagatttaattcaagtgattttggtcaaggattctaattgttcttgcatttgaagccagagaacccaatagagatctgaaaatatagccatggtttaatggaatgcttgtttagatttttagattctttgtaaaactaacagctggctagaaaagtacctacaaagaaaatgtctttttagaaattgtttttctgatgaaattttgtcaacaagatgcaatgaggatgctctattaagtgttaaaattcaagacatactgctcaaatagttttgttttatggattacagaagtgtatggctatttttaaaaggcagtggtagtacgcagctcatttgagaaaaccaagaagagcacagcaggaatcgtcacagaagaacatcccaatttttaaaacatgtaattgtccatgttatagactaaatattatccattatgtggattgctggtaccatctaaaggttacataaaattgtttcaatgcggaggaaatctttcagtatacttctcataattactaggccttacattacacattttgtatttcggagcgcaggaatttgaccggggaatgcgggttggataacagatctactacaaacttgcatttgtgttgcttggatgaacttaagccagtgctttcaattccgaagctactctgtatttttttttaattaaaaacatctctcgctctttactttgtatgagtagtctaactttaaaacatcattattaaagataatttttttaaaagacaaaactcctggttttagatagaagcaaattcagtccttaggcaaagaagacaacatactaacaatgtaatataatgcctgtgttgcatcttttcatgatttaaaaaataatttttaaaatttctatttgtatgattttaagataatttaaatctgaaagttaatatcttctaaaagataaggctaaaacctcaagttatctattatagggacatttagaatgcatatttgtatgattttaagataatttaaataaatcgaaaagagaatatcttctaaaagataatgctaaagcctcaacttgtctattatagggacatttagaatgcatatatgaagctgaaactgctcatgtttaaaatagcacaagctttcatttatttgaattatatcttctaaaatataatagtttctttctttaaatcttccttgaattataactttatactgacattttctttttcattagatggtaattttttgagagtcgagtctatggtttcacacatccttgaatatcccatattatcttgctctaacttatgaaatagatagtttgtaaatccttgttgaatgatcgttatgtatgcctcccaaaaaatccatttgttctccgctgagaggaaaaaaataaaaaataaaattaaaaaaaaagacaatgtgaactttcagtatcagataaaaattcatggataattattcttttgacagaatcttctataatgaaaaaaactgaattaacatgtttctgatccattgaacaaattctctaaatgtgtctactccaataaaaggtagaaaaccctgacctcttcacaacgtgttcaattgttcttcttctctcactaatgttgaaatgttatctttaaatttctaatggttttatgggagaaaatgtggaggagaattttagagagcaagacatatggttagatgctataaaaatcatttattgtataaattaaatgcaaaatattagaactcatttcaatgtgtatggaacacaacagtggatgccatttagtctttcattcttttaacgtatgtttacatggatgaaaagacccacagaaaatctgacctgttttccacttaaaactggacctattttcacattaagagtaaggaagcagctttcttcaaattatttacggtgtaagaaatcacaagccctaccattggatgacatttgtgtttattctagtagacagaggacatgattgtttctaaagtatttttcccaatttttaaaatactatttccttttccaggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgtgagtatcgtattgtttaaatttgtggcaggttttatctttatttaaatagtaagctgttttattttaaattatttaacattacttgctttctctgacaataaactaccttctcatttacatatatatgtatctatgcatagatacatatatatataataaaaggttgtgtctctatttgcatgttataaatgtatattataaacacgtacagagactgacatgtcatatatcttaattatactttaggttgaagatttggaaaggttttttttgttcaatagactaaataataaagcttattaataaaattgccttgccttatgaaatatttaaaaaggggaaacctatattgttatctatgtatttgggtctttattatgggttttgaaaacatttcgaagaacttccttcgggttcactaagtatctctcttcagttatgcctattcctatactaaagccaatcactgggttttaaagtcaatgacgctttctctaccaaatttaatttattttttcaaattgatttggtcatctaaagaggttattttcccttaaatatattttaaagctcccttgttatttcttaaatacattatgcatatatctaaggattccaacatatgaatttgggggattataattcttctgtctattgttgctgctaatttttgcaaatggtacttgttttctcctactcctcttcctctctctttttcttcttatcttgtttgcctgtctgtcctttttatccttatccttatgcttatccatattctttactgtgacctcaatttctttaaaattttatctgtggaaatttgtttgggccaaggttgatggtgaattcttcttgagaggatatatctttgcttatttgcttctgtgaaggcgataccaacacagaactgctttcaagattatctccagttgtggttgttgtttctttatgagactgctagatagtataaatttaatctacgaacacgtgatttgcaaacattggcttcaaaatatgaattccctagtaaaatatactttcctcattcccggaaatttttcttccagctgttacaattccctgggggaacaaagatgctgggtatgaacaaggaggggatttggtttctctatgttatgcaaaaagtctcttattagcccgtttcctactcattcctataaacccacaaaaatgagttcacactaagcagaaaatttcaaatgcccccgttggacaagctttctaaaatgccctagacacttagtattttatataaaagaatatatgaagctttcacctctgtacacatttagtaacagaaattggtcaaaatattagctataatagtgcccgaatactgtcttattaattcataggcaatagtgttatgtgcaaactacaataaaggggtcatggaggtcatttaaaaattctcaaaaactgtttatttggttaccattttattgtagcagataaaattagtagagagacaaaagatttagctcttcaggagaatgtagctctttaaaaggaaaatttagcatttctggtaaggcccaaaaagaggtctaacataaattagaatctttggtcctatgtggtctagacattcatgaacagagtgtcatgttcacacatagtcttgctctcagcatagcatcatgacgggaaggccagaagaaaatgtgatatttttgtgaccatcacaaattttgttaagagccatgtttaacttttagtaaataaatacagacacacacacacatatatataggtatatatacacacacatatacatacacacacacacatatacgtgcatatatatatatataatccttcatggagactacgtgtatgtgcaatttattttattagcaattatttaatgagcacttttcatgtgtgataaatatattaaatggtagcattaccacagtagatgagaaagacatggtctttgtgagatgaagtgggacaaataatttaatagagttaataataataaaaatagtaaaagttaaaatttacccaaaagcacatagcctgagtgataggtctgaaagggaacccaggtagtctggtacagtgccaaagctcactatcaccgttctgtttttaatcccagcaaaataagcacccacctgaccgtccacagtttaatcaaaacatcatgtcaacaccccgcaaccactgagtaggccttctcccagttactgcaactccttaaacataaaaattcacctgatttgtatcaccaaagattagttcttgtttttcaaaaaaatttcacacagatggagtcataaaagatgcattattttacacttgacttctttagttacaaatcatatttctgagaattatctgtgctgatattagagatattagtttcttttcctcagtattattctatcttgtgaatattctacaatcatttgtttatttcatgctgatgaacgtttgagttgtttctagatgttggctatttatacagaattactaaaaatgtttccaatgggtatagacttgggggggtaataacaaactagcatatatgtgtgttcacctttggccaataacaacacaaatttttctaatttggttatatcaatttaaagtctccaatgcaattaactggagttcctgatgcttacaaattaagatatttagtattgtttaaaagtttaggccgggcgcggtggctcacacctgtaatcccagcactttgggaggccaaggagggcggatcacgaggtcaggagatcgagaccatcctggataacacggtgaaaccccgtctctactaaaaatacaaaacaaaattaactgggcattgtggcgggcgcctgtagtcccagctactcaggaggctgaagcaggagaatggcgtgaacccgggaggtggagcttgcagtgagccaagattgcaccactgtactccaacctgggcgacagagccagactccgtgtcaaaaaaaaaaaaaaaaaaagtgtagccattctggtgagtgtttgtcatgtctcattttagttaagttatgtttctttttttttttttttttttttgagacgtagtctcgatttgccacccaggctggagtgcagttgtgcaatcttggctcactgcatgctctgcctcccgggttcatgccattgtcctgcctcagcctcccgagtagctgggactacaggtgaccaccaccacgcccggctaatttttttttttttttttttgtatttttactagagatggggtttcaccatattagccaggatggtcttgatttgctgacctcatgatccgcccacctgggcttgtttctgatttttgaaagaggttatgcttattggtcatacgtataccttttttttaagtgttcaagaatcttgctcatatttctatggattcccatttatctatctatttatatatctatcatctatatagcaatcatctgtttgattgttttaagtagtttttgcaggcaactcttcttcattctcattacaattgctagacacgtatttatttttgaggtgacatttttttaacaataataattttaaagcaaacattgtcaatgaagttacttaagatccacaggtgtagacttaaactgtgaccacatgttctgtaattgttacaagtagatttataaagttgtgagtttgtgctgtcatgggcttttccatcaagcctgggctttgacaattacaagacaagaaggaaaaataactgaagcaaatcaggaagcgagacttttccactgtataagtccctttgggggaaaatcatatagctttgggaaactgtattaacatttatatcaatagatgccagtggagtaagtaacttagcaacacaaaatttaaaaagtagcatttcagttggatgtagtaggttgggtaatggcctatcataacataaagcctttattcttggaagttgtaagcatataagtatttgcagatgtgactaagttaacaatcatgacacggagagacaatttttttttttttttttttttttttgagatggagtctcgctctgttgctcaggctggagtgcagtggcgtgatctcggctcactgcaagctctgcctcccgggttcacgccattctcctggggagaggcaattttacattagccaggtgggccctaagtgcaatcacatgtgtcattgtaaaaggtagacagggagagatttcacagatgggaaagaaggagagaatgtgaacaccttggaaccagaggctgtagtgatatggcgataagccaaggaaggccagcagctcaaaaggcagatttttctctggagggaatgtgatcttgccaacacatcgatttcactcagtgatgctgctttggaacttctgacctccgaagttgtgaaagaacaaatttctgttattttaagccactaagtttgggataatctgttatagcaacaacatgaaactaatacaagagtcaatatattttagaaaagaaaagacaaaaatcggcctgagcaatgttctctgatagaactttctacaaagatgtagatgttgtcaatatgctctagccactaaccatatgtggctactagcatgtgaaatatagctaagacaactgtggaaccaaatttttaatttaatttaatttttaattcatttaaattcaaatttaaataatgtgactactggctaccatattagacagtgcagcttagaggaaccaaaacatcatgtatgtttttcatgtctttttataacataaaggacctataaaagttatgttttaagtgtcagtctctattgttttttcttagtttggaaaacaaaaatttaatcatcctgaaaactgtctttactgtcaataatgtaataaccagtcatcttactaaccacacagtcttagtctgttttgtgttactataacagaatatctgagactgggtaatctagaaagaacacaggtgtatttcttaccgttctggaggctggggagctcaaggtcaagggacctgcatctggcgaaggccttcttttcccattgtctcataacaggaaacagagccctcgtgacctactcatgtcttaaaagtcccacctctcaacactgttgcattggggattaagtttccaaaacatgaactttgaaggacgcattcataccacagcgtacaccaaatgtccagataagattctttttcatttattatttttgaagaatgaaaattacacttatctcttttccaagaaaaatatacatgtttacattttaaaatatatatatgttaaacatatttgttacgaaacactttccaaaagttacttccaaaaatttactggctaatgtaaattttctatactagagttcaaactagaatgagtccttagaagatgatactctgttcttgagcttagtgaactgttgtctcaagagctttctttggatttttcaatgagaaaaggaatcatataactttgagtggggaatgtagattagacacagccccccattttggcttcctagagaatagcagtgctgtgtactctagggtctcagcaaggagaaacatagttttgatcctgcccgtggaagagagatgaattctctaatctgtctggaaactcctgaaagggtgtacctgggatctatcttaaacctgcaagagagggaatggggcttctttcactgcaaagtttgccagaaaactagagagagagagagaaatcacaatgtgagcactgtttctgtttgactgtgtgtctggtgcaactccccttgtgtttgtcatctttcctttgtgcagttcctccatgatcactttgtcatctgagaaatgaggtacttctcaaggctgaaataagacgctgactctattccaggtggagaatttcgttccaggccactgctctgaagcctttagggcttctattgttcctacttcctgacttgtcttgaatataatatgaattccaatttcaataaatctaaactcatttgaaatcattctgcttcctctacgtttggttttccctcaagtttagttgaaacaagtgcatgcagttatttttaaaacttagcaatatgtcccatgccttttgattcagtgagctttctcccacagcgcagacactaatcttcttacgcgataccagtgggacttcataaagcaaaaggaagaggtctcagattaataatttcaaaaaatcatttatggctgcattactcaaacattcattttaaaaagccaaacacagtgcactgattaaagtactgagcgtttttgatggcaaatacttaattagtttttagtcagagtcctcttaaaagtaaggacggcaccttgggaaaccaaggtacacacatcgaaactaatttttatataggcttttaatttggatgaataaataataaaacctgtatgtcattcaatgcaaatcgtgatggaaaactgtcttgctgcctgagaaaaaaagaaaacatatcaggagaagttaaatacaaataagtaaaagacagtgtttggtcattttcatgctgtgttgatggcacgtctgcatctctagtgagaataccctcttctagggtcacacactaactcccctcactctcattcttcccaggcaagagatgctgccatgtacagatgtgttagtttcctggggtctctgtaaaacagttctgcaatcttaagatgaaatttaagacgatggaaaggtattctatcatggatctagagggcacagtctgaagtcaaggtgttagcaagggtagttccttctggaagcttggagagagaaacagttccatgtccctcgcccatctcctggtggtggccagaagtccttgatgttctttggctcattgctgcctcatttcaatctctcctttgggttcacattcacatgaacttcttcgcttttgtctgtgtctctgtgtcttcaaatagtcttcttctaaggacatcggttattggaattaggatctaccctaaaccaggatgaccttatcttaacaagctatatccacaaagacccacttttgaaataaggccacgctttgaggttttggctggacatggacttttggaaacactattaaacacaatattatatatacatatatatgtatatatatatatatatataaatcattaagaatttatgtttacatcagtttaagtgagcaaaaaataaaaaatcagttctggaagtcaacctgtgtgttcctacttaaattagatgtttaattttgtatcatacagaagcatcccagatacttatattttgtgtttataatttcttcaatttattcagtgaacctgtatcgcattcaggcatttagaaacaacctaaagcatgaactctgccctcaaggagatgaatttttggcagaataaatgaataagttaatagtttaaatactctatgataaatgctatgacagagaagcaagcctcgcctatgttgattaatgaaataaggtttcactaagaagcaacagaaattaggggtaaaggagcattcaagacaagaactaacattttcaaagactaagagacacagaggtaagaacataatttatttcatatttggagtttttagttagcaacataagtctcatttcagtgtacaaaaatatacaaattattatgttgcttagaggatcaatatatttgtgacagatttgttaatcttattaatattaataagaataaaaacattgaattatactattttaaaggcattttgctaattttaaatcttaagtgcaaatctgaccatattacatctgggctgactacacgttaatgatgctacattgcctataaagtccaagctgtttgtttgaaatttaatttctgcccacccactgactacctctgtagtcttaaatccagtcatattgtgttttatgctccaaatatgaatacaagctatatttcctaatacatgagtgacctgcttgtttaacaggcagtcattggagatactttctctaaccaaaatagcctctccatcatcctttacctgaccaatcttttttatctttcaagattcagttgaaatgcagtctttaatgagaatcatctgaatttccacaatgagtcatgtgtttattttcatatgaatatttatcagatatcatataccattatattacataaatatttccaatggaatatttaacaaaataattcaaaataaagtcaactgcaagatactgggaggaggagacagcaagtgtcaccttattcatcactagcatccccttaaatggcaggctccctgtacacaataaatgtttgctgaaatgaactgacatcaaatgtaaatgatacaggcgtaatttattccctcagtgaaaactgattactatttgaggatgcatagattcttttattggtggaacagggcatgattatattgtatcatattgaacagtgctctaaggggcctacaaaatattgaaataattaccaaactaaatataataatagatgttcaaacagagctatagacagcaaataactcagtgtttttttctaatttaaatatttgtataacttgtattattatttctggttattattttaaatcacacttttttgaggctgcttcatgggttatgtatatggattgcttatcagaggaaaaaaaaccacccaagatccagagtaatgtgaaaataaaagtaacttaacataaaaatagatttaataaatatcactgccaagttatacaagataaactgataattaatgaggtaattaaaattgtcatgtgctgtatgacatatttgggatatgctatgtttctaagttttcatgttattagatttaaaaaaaatactgtaagttgtaaccagagatgttcttgccattaagagatctggaacttagatttgagcacatgtagtattctttagtgcttttaagtatagtttgggtttcaaactagaattggagtgctttgtaatagacagctgtggattgtcattcagtgtcagtttgagataatgacttcctggtctgtacatataaatattattgtagggataaggctaatgatgaaagtgcacatgatagatactttcacataatttgggtataagccttttttgcaggggttggctaaggtagatagctagtggatcagatactcagtggatctcattcctgggttaccatttgagggtgacatttgaaatgaacaaatttaaagcatggaaatatatgttctaattttttattctatggggaaacagctatcagtatttaattgttttttttctagtgtaatttgtttacttggaagaaacttacaattgactttgttcagtgagagaacatggtgagcctacctttatatttaggaacaagacagttacaattggcagctagcttatattttggagaactatttaatatgtcactgatatagagctagagtcacatcatattactgtaaaatctaaatttaaatttactctcaagaactttcaaagttaaactgacatataaaatcaagagtgtcgatttaaaagcaaattaaaatttctggcagagagtaatatgcaattagacctatgtctgtcactctgaaatatgaataacagtatactttctagaataagggagggtataacttttattatacatattagtccaaaatttttcataaaataatttcccaagaaatgtaaacatattaaaacaaaagtatatatacacattttggtgcctggttaaagagaagaataaagtaatgaaaaagaactatgtttcactgtggtttataaataagatattttgattactacaaagaggagccatatgtgtactctataagaacttcaaagctgaaaagttcccaagagaccatccagcccaatcctctattttactaacgaggaaaccaaaacccacagagttatgcgacttgcataagcgaattaatcgcagacctagaaatcctgcataacaatctagagcatagcttcctctctgacatttaatacctctctcctctggttcattcttctttgtttcttcttcacccgtaagggctttttataatcttagtgatggcctacagaaaatacaattttgtgaattctaatgaccatagaaatgctttggcctatcaattatcaccgtaagaatatataggagatatccagtaagaaaagtatctcactagtactgtgcattctacatgtccagcagaaaaatttaaatgactaatcttcataatgtactcattggagaacagcttgcaaataaacataactcaagctttaattgcattttggtgcagaaagtttatcaatatcagttagtgtattttctcaggtaatcttacctcctgagatacgttaactactttttatatatatgttaatttttatttatgatagatgattgcagagagtactagagcctaaattacagttatacagtccatcaacatttcacttataatccgtttaatgtaaggaaagcaataaaatttaaaatgctgcaaatatatataagtgattcctttattagcttttattcttatgttgttagttttcattatcacctatttaaattagctagggagagaagagcaaatatttaagatggcagtaattgtcctcatgaattaaaagtaacaacataataaaataattatttagtatgcacactttaaaaatttcaagcaatttaaattacttgaattagaaatcagtgattttcagagattaaatattcttactcctatcagaatagtatcagatcttttatagttagacttgaaaagaagtaatccagattttcaatttgagatttttatattttctatgcttctaaatgaagcatgtatatttttctcacatgctcaaaatactgtcatattaggtttttcacctttcatgctcgtttggctggacaggaggagttaaagaaactgtcagtgttctcttttattaccaattaatgggggaataatctcaagaattaaagaaagcattcaacccgtaccaatcattttgtaaacatctgaatactctaccctcaggcacccccaaataataatatttgctaggaaaaaagtccttatttatggaatgtttttagcaagatatccctgtgttaggttgcttatggtaaacacttagcaactttagatttatgatcacggctctatggaaaatcacttatcagctagatgaccatggaggaatgaaatggagatgcttcataaccgaaatgcttctgcgtgaggcaataaactgcatagcttattaaggactgtccctattactctaggccagagagcacatgtctgatgaaagaagaaaaagcctgaggaactatgcagtgtgtatcagatcccaccttgctttgcttgtccctctgttttaattacctcctctttatcccatgggtaagggaggattcctgtcctggggttatgggtatgacggaacacctgacacctgacgtaaagcaactgagaccaacagcagtttattagtggcatttccacacaggctttgagagaaaggcatctcaagtctcgcaggggacatgggggttgtccttgggaacagagtgagcaatcagacactgcgggaggcaggatttgttgtatcaagagagtggtcttccccctggttcccaccggaggatgtgattggcttgttcgaataattctgtgggtgtagggtaggagggaacggaagcccaatactcaaggagaagtggaatatgcctgatccccgagggaagcagcgtctttttattggaggacatatccgcaggaacaaagttgggaggggagcttgcagtgaggtcactggagaccctccaggcttttcccagatgtcaaagcacacataaactgggccttacttttcggccttataccacaagctcttaatgttttgttttctacaattattaataatctttggctctacataagatgtttgctttgtgtaaatttgatttaacaatccgaatttaatatcaccgtataggttgcattaattactaactttagccaaatcaacaacatgaacaacatgtaaaatcccatataaaattttttcttccctgttatcagaacagaaaagaaaaacttccctgtttttcttccctgttataaaaattatttcttccttcttaaccaaccatttatcatgtctatttagctgtatgtgctcttttaaacttgctgtgttggctgtatttgtgtatcataaatataaactagaaaatggacaagtagcttcctaaactttgaagtgcaaatgttttattaagggaaaaaaaaaccctctttcccatggcattgcacttccatagaaaatataattatttcccccaaatccttttacagggttttgctatgttccaaaggacagggactgagctcactttgatttgagttggactctgaacatggttggattaacagcctcggtcattaatctctactccaaatttcagcatgctgtgtccatctattacaggtgtgggtgtgttttttgttgaaacaaaataatgtatacttactaatgctaaagttaacgaacaaaagcaaggttagtaatttttgcaacaaaacctacccagtgagggtcccagaaggctatctgagtaatacagtggggcaaatggtttcaattcaatctctggatgagctttgtttgtttgtttgttcatttgtttgtttgttttggagacattctcactctgtcaccgagtctgcagtgcagtggtatgatcatgactcactgtagcctcgacctcctgggcttaagcaatcctcctgccccagcctctgaagcaactgggactacaggtgcacaccaccatccctagcttattttttttatttatatttttgtagagatggggttattttttttttggtttgtttgtttgtttgttttccccacgttggttttagactcctgggcttaagcaatccttctaccttggcctcccaaagtgttgggattacaggtgtgagccactgcaccaggccaagatgatccttttcaacagcgtctaagttaaaatatgctacaaatttatttaagatcttgctgtaaaataaatcatttgaagtcgatatcatgaaacaacaggagaatgcaatgtgtttcctcctttgtcaaccaacagtgtggacccagcctggacttgcccacaaacagctgagcctaaagcctgcttcatccatcacctgaccttccataatgactctatatcacctcatttcttctattttttttaaaaattatgctgctctttctctttaatctagtttttcttcttcttatatcttctttctaaaataaaagagcacataaatgttttaaaacaaattagattttcaactttcagtaaagataaagttttgtcagtagggattaaagtttgccatcctcgacattgttgatatttctggctctataattcttggctttggaggaaagggctgtctcgtacactggaatcttttgcaacatccctggcttctacccattcaatactagaagtgcatcatatttccctcagttgtgacaaccaaaattaacccaaaagtctcctagtggcaaaactgcccctgggtaagaactgctgatatagatggtgctaaagtgtcacctagaaatcagttcattgtgttcctaggaactacgaaaggaaaattgacacattgtaagaattgactcaacattcatttgatttatatagcagtgtctgttatttgcagaaagcacgtactgcatgctgagatttccatagacttcatattgataaggacaatatttatggtgttaaagtatgcctacatatatagatctcctatatatgtactgcagataaaaatactattatgtcacctcatcagcataaatattgcaaaagaaaatgacctcttgaattctcatatcgtttgtctgtgatttgtggagaattacacaacattacttctaaacattttcaatctaagtggttttatttttattaattaggcattactttttattttgccattaaggatatcatcttttcaaccaggatcaatttgaatctgtaatctcctttggttaattggacattttccttattgtgaatttaagtttgggatcaagaggagattgattagatctgccacatagtttggccggggattatttatatagctgtttctttgcatttcacttttgctaaaaaagtagacattcaaaacaatataaatttgtagtctgttagcaaagtgtattctctaatattctattatagatatagtatgttctatagagtatattacactatattctattctattatagaatacactttgctaacagaataaaatttatattgttttcacgcactctattcacatttaagaaacattaaccttcataaatagcataaaggctgattttctctaaaacagagcaaacaaatcaataaaataactttgccccacttcttagcttccacctcaaagggttcttttttgttcgtttgttttgtttttgtttttgctttttgagatggagtctcgctctgtcatccaggctggagtgcagtggcgtgatctcggctcactgcaacctctgcctcccgggttcaagtgattctcttgcctcagcctcccaagtagctgggactacagatgtgtgccaccacgcccagctaatttttgtatttttagtagagacggggtttcaccatgttggacaggctggttttgagctcctgacctcgtgatccacctgccttggcctcccaaagtgctgggattacaggcatgagccaccattcccgtccctcaaagggctcttttcctactaaggaagtaaacgatgcaggcctgattgtgtgtttttttgcacttttaataacaccttcattgaccatgtgacaccacacaataccactccttggtgatgtgcttagcaatcccaaacaaacctttccaattcacataaaatgccacacaccctattcctccctacctcttagggttgtcataagaatttgaatgatacatgtgaatgctcttctgattttgaggatgaagtcactgtgtcatcttaatcatgcttatttggagttgtgcctagaggggcataatacacagtgtgaaaatatgttctattgaaagttcaaacgattgctttagtggttgatgccattaaattggtttggaggatgttttattgcatttaaattggactgaccacctcaaagagctatttggataactctaggcaacctcagtctggcacagataatccagttacttagtaagagtcttgagcacaaaactggggagggggttatatgataattctgattttttttttttttttttgcaaataaaaagatactcttgactgtgatcttatttccaattgtacaatgggttcaccttacaaaattaagtatagtactatccccatgcttgctttttaattgaggaaatagtgggtggtttggttaactaaacaaccatttgttagattaattctcactagcttgattcagaactatacctagtaggaaatattggagctaggaactgagcaataagcagcatttatttagggtgtctggctcatatatattgtgtccttacaacaaagatgcaaaacaggtaattattcccccattttgcaaatgacaaaaccgaagttgaagaagtgaattaacttactctcataacaagcaatgtcactttaatttttggcctttctaccaaagcatgttacctcttaaagacagcataaaatcagagcataacagattcatagaaagaatggttataataataattactatcattactactataattatagtttgtatccagaattgattaatcattgattataggtcagatattgtgctaagttccttatttaaaacctcacgatactgctacaactatcttcattaggaactatcttcattttaacaatatgaaaatgaaggacaaaataattttttgtttattcattcaatcactaagtgtaaaaataagagcgattatgtatttgcttgtttagtggtgccatattctcaaaggtcccaaagtaacaatttaaaaaaaaaaatgtatctgtccttgaggggaacacagtacatctatagtacaatttttcctaagagtagttatttgaaagtcatgacaaaaagggaagtggtcaaataaactgtgttgaacagccattgcaaattatttaaagcaattttaatggcaacaacaacaaaaatatgtattaggtgaagaaaagcagaatataaaattgttaatacagatcaatatctctttcacttagcagtttgatttcaaaatgtgcaggctgggcacgatggctcacgcatgtaatcccaacactttgggaggcaaacacaggtggagcacaaggtcaggagatcgagaccatcctggcaaacacggtgaaaccctgtctctactaaaagtacaaaaaaaatatctggggccgggcgcggtggctcacgcctgtaatctcagcactctgggaggccgaggcgggcggatcacgaggtcaggagatagagaccatctggctaacacggtgaaaccccgtctctactaaaaaatacaaaaaaattagccaggcgtggtggcgggcgcctgtagtcccagctactctggaggctgaggcaggagaatggcgtgaacctgggaggcggagcttgcagtgagccgagaccgcgccactgcactccagcctgggggacagagcgagactctgtctcaaaaaaaaaatagaaaaagaaaaagaaaaaaactgcgcaaaaattacatcaaaatactaatcatatttctgagatgtagtattatggataaccttttttatgtttttctgcattaatattcaataactttattactaatattcaaatattactataatcgctgaaagacaaatgctgtatgattcaacttatataaggcatctaaaatagtcacattgatagaatcaaagagttgagcggtgggtgccaggggccggggaggaagaggaaatgtagaattactattaatgggcatgaagttgagcaagatgaataaattctaggaatgtgctacacaccattgtacttacagtcagaaataatgcattgaacacttacaaatttgttaagagagtagatctcatgtgtttttaccattgtaaaataaaattaaaaaaatgattagtcaaaattgtgaaaaatacaaaacatatataatttgctttaaatatcattttaaaatatgtacaagatttgtatctcaatgtataaattcagatgcacataaaagttctcatccctttatttatcagttttaattttaagcttccatcttgctgttctttcgaaaggcttactctaagtcaatcctggtttcattttatttcagggtcttatcgtgtcattgtgtgcacacacttgtatgtacatacagtgatgcatgtgtgtatacactcatgtgttcccagagactagttgtgatacttacagtggcccctgtttgtatttcctcctccacgattcagtgattctctgctgcttttcctgcagtcttgggaacttgaatcaattgggaatgtgttgatggtccacctataaataattatcccaaaatagcaaccaattactttatttgaaaacaaaacaaaacaaaacaaaaaaacactagctgaataaactagtatacttagtattcggatactaataacataattcaaaaacagttctttggccgggcacggtggctcacgcctgtaatcccagcactttgggaggtgggcggatcacgaggtcaggagattgagaccatcctggctcacacggtgaaaccccatctctactaaaaatacaaaaatttagccaggcgtggtggcgggcgcctgtagtcccagctactcaggaggctgaggcaggagaatggagtgaacccgggaggcagagcttgcagtgagccgagatcgcaccactgcactccagcctgggcgacagagcgagactccgtctcaaaaaaaaaaaaaaaaaaaaaaaaaaaaaaaaaaaaaaaaaaaccagttctttatgatatatataaaattaaaaccatagacagtacctacaatctatattttcaatatcacattaaaaaagcagtgtaatatcagtatattattgtgatttatatgtcacaatttatccctgcttaaatatcatatagaatgcttaaaattgtattaattcaaagaattattcacaatgtcattcccaatgtcactttttagtttagagcagagtatgcatgcacagggattatttgtggtaaccatattatgaagtgtagcattatcttttattataaatgatatgatataatcaaaagagatggccttttgggtttaaagacaaaataaatgccacgtttactaaatgggtatatttgagatgattgcttaagctttccaaatcccatttttgccactcataataggaataagaatgcttacttcatagatttgtcatgaagattaaattagataataaatgccaagtgcttagcaccatggctggctgaaggtaaggatttatacatattagcccttattattattgctgctgttgttcttagttcttccctttggtagtgcatagagtcatgtagtaactgtttgtacttcctatattctcaactctgaaatgaattttattatctagcgtctgttcttaacctcacaagaaaacatgccttaaacattaaataagcataaaaatgaggtcttgatgctcacacagagaaataagcattttccagaaggagttgccttcaaatcaaaatataattgatactactcagaaaagagattttctctctgcactgattgacttgaaagcagaatagaagactggagtcacggagccagaaaatgtttagaggtggctggcttcacatgtattttctagtccaactattaagtttgcagatgaagaactgagaactccctgaaagaggaaacggctcctcctgagacttccccataaggaactagtagcagaaccgtattggatttggttttagtgcttagccccatgctcttccactatattacatttaaggtaacatgtacgttttcatttctattagaagtcatcaatgggtggactttgagtgtgagcattttgccttgcatgtaatagatattcttaaaatagttgtgaaagaatgaatccctcttttatctatcctatatatgaaatgactttgttggtaaaaaaaaatggccaattgctcagcaatttacactagaggataattttacaaccgcaggtatgggacacacttgggttcctttccacacttggacattttatagatgcatttttaagggaggaggagataacagcaatctcagtttttttctggaaaataaaaataattgttgtatgcccagtggaactatgaaggagcatattgggcccaagaaagtaaagaatgtctacacttaagctatttttaaataataaattaattcataggagaaacaggaatgagaggcaaaaatgtctagtaattaatataaagtccagcaaaatgacttaaaaacagttatatttgcaaagaagactcagcacacttatgtcataaaaatccttgtctagtcacagttttaatttatatataaaattaaaaccatagacagtacctaaaatctatattttcaatatcacattaaaaaagcagtgtaatataaaaaatataaaagcagtataaaaaatcttatctagtcacagtttcaatttctcacaattgtatgatcattttgacattataggagagtaaggatatgtaagttagctaagaattacagcagctttcgagaaagataagacagagaagtgagagatggaaagaaatagggacaactcatcgaaatcaatataaaatatgttagttaatagcactgtttgcaatctttaacaaatgtcctctagtggtttttaagtatagcacttcataagccttttgaaatggcatgttaaagtagtattaaaaggctgacttaccattagcatgctatttaatgtgtcattttaatttttaattttggagagttcctagaaatagtgtattgagtgagcattaacaaaagattattaaaactccaatgtcaacttaattgatatatcagaattcttatgacaaatagttcataaatttgtttcacacattatgaaatggaaaaaagtaacaggcacatgctctgtatattgctgttaagtgcatatcctaccataaaaacctctccattgtataacaagaggcttgtgagatacttgatgaaagggtagcatctcacctgctaaatgatgtggaagaattctttgactgaccacaccatctatagagatttgacattttccctgtgcctcacatagcattcttcacaaaaggtgagtgttgtttgtattaccttgaatgcacacacaccgcctttctttcctcccatttctttcccatctccagtcacagttcttatagtgtatttttctgtaagtagttgcaaaatattcaattaatagcagaggggacttattcaatgtcaatatatccttaaataaagaataataaagaagaaattactgtagggaatggaaaatcattctctccatctccaacaaaactatataaaacaaatccattttctaaaaatgttaaaatcttcccagttggctgaccttgtttcagtccagaaagacacagatttttagaactaagactgtgaagcccacatcaattttgcagtttcaagagctcaaattccttatgaaataagctgatgaaagtgtttaacctgtccaaatgaaaaataaaatgctgagtatttaaatgcctctgaaattaagtaaatctgttctatacatgtttttcttctaatttctgcttctgatagaaaatagtttagatgagattgttttaaatgcacaaatggacaagaaatctactgtaatataaagccctgtccaaattccagctcttcccttattagctatgaagccttaagcaagtcattgacctttttggagctcagtttcctatatgtaaggtgaatgtgataatagccgttatttaatattgttaattattaattgaaaagtttaatggaaaatgtcttgcacatagtaattattaagcaaatggcaaccatttgaatcttcactagaggctattttgtattctaagtcaagaaatatattggataagaatgaaattaagttgactacagatgaacttttgatgtaagtatgagcctatttgttctaactaactattcagaaattggggcagtgtaattcttaagtacaatttaagatgatcttttccaactctcatatttaaacaccaggtaaacaacattaggagtggctgtagtttgttggttgccaactagctggttagtggcagacacagatttgaacctacatgtctgttgtgtggataaagttttcctcttatatcctgtcacttatatgttcagtttcccttgtatcttaaaattttatgaggaattaattatgcttttttagtatattcttcaagtccattatcaatttcttaaagacacaaactggttattatactgaattcctactcttctcagcatctcaaaatgtaagttgcacaaagctaataggcatttttaagttgattgttagaagtagaaattattataagtaaaaatcattagaaatatatttctgattttacttacattttagtcaatattaaaattaggagttttaattaggaaaattaagaaaataaagacggtgattttctcatgaagttgactcatatcttttgtacctgtctcctttccaaactctgaagtataaaaaaggtggaaaaggtggttttataaaacaaaacaaaacaaaacaaaaaacaaagaaacaaaaaaccttacaagttaattcagaggtctaaaagcaaaagcttgatatctgcaacaggagcttgatgtacagaaactagaaggcaacaaaggtcacactgacctattatttaattagaaagaacaaaagttttctcaatgaccctaacagttctttaaactgaattgaagatgctggtagactgtaactttcagcagatcgtcgtcagttctaaggttatttcgtcagttctgttaccattacagccaagacatcatacgacagactacttcaaatctcacctctacttgccaaatccgggatgagaacaggacaggtgacacagcagacggtggcttctccacgctcatggttggctgaagttgccttctagatgggctttcctttttataaaactaaacagcatatcacactggaaattgtttttgccttgtagatatatctggtaacaaattctgacatattggattttataaattctatttaagccttacaggagattttaagtttcctaaaattcttgctgtgttcattcccaattatagactagtaagtgttcacacagactctaacgagtttttcttactgagaaagggtgcacaaactcataatgggggagaatagtcaagataaaaaatgttggcatcagtaattaaacaggtttgctttccctaatgccaaccatggtgggtatttatttcctctttattttgaagaccacatgttagactgtcttttagtcaggtaagattgctgtaacaaattaccatagattgggtgattgtaaacaatataaatttatttcttatagttttggggactggaaatctaagatcagggtgctagcatcatcgagtttgggtgaaggccctgtacaaggttgcagactgctagttccttgttgtatcaccatatagcgaagagaacgagctagctgtctggtcacttcttaaggtgggactaggctgggcgcattggctgacgcctgtaatcccagcactttgggaggctgaggtgggtggatcacgaggtcaagagaccgaggccatcctggccaacatggtgaaaccccatctctactaaaaatacaaaaattagccgggcatggtggcacacacctgtaatctcagctactcaggaggctgaagcaggagaatcactggaactcatgaggcggaagttgcagtgagccaaggtcacgccaatgcactccagcctggtgacagagtgagactccgtctcaaaaaaaaaaaaaaaaaaaaaaaaggactaatcccattcataaggcctccaccctcatgacctaattaactcacaaaggccccacctccaaatgctgttttattgggggtcagatttcaacatgaattttgggaggggacaccaacatttgggcaatgagggattagatctactaaactcaaaaaactgtgtattgctattccaaagaatggtattttttcataattcttttttatgagtatgctataatatttacaatgtagcagtgactaatcaaaaacccacctgtccgacattaattcaggcatccataagaagagataatctgaactgtccctagaatacaaatcttgaatctgacaggtactatttcactttgggcaaactacttaatttttgagcttcaacttctttatccttaaagatgaaacaaagaaattcttcattgatagaaagaaaataatttcaacaagcattctgttgagtatcttatgaagtctcctcagctcagtgccacacttacctaatcctctcgattcgcattcggttgttctcttcccattccattttgtgttagtttcttatatggcacaatttccacaaacttatgccttagaacagacatttattattttactgtttttgtggaccaggtgtctgggcatggcctagcccatcggcgtgtcagcctaggctgtggtctgggctgagattcaggcttcttgtgcaagctcgaatactgttggcagaagtctttttatcgcagctatagaactcaggatggtttacttcttcagggatggcaggagagacagcctttgttgctacaaatctcaaatctctgtatcctcttttaaaggggtcatctgcctaactcaggcccactaaggatggtcactcttctgacctaaaatcaactaattggagacctgtgagcatcagttgtatgtgtccatttggcaaggctaccttcttgggttggccaatcaaacattaacttaggtgttgtatggaagtattttatagacaagattaaactccataataaattgactttatttatttatttgtttgtttgttttttccaagacatagtcttgctctgtcgcccaggctgaagtgcagtgactcaatctcagctcactgcaacctccgcctcccaggttcaagctgattctcctgcctccacctcccaagcagctgggattacaggcatatgccaccacgccaagctaacttttgtatttttagtagagatggggtttcaccatgttgaccaggctggtctcgagctcctggactcgtgatccgccaacctcagcctcccaaagtgctggaactacaggcatgagccactgcgcttggccacaaactccataataaatttactttaagtaaaggaggctatctccaatagtctagctggtcctgggcttcttcccaagagtttccagtctgcctttcctgacagcctgtcctatggacttcagaactgccaaatcatcccctacattgcataagccaatttcgtgaaatacatcttaatatttgtgtatcctcccgtgtgttagtcctttctgcattgctgtaaaggaatacctgcagctaggtcatttataaaacaaaagagtttatttggctcatggttctgcaggctgtacaggaagtgctggcgtcttctggtgagacctcagaaacttttactcgtggcagaaggcaagggaaatctgttttcacatggcgagagagggagtgaaagagagaggaagtgccaggccatttttaacaatcagatctcatggggaaaatatagagcaagaattcactcatcacccggggaagggcacagagccatttatgagggatccacccccatgacccaaacacctctcactaggccccacctccaacattaggaattacatttcaatgttagaatggcagggtagggggagagcataaatatgcaaactctatcatcctggttctgtttcttcagtgaatccctggctgatataggaccttaattacatatactaaatccacttactatgctgtataacataaccataatcagaaaagaaaacccatcatattcacagattctgttcaccctcagaagaaggggattatacaggtcacctgtcccagaggcaaggacatataggggccatctcagaattctgtcttccacatattctccaactatttactttttattttctaataaattctattcacggagaacaaacagtatgactttctgggatgggacagtaagaaagcagttggtaggggagggaagaggtcacataaataatggaattaaagctttacgtaacatagagattgagtaaagatataaaagctggccctttctgacaatcggagatccagttccccaaactcattagctgctaatctcaaagttgcttacttactatcattctctgttttctagtaggtagagttgtccaatagaattttctgtgatagaggaaatattccacttctgctttgttcaatacagtagccactagccatatgtagctatggagcattcaaaatgtggctatagtggctgagaaacagaatttttgttattaactaatttaaatttaagttcaattaatcatattgggatagtggctgcagtattagacaacacagcatagaggaataatctatcggtcacagctggatttctacaggaaacttgacagctttggctataaataagacctgtgatatgtctgcagtttcaacatttgttttattaatgtgtacctgacaaacaaatgacctgaaaatctcttttcaaccagaaacaaaatagactggctcagtactatgctttttacatattgcaattttatgtgctttgttttcactttaaagaaaatatattgtgcctatctacaatctcagagggaaattaggtatatagcatagtctcttttcacgtggaatcttttgagggggactagattcatccgaaacactcaaataaaaatataaatagacataaatgcagaggcagaaaaagcacattgcctgtcggggaaaaatgagctatcaattcttctgtagccaaaaccacatatggttagctcattttcaaggttcaaatgctctgagaagtgtcatcgtattaaccacacctaagaacggatattcggggaattctgagatcctaactgacagtctgatcagaagttgggtcctagagagctcagaaggactgttagaatgctgatctgatccagagattacccaatgctaggattttagtctttgatttctatatagcctacctgtggttccagggaatttgaagagctttgcatttgtcattaaactgaaagagtcatatagccttgccagggaaagaagacagggatgcaactgctgattaaggccccatgtttttatgtccttcttagagtacggattccatgtcaggcaactttaactagctttcacaaatttctcttgaatatactcatattgttggctggaaggtttaaggaattatttgagaaggcttctcatttacgatggaaatgtatcagaacatgatttaaaactaaatagcagagacctctgttttcaaaagaagcataattaaaggaaatttaccactggcagtgtgtgtgtgtgtgtgtgtatttgcttcactccaggcccaggacctgggtatatggtttggcctctctttttctcccaggacctcattatgtatccctctgtgtcttcaactctgtgggactcttgcttgacttcttccagctgtttcaccatagacacattccttttattttgctgtgtaaagcaattcaacccagccttctgactggtgctctagggcctataatttcatcggcaaatggcccatcaaagtgtttagttaaattttctccataacagaaattttcaagcaatgttttaaaatagtgactttttcttctttttaacaaataatgaagtgatacttttaaagttattcagctaacaggtataaagcagattatcctgcaaaaaaaaaaaaaagatgtatacattcctccaaccatactctgtgggaacagcagcaggactgccccgtgcatctttcagcaagcaggagatgcatccctctcttgtaccatttatattaggctttaattatctctctacataactgcagtccccaaatatgaaatgagttcctgatggcagaaaaagcttcatatcaatttttgtaaccccaggccctagtatgctctctggcacctaattatagcaatcagtgaatacttgatagggtcatcattcacttaacagatattccctggccacatatgagaaagtgacatttaagctgagatctgtaaaatgagtaagagtgagacatgtggaaaagaagatacgggtagttaaggctgagggagtggcacagaatgaatcaactagcaagttaatgaatgaccaaaaatgctggtctatgtagtactagacagaggatcacaaatatcttgtttcaagtcattcttgagagttctggccatctgtatcaaaaacttttgtttggtcataataacaatcattgattcagtaacaatgactaagaaccaaccatgtactaggggctggatatgcccagggtatcatgatgaaaataaaaaccagtctctgcctttgtggggagactgacattacagatctgcacagtggaggtcatattgcacctgtactcatcctggaggatggtagtgctctcaaggtaatagaagccaacggaaatgtgacttcagtagtgatctgagggagaacttctccagggaggtgatggctggttgagctttggaaagtaggtgaaggtaggaggaagggtcatatttcaggtaaacaaaagagcataaacagaactcttggggcagaaagacaaggctggtgtggctgcagcaccgagattgaagggtgatttggtatgaaataaggctggagagttgacaaatcctgcaatagatggctttttaggcaatgttcctgatttctggttttgattccattagaaacccaaagagatgccaccaaactatcttaagccaacagtttgtatgtgttggagtgatggacatggaggaagcatatcatgatcatgtctgctctgggtaagccttgctctggctgtggtgtagaggacaggtctgaaggcagaaagagaagacttggtaacacctgtcacaggatatgactgcagtgccagggtgagacctggcagcctagactaggatggtggtagcagagtggaaatatctgggaggattgaagagctattagaaggtaaaatctacagaacttggttgtgggttacatgtgggctgtggtggaaaaaagtgctggaaatgcctcccatgtgtcagtctggttttacctggtattgggcaataccatgcaggtatggactgatgggagagactcagatttaaagaaaggatcacacatctgttgttttttttatttttgaggaggtgaacttaacactctgggtctttatttccttttcttcctttattcttttttttttttttttttttttgagatggagtcttgctctgttgcccaggctggagtgcagtggtgtgatctcggctcactgcaagctccacctcctgggttcacaccattctcctgcctcagcctcccaagtagctgggactacaggcacccgccaccacgcccggctaattttttgcatttttagtagagatggggtttcaccgtgttagccaggatggtctcgatctcctgacctcatgatccacccgcctcggcctcccaaagccttttcttttttttttttttttaacttttattttaagttcaggactacatatgcaggtttgttttatggataagaaaatgtggtacatatattccacaaaatactatgtagccataaaaagaatgagatcatgtcctttgcagggacacggatgaaactggagagcatcatccttagtaaactaatgcaggaatgtaaaaaaaaaaaaaaaaccacaaatactgtatgttctcgcttgtaagtggcagctaaataatgagcacacatggtaaatgttgaatccgaagtgcctttacggcatctacaaggtgttgcgtggataactaaataaaggagtcaagatctcagcttggataggacaaacgacaaattgtgacttagctatgcataggagaggtaattgaaaccgtgtttggatgagatcacctaagggtgagaatagagggtgagaaaagaagagcatctaagactggtccttagatctaaaaataatggctgaataatggaacataagcttcaaagcagacagagaatgagtggcaggtaggtcaggggaaatctagaagggagatgtgacaagaaagcatgccaggaagacagaaatgggcaccagggatgagcactgctaagagatcatgcaagatgaggactaaaatattgtccaggaaattagtaaaattgaagttgttggtgaccatagcatgagttgtttatggaagggacggaaatttaaacctgggtgatgtgaatggagtatggggatgaagggtggggttaggagattgagtcagaaaatgcagtgtggcatttccaaatgaaacacagcatcagataataggataaagatgaggcatttcatttgttcgctcttttaaacagcctgcttttggaatcaagatggtgaattcaattaacctattattatttcttggtatatgacagttcactagctattgcactccgtagaatttatttcattctattcaccctggctgaagaaccataggtaagatccaacattttcagtggcagcccctcaaaaccaacgtgtttccctgataatcattctgcttcccttcttttgttgtttctggagatctccatctgctcttccatttatcatctgcttgatattcttggatggtgtgcttggttggcctatgctatgggttcagataggcaagtaactatattccccttccccattacagatgatgtgcctcatttagctatgataaatatttgctcatttcctcacatctgcatatggcactgctaccaatccatcttttcctccccatcctcatctctgctaagttcttttcctgccaccatttctatggttgaccagttagcatttaagaaaatatgctgacagtagccgcatcatggattagcatttcttcatgttcataatgcaaaagccccattagatgtaaaaaacttgctttcttatctttcctttgttacacttatatggaaccttttagaagttctatttataagtagaatgatatgaataaatagaaatgtgccagtgaaatagaataggccaaaatatacatcatattaaaaatgaaaatcaatcatttaaataatattatggctctttgaaataatattataccctatatcaggaggtttgtgttttgtcttatttcattttcagtatgtttctattgaaagtgagattgccatcaagaattctcaaaaccttctggggtgagatttcagagcttcaactatgttaatagctgtgcttggcatatctaatggtgttttgctccttctgaagcattttttttaattagacaatacatttataaccaagctcagtgagggtccagattgtggatgaggattaaattgagattaagatataagtgtctggtccattttaggaagttgtcaaacaccgttaagagtacacagtaatgttattctctgattgttgaatataggcaagtttcaaaaggacccttcacagttatgaaacttttaagtttgctatagtgaaaagattgatacatgggaataaaaattcactcatgaatctcattttataaataaatgcttcatttatgtaaattgtttgtactttgtgtgggtaaacaatattgattgcacatctagttgaaattactggatgagaagtattagtatcctattcttatgtgtcgatttaacctacagcctgggttctcttgactgccacattcctttaatttcctttacttttatatactcatttatctagaacttaagaaatccccatggcttgtggtaacatgaactgaagatggtattacaacacatttccttctagctctacccagcacgaaagctttattataaggattctggttcttcttgctatttggggagtaatattttgaaaattcataagattatgtccatcaagcattccagactaacaataataatagtatatgaatgtatgaaataccataacatttttaatatgatatttttaaatgaataaatttcttcttttttcttttttttaaattatactttaagttctagggtacatgtgtacaacgtgcaggtttgttacatatgtatacatgtgccatgttggtgtgctacacccattaactggtcatttacattaggtatatctcctaatgctatccctcccccttccccctaccccacgataggccccagtgtgtgatgttccccaccctgtgtccaaatattctcattgttcaattcccatctatgagtgagaacatgtggtgtttggttttctgtacctgcgatagtttgctcagaatgatggtttccagcttcatccatttccctacaaagaacctgaactcatccttttttatggctgcgtagtattccatggtgtatatatgccacattttcttaatccagtctatcattgatggacatttgggttggttccaagtctttgctattgtgaatagtgctgcagtaaacatacgtgtgcaagtgtctttatagcagcatgatttataatcctttgggtatatacccagtaatgggacagctgggtcaaatagtatttctagttctagatccttgaggaatcgccacactgtcttccacaaaggttgaactagtttacagtcccaccaacagtgtaaaagtgttcctatttctccacatcctctccagcaccggttgtttcctgacttgttaatgaacaccattctaactggtgtgagatggtatctcattgtggttttgatttgcatttccccgatggccagtgatgatgagcattttttcatgtgtctgttggctgcataaatgtcttcttttgagaagtgtctgttcatatcctttgcccactttttgatggggttgtttgattttttcttgcaaatttgtttaagttctttgtagattctggatattagccctttgtcagatgggtagtatttttaagtgaataaatttctaagtgaaatcagttatgactttcaaagcaatttttaatctgctgcatttttattagtgatgaaaagtatatgagttttaatcatgaacacaatttaaaaagtcaaccaaagacttcaggatgttgttccttgttacttctgtcagtgtaaatttcattaatactatgggtgatgaataatatgcaatgtttaagctgtttatattttctactttaatagacgttctggctttactatcaaaaagaatgcaagatttataatttagaaaacaagaagaaaaagagcattgtgaaggtcaaactagctatttgcattttaaaatagctacttctcttttaatggacgttgctacaaatgtatagcaataacccctcagctggcaaataaggaacattgtattagtttcctgagtttctttaaaacacaactgcttcgtttcctcccacagatactatggtattagatgttttaattgaattacttagaaaatatatcgtttagcttcttaatataaaactaattttaatctgagaaaatttaaaaaagtattttctcatccttaaattcttttttccattgttttccaatttagccctattgtgtctacaactcagattttaatcttttttttactaaaacaaatttattatttaaaaaaattaacttttctttttttccttataaaagtaacctacatttgtatctttagttctaaaattacaggtggccctaattcttttctctttggtatctggagaaagtgaatgcaattatgattagcagaaatgcttttttttcaattgcacactttatttagtggaaacaaaagatgcatgtatgattcaacttcacaaaaggaaaagactcaaagcaacactggtgatgagccgtttcatattcttaggtagacgcaagatccccgtacttcctgaaaccttatctaatagtaaaatattttctgactgtttctccagtcttttaccactcttgtcaatggatacacaccaaatacataaataatgtatgcaggttcattttgggtaccatctagctacacagcccagtggagtggttgagtacaaaagccagcctagcttgaaatttcaagctttgacattttctagcttccttgggcaagttacttagcctttctgtgcctcagttttcttacctataaaatgagaataatgatagtaccctcataatagggtgattatgaggattgcatcaggtaactttgtaaaggttctggaacatatagcaagtactatataaatgtaatacgtatgcaattaaaataggcttcaagatacacagattacagataaagaaatagctgtagacagaacatatcactttattcactccacattattactttttacattttcaggcttcttactaccaactaacagggtatattattagttctcttgtctatgacatctgatataccttccttcctttcaaagagtgccaaacattttaaatgatacttacatttttctccaatgtatgctgcacaattaagtagattgatagatatttttcatcagcacaaagagaggatcgcaatacatataagactttatctctgctgcaaaatataccttgaaagaattacatgtataatgaaaataaccctgacaatgccaactttatctgcgaaatcactggccgttgactttctgtgaaagagttaagtacgttgctgtatcaaatattcagttactcattaattaaagtagaacaaagtcaatactttttttgttcagcagattaaccaaaaactaccatgtaccatgtttgcaatttatattcatcctataaactgcatatgcattaaacatttccatctggagccccgatgactgtttttctcccatctcatgcttgataagctgttactgattagacagggaattctgaagctgttgaaagcacagatttttttaaagctctatcaccttggtattctttatctcttaacagaccttgcttgatgcctgcaggttccattttggctgcaatccagataggaactataggtcccctggccacgatggtctaacacagacaacgttatttggtatctatctaattattcctccattaaaaaaaactctctatctagtctaatttctaatattgaatttttcttctttaattgtctcatttaatttttttttttttgagatagagtctcactgtgtcccccaggctggagtgcagtggtgagatctcagttcactgcaacttctgcctcccagattcaagcaattctcctacgtcagtctcccgagtagctgggattacaggtgtgcgccaccatgcccagctaattttttttattttcagtagagacagggtttcaccatgttggccaggttggtctcgaacttctgacctcaggtgatctgctcaccttggcctcccagagtgctgggattacaggtgtgagccactggcctggccgtcttatttaatttgatgtcaaaccttaatttagtctgtgacatactctgtaatataacataactagcatattttggtgcatggtgttttctaactattgttataaagattttacgcattttgactgatttaatcctcactaactgtgctacgaggtagatgttattattatccccatttagtaggaaaactgaggtcacagggaggttgagtaacacagctaggaggcagtagagctcagccaggaacccagagcttctaattctgggacctgtgctacctgccaccacaccacggcctgacagagctgtcttcatcccaccgttagtgggacatgcagtttgggatgttgctcccgtgaaaaacagtattcaaaagacccacagcctgactccttctttataatacacaccctggatagcattaggagatatacctaatgctaaatgacaagttaatggttgcggcacaccaacatggcatatgtatacatatgtaacaaaactgcatgttgtgcacatgtaccctaaaacttaaagtataataataataataatgataataataataataatgctaataataataaattaattataatacactccctgcctgactccttctttataatacacaccctgccactttgtgctacctgataggaatcatttaatagattaaaaatggagtatataatctgtgtgctattaataattaaaaacaatgacaacagcaaacacaataacaatcccatagctgctgtttgttgagaatccccacgtgtttgtcctttcacagtgtctgtaagccgcgagacttactgtcatgtgtcatcagcacctgatgagatattttaaatatcacttcatactgagactcagaaaagtgctctttcttgtaaaagggcacaaagttagtaagtagtagaaccagaattcaaagcctagtccttttttttttttttttttgcatagccatatgctctcttatatactaattggttagaaccctctagcttgaaagcaactcagctagccagcaaatatccccccaattaggaggtgactgatgtcataaccagattgctccctgttctctttttgtttgctataaacttgatcctttggatttgtgcatattctaaagatcaccctgtcaccatgcctggaggcaattaagtataagggagtagtgtttcaagataatctcccactgtgaaaacatgggaataattatccaacgtaaacatgtcatttcttttctaaattacatggattccttttttgcactttaaacctggattatacatcttactcaacttcgtatccagacccaggcatataccagccaggtgtatagcatgaacttaataaatgttgattaagtgaagagacttaataattaataattaactaatatatgatgaaagaattttaaaaattcacttgtttgtccatagtttcatgtagtcaacaaatgcaatcaaaaggccaatgatatccatgaagataacatttattttttaactaaaatcctatgttttctgtaattgtatggtagcatagaattttatatatataacatacattcatatataacatatataacatgtatatgacatatatataacatatatatctatatataaaataaatatatataaatatatatataaaactttgtgtcatttcaatcctgagctattttttatttttctgcctcatgtcaattagaatcagtctccccctttgattccagtcaattcaaccaccagtcgttttcctacctcttcctgacctcctcaccaatattgactctggctatgtatcctgaaaagtgagaaagattgaactgatatgaatgaaaattagaataaatgtaaaattcacacataatattgtttatttctcctcatatggtacacaaatatacacttaaattttatttcatatgacatcaacatagtgtatattcaacaaaatataactcctgatcctgtcttaaggagtatataatctaatgaaagattgaacacacaacagtgctaagaaccaacagctatgaagaaggtgcaatattcacaaagaaactgtctttgtgatttcaggtagtgctccttagtatcggattgttgagccacatttgaaagaatgattgtgaatttatgagaacatacaccaacgagtggacagtgggatgcctctatccagcaacacaggccactgtctcatagttcctcatcagctgctacaggattcactccaaatttcactataggacctgccagcttgtatttttgtctcttgagtctacgccaaaaccaaaactggcaatcccaaccactcatcacttaaaaactaagagattcttttttttttttttttctgagacagagtctcactctgtcgccaggctggagtgcagtggcgcaatctcagctcaccaccttctccgcctcccgggttcaagcgattctcctccctcagactcctgagtagctgggactacaggcgcaccaccacacccggctaatttgtgtgtgtgtgtgtgtgtgtgtgtgtgtgtgtgtgtgtgtgtgtatttttaatagagatggggtttcaccatattggccaggatgatattgatctcctgaccttgtgatctgcccacctcagcctctgaaagtgctgggattacaggcgtgagccaccgcacccggccgagattcattaatcttaaaggcttggtcaaagagcaagtattaaaacaggaatgtcactttcagtttcatcttgtgccgttggccattcataccttcctgctacatctgtacagtcttccacgcccagcttgtgcttctagaaggaaatcaaatgagacgatttgtatgctggtgctctgaaaaggagggagctagaggatcaataggctctagctaatagttttttggatccgaataataatgtttatagaactggaagactgcagtttagaatggtccttgatcacttattcattggtctgttcaagcaggaaatacaatggtttcattgagtgctaggaaaaaaaagaaaggtaaagggtgttgaattcagccactggctgggctttgaccagaagggaaaatcagggattggatgctgctatttaaacattagcatttacaaattaattggtaccacgaagaaaggaaaaagaaactgaaaactgtgattaccaaagaatagtttaggaccaacatgctccccttttctttacatttgcttaggccttttatcgctgcctctttgaactgaggctgagattcacttttttgtttataagggcttacttgttactgagaacagagccaaaatgggcttgcagcatctgctcataactcattaaccagaacttggtcgtgtgaccaccaacacttagatgcaaaggagaatagaaaactagtctgagttctgtagccacgtacccagctaaaagctgcaatttgtatcactaaagtaaagctcaccttgcgctttcattgaacagctagcagtctctgccgtgcgatttacttcctcgcccctagacaaatggaggagagaattcctcctcttctgtgctttgaaagatcacaattgtcataatttttaagaggaaatttaaaatatacatttaaggaaggtttaatctttagttcttactaaaaattctgatctgactcaaactgattcaaaaagcaaggaaattcagtttcctatatgatggaagtgtcagggtggaacagatctcaggaattagttgacccactgacctgatgctttgggagccatttgggagccattccggcatcactgcgtgtcctgagcctggctcccatcttggggtcaagatggccacaccctttcagttctcacagacacacactgcaatttccagaggcagggtgaggccatctgctctgccgccatgttcttctcaggaatcggcggccttcccaaaggtgttctcagcacgcctctcatcctctctcgctgtagctgagtcacatccccatgtttcatccaagtagcggcaaggaaatgggattgcctcggttgacttggatagttcaggactggctcccttgcagagaaaagagagtcgcttcccttgaattatatgaggactggatggacactggacacccaatgagtaaaatcaaggcttgtctgaggtcaacagtaacaccaccaaaagcaacaaagaggaaatggatgttaggtcggcaaacactgtctgctacagttcataacgtagtttcgagagccttcaaaagtattaatgacaaactaacgtttggaatatggggaacactgtattttgcttctagtgatttggagaagtaggcaataatgtcgctcacctctactaaatgtatattgtaatgtgtacattaaatttaaaattgtacaaatgatttctcatcctcaaaagactaactcgttttcaggttaaaagtaaacatcattttatatatatatatacatatatatatatgtatatatatatatacacatatatatgtatatatatatacacacacacgtctataatgctatatataaaaaatatatctgtatgtgtgtatatatctataatgctatatatacatatataatacatattatatatgatacatagatatataatgtattatatatttatatagcatgtgtatatacatatatgctatatataggattatatatgtgtatacacatatatgtatatattatatatacatatacacatgtatgtacatattatatacatatacacatgtatgtacatattatatacatatacacatgtatgtacatattatatacatatacacatgtatgtatatattatatgcatatatacatatacacatgtatgtatatattatatagcattatatatagcattatatatgtgtatacacatatatgtatatataatacatatatacataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatccatatatgcataatgctatatatgtatatataatatatgcataatgctatatatgtatatataatatatgcataatgctatatatgtatatataatacatatatgcataatgctatatatgtatatataatacatatatgcataatgctatatatgtatatacacatatatgcacatagcatgcttataaatgctctatattgtatatacatataatactatatataatatataataatataataatatatacatgtatatacatatgtacatatagcatatataatgctatataagcatgctatatgtatatatgtatatacatgtatacgttataccatatactatataatatatagcatatataagcatgctatatgtatacataatgcatatataatatataatgctgtatgataattatatataatgtatataatatgtgatatatgatatataatatgtaacatgatgatgtaatacatataattttatgtattttattatatataatttatatatatgctatgtataggcacacacatatagtgtttgtgtgtgtatatatatgtagcatgaggttgtgagctagtcaaactttagtcatatcatttaatatctcaagtttacattgatgaaatatttataatgaaatcctttgctacccactaactctgagaggtttgagtacttataaaatcaggcttatttttttctcaaagttgagaaaagcattttttctccaagttagaaaagcattttttgttgtttattaataaaccaatcaaagctgatgtcttttggtttgagaaaaacaaataattttcttaagaaaagtgtgatgaaaattatagcatctttaatgactttgttctccatctcctagtattgttatctttgtatgtatcccttttgcctgggctgggaaaactgtactgtaggtcaggggttcccagcctccaggccacggacctatactggtccatggcttgttaggaacccggccacagcatcagaaggtgcccagtgggcaagcgaatgttcccacctgagctctgcctcctgtcagatgagtgcccgcattagattctcataggagcactaaccctactgtgaactgcacatgcaagggatctaggatgaacactcatgagaatctagtgcctgatgatctgaagtggaacaacttcatcccaaaacccacccccaagcccaacctgtccgtggaaaaattgtctcccaaaacactggccctggtgccagaaaggttggagatcgctgccataggtgatatctctcctagaaccatacacctctggttttaagagctaaaaacatacagacttattctgtaagtgtaaacattttactgtgtgttacctggccaattcttcacagctgatcattgtatatttttaaattctcttcatgtctcatcgttttattagcgtgtttcttcccattatgccattctgaaatccttttacaagttgtcctctggtccagtgatctggtgatacaaatgattgatagcaataaacatatcatttgcatctgcaacccaaatgtcctgtgtgttcctgtagaaattatgtagctaagacacgcacacgaaagctctgtaagtcaaagagtagcgtcgtgtttttccaaataaatttttctttaaaccttggagcctcattgaagcacaacttgaaatggtagaaaaacccagtggggcatgtcaccaaaagcagtttcctaccgcagcttccaagagaacttcattagtgttttcaacctgaatactaatcaatggcataaactctaaggaaattttaatatgaatatttttaaaggagcattttaatgtgaacgtagtgaaaatacaaaatcatatttaaataggaaagaaagggatatctctgggctcaatgagttttgaaagaggagaggtttgaagaataaatgagtttacagaaaataaacaaaaatatgaaacaaagaagaaaatagatacagagaagcaaaagtataaaaatagcaacatttaaaatttttatctatgctctttttgatacatccacagaaaatatgtttctctttctttttcttttcataaaatttatttttatttttaatttttttaaattacttttttgagacagatttctctctatcacccagaatggagtgcaatggcatgatcatggctcatggcagcctcagtttcctggctcagtcagtaatcccacctcagcctcctaagtagctgaaaacaggcatgcaccaccatatgtagctaatattttttaaattatttctgtggagacagggtctctctatgttgcccaggctggctcaaactcctgggctccagcgattctccaccccagcctcccaaatcgctggaattataagcatgaccacctagtctggccatacagaagatacataatcttagacccccttcctcatgtaacatgtagcactttctctaactatatcaaataatgtctgggaaacagcaattttaaatctttagtatggtataattattgtcaaagcaaaacaagatgaaacttcagaaaagtctagtacagagcttcaacgaattcaagttaagttttacacctgttactccctgatacttagaaaagttttatgcttgcctctattgtgcttagagagaatgttgtggtttgtaggaaaatagacactggtaagtgtaactgtatctgaaatttgcacacttcaccagtgtgtctggttattatctacatggtggaccttcagtgactggaggacctctctttccattcaagctgtctttttattaaccgttctctggggcctcaagttccctctgcagcatttatttccctttgagttaagtattgttcccattattgtcttagaaacgttaagtatcattagatacagtatctcattgtggattatgttatcagattctttgcaatgtgtctcttaacaaaaggatattgagtggcagagtggggagtggaaaatcactgaaaaaagaggacaccgaagagacacatgaattttctttgttctgttttttttaaccagtggtcatccctagcaaagatgtgtgtaagtgcattaaaaacatttgtgtgtagcgaaagtggtgaatttctctatgcaacatatttaaaagtcattgtttgtacctcacttgcatggctatttggccctataaatattggctcttgtctaatgacattttctatttcactttttaatagaatttgctgtaaaatggatactacagaaacagcattttattttcattcttggcaaaatcatttccacccaaagtgggggagctcctaacaatggttgcttctactttatttataagaaaaataatcaaggccgggcatggtggctcatgcctgtaatcccagcactttgggaggccaaggtaggtggatcatatgaggtcagagtttgaaaccagcctggacaacatggtgaaaccccatctctactaaaaaatacaaaaattagctgggcatggtggcgcacacctgtagtcccagctacttgggaggctgaggcaggagatccccttgaacccgggaggtagaggttgcagtaggccgagattgtgccactgcactccagcctaggcaacacagccagactccacctcaaaaacaaaaaaacaaaaaaaacagccatcaagcagacatggtcatcttttgcctgtagtgcaacagaactgtttaaaacacagtttaggccttaacgtggaaattcttgcttgcagcttccactaatcaatctcgctaacctcaggactctaactttcattttcctaattcacatttcaaaacctttctaaatttcaagagggaatgatttatcaaatcatctaactctttcaaattttggagaaataaatctcacttggatcactaaaaataaagaaaaggatcactatggaataatgaccctttaatagaaaaagaaaatatttctaacataaatattggagcttttctgtggtagctgtcaaatccaggagtttggaaattggaaaactagaaattagaaaagaacaaaaaatagatgttttaaagttgcaaagctccttttctaaccttaaattttgaggttacaatcagtttaaattttaaggtttaaagccagtttctaaatcttaaaactatattatttacaagacaattcaagtgacaaaatacatagtagtcagtcataaactaaatcagattctaaaatattatgtcatattatgaagcagtatgtaactaaagggctggtgattgagccctgaagggccgtgtcaggtcttctacttgttttcaaaatcaaggctgaagctgggtgcagttcccacctgtaattccaacactttggaaggccaaggcaggaaaatggcttgagcctacgagttcaagatcagcctgcaacatagagagaccccatctctacacaaaaatacaaaaattagctggacatggtggtgcctccctgtaatcctagctactcaggaggctgaggcaggaagattgcttgagccccggagttcaaggctgcagtgggctgtgatcataccacttcaatccagcctgggtgacagagcaagatgctgtctccaaataaataaatgaaagaagaaagaaagagaaagagagaaagagagacagagagatagagagagaaagagagaaagagaaagagaaagagaaagaaaagcaagactgcttctcccagcaatttgttaggatcctggctgtccgcccaagatgggttagatgaatggctgacaaggaatttgttttctaccactgtcacatgggagctacattaccccagctgttgcccctgcagagagaattatctgtatgttccgtgtatgcatcccaccttttcaacatcttgtagcagttccacttgagaagtttcaagtgatcggagtcctggccctcccacttcattgtctccataatccctagcattgcacttctctgtttgtcaatgtctataaatggtctctttgcaaggcttctcatgctatgtataaaacctttataaatagcatccactgcgactcacacagagccacttggaaaaacattcttgtcttgtttttctcacatatgtctaaaattttacactttttcctttatttttacttgatttagctaatttattcttaaccacagcattgtggtttagtaattgagacattttcttcattttgaactccagagtctcatcaactttagtcatgaaatacaaaaattggaaataagtctttgttataaatctaggccttgggtaggagttaactaagtttggtagtttgaaagttatagaaaccaaagtttacattgaatacatacagccaaccaggtgttatgacactgaattcctatattcaataaatattagttgttttctgggtggcaaattcataagctataaagaaattctggcttatattatgctgatgtggacagaattacagatgatggacttgaaggtgttcatataagcacccgtcctcactctgcaccaaaggtgtctcagggcctagtgagggggcagtgccagaagcctccaaaatacttgtttctctgaaatgttcttcagtacagaaagcagtggaagcagagtagactgaattatgtattttttcagctttcactttatgtctctacagtttgctctcttcctcactggggagaaaataaaccagctacctcagggaagtcagcacaaatacagaacagtaagggagggtcccatagtcaccaagcaagacgcccaatttgtcctaaatccattcatgcatgttatggtaaaaatatggccctgttctccttccaggcatgagtcaatgttgctaagtgggtggattagaatagtcattatttcaaatcaattagacaaatacttaatatgttgccactccagctactgtgaaccagatcttgatttagtaaagaagactgatatagaacatataagcgtgtgtgtgtgtgtgtgtgtgtgtgtgtgttacaattctctggtatttacaacaagggctgtactgttgtgctaggctaaatattagcaaaaagagagggaaatatgacatgttttacctgaatgggattaaatcttttattttacacttgctcaaggtcatacatttattcttactggtcccaggtaactgcagccatgaatatttttcttaatttattcagatacttttttaatgttctagaattaaaataatttaatcttcagaaatgtgtatctcttttagcattatcaagcaactaagaatataagtaataattataaattgttgtgttagattttacttctaacaccttccaattgtttattaaaacaattgatataattattctttgtaaaaattaacaatattgacaattatatgtggtttttaggatgtaatatttttgctgcaattggctaattttgatacttttcttacataaattttaagtgattgtccagtcacccgtgaaagcgtttcaatgtctgtggattttatgttttaaaattgcatttgaaatagtccaattcataatgtgctaaaataatcaagaaatgttctctaaaatcctgaattcttccatttaggatctaacttaaaattcaaaattaaaaataaatgaaaaattaagcttgggcaagtcaatcagaataagagatgcttaatttctgtagttgaagggagaaaattaaagtgatgtcagctttctcatgacccaagaagtatgtagttgaatcaatagcatcatgaacgccccatcggatgatcatggagtctcttagattcctcgtccccttccttctttccttaaacagacccagaaagtgaatcggtttcctcatgggcaaataaaccaagcctagatcctgatctctgggctcagagccaatgctcttctgtatcctgatgggatggtcatgatgctattgactcaactacgtatttcttcggtcatgagaaagctggcatcactttaattttctgaaaaatgctctgcctcagcatgctctttgtcgtgccaacccttggaatgaaggcatgtgctatgattctaagtttatattaaagaaactcaaccatatacttttttcttttttctttttttgagacaagagtctcgctctatcaccaggctggagtgcagtggcacgatctcggctcactgcaacctccgcctacggggttcaaaagattctcttgcctcagcttccctagtagctgggactacaggtgcgcaccaccacacccagctaatttttttttttttttcttgctctgttgcccaggctggagtgcagtggtgcgatctcggctcactgcaagctccgcctcccaggttgaagccattctcctgcctcagcgtcccgggtagctgggactacaggtcccctccatcatgcccggctattttttttgtatttttagtagagacggaatttcaccatgttagccaggatgatctcgatctcctgacctcgtgatccacctgtctgggcctcccaaagtgctgggattacaggcgtgagccaccgcgccaggccattttttgtatttttaatagagacggggtttcaccatgtcagtcaggatggtgtcgatctcctgacctcgtgatctgcccacctccacctcccaaagtgctgggactagaggcgtgagccaccactcctggccaaccattgtcattttaaggacttaaccaccctactataaatagcacttgtaacagcactatatctgtcatgccttgggaaatgcataaattgttaagattgacctaagctgtaaaaatgcaggaagttgaaacacagatgtgtaggcactgtatcaaatgtatcctgtttccaagttcagttcctttcccaatgaccccctcaaaaatgtttttctaaaattaactggatttgtgatatatctgtccttatattttctgaattcaaaataatttccttcttgaagctacagaattctgcaactttgcaataggtttctaatatttccaatatctcaggcctttattcaaaagaaaatgccagatcttttcaagagaaaccctgaatttatgttagaaagagaaattcaagctataaattgtacaaaataatatctaaaattcttatagtataagaagtcaacttcaagcttatttatagctttaaagtaatttagggtttagagagaagagagattaatgttcctattctagtagactcaataaaatatttgtttttatgttgcaatttttaagcagaatattttctacaaagtcaggaaaagtaggcaatcatcaaatagctttaaaaaattctgagcttcaccatagagggaatgtaaattgaaaaatgtgatttggattctgtgattctttaggaatctcagattctacatacctctgtactacaaaaactaaacttattgttgatatagtggttagtgaattttaataattaggtatataaaccacagtgtttagttgcagcaagcatgtcaggaatgagtgattggcctttgtatgttctacttgtaagttgcatgtactaaatggcacgtccatgctgtggaaggaaaaggggtatggccgggcgcggtggctcacgcctgtaatcccagcactttgggaggccgaggcaggcggatcacgacgtcaggagatcgagaccatcctggctaacacggtgaaaccctgtctctactaaaaatacaaatacatatatatatatatatatattagccgggcgtggtggcggatgcctgtagtcccagctactcaggaggctgaggcaggagaatggcgtgaactcgggaggcggagcttgcagtgagctgagatcgcaccactgcactccagcctgggcgaaagagcgagactccatctcaaaaaaaaaaaaaaaaaaagaaaaagaaaaggtgtacgtatgtcagatgatacaatgcagcattatacttatttttgaagagatttgctgtttgttaatcatttgcctcaagattaaattaaatatttattatattctgctgacatatatgtggtagtttgaaatggttctctactttcttgtgtaaaggtaaataaatgcaacgtaaacacaagcagtcttcattattgatagtaattatgtgctataaagttgccaggaacactgatttagcgaatactgaattatttctcctaggggaagtataggtttaggtttcagtgagcctctggtcactacagtttttgagaggacacaaacactcataccgtagcgttctgccccaaaaccccaaaattcacacaattctcacacacaaaatgcgtttattccatctcaatagccccaacagtcttaattcatttcaacatcaattttaaattctaactccaaagtctcatctaaataacatctaaatcagatgtgggtgagactcaaggtgtgattcatccagggcaaactgctctcctgctgtgaacttgtgaaatcaaacaagttgtgtacttcgaaaatacaatgtgggacacacatagaatagacattatcactttaaaaggaaaaaaaataggaaagaagaaaaaggtaacaggtcccaatttaaagtcccaagccccgaatatcctgccacctagatggttctctgcagtagccccacctccatggtggctctgtgcctgggtcaccagctcacggctctttcatgctagaatcacacactggtggcttctaccggttttgatggcggcaaaacttggggcagccgcaaccccatggcacctctatacattgccctagaagggactctgtggagatcttgcagagcaacagatctcttcctgagttctgcaacttcccagggcatcctcatttctgtctgagacctcatcggaatggcctttatcacccaaatttctatcaacattctgttcacggccacttaggtataccttaagaagattgaggttctttctacagctctcctcttttcttcttaagtcctcaccagaattacccttaaaggtccattcagaataatgtagccttttattattattattccttttttttttttttttcttttggagaaggagtcttgctgtcacccaggctggagtgcggtgccgcgatctcggctcactgcaagctccgcctcctgggttcacgccattctcctgcctcagcctcccgcgtagctgggactacaggcgtccgccaccacgcctggctattttttttttttgtatttttagtagagacggggtttcactgtgttagccagtatgatctctatctcctgacctcgtgatccgcctgtctcggcctccgaaagtgctgggattattattattatttttttaaagcatgaactttgtaagccttccagcctctgcccatggccatgctccaaaaatgttcctacgtttttagtatttgctgcagcaggactctacttgagtagcaattttctgtcttagtctgtttggcctgctataacagaataatataaactagatagcttataaataacagaaatctaattttgcaagttctaatgtctgagaagtccaaaatctaggtaccaagagatttggtatctgatgagggtccactttctggttcttagatgatgccttcttgctgtgtgcaagggcaacgcatctttctggggcaactttattttttttgtttttgtttttagagacagagtcttgctctgtcacccaggctggagtgcaatggcgcagtctcggctcactgcaaccttcgtctaccgggttcaagcgattctcctgcctgagcctcccgagtagctgggactataggcatgcaccaccacgcctggctaatttttttttttttttttttttgtattttcagtacagatggggtttcaccatgttggtcaggctggtctcgaactctttacctgaaatgatcctcccacctcggcctcccaaagtgctgggatttcaggcgtgagccaccgcacccagcctctggggcagcttttatgagagaactaatttcattcatgaggacttcaccatcataacctaatcacatctaaaggccccaactcctaacactgtaacattaagaataaggttttaacataggaattttgggaggacacaaacattcagaacatagcagttaataaaatatttgtaaaatttatatatgtatatatatatattttctttttagtaagttctatttcaaatctcagtgaataagtttcagatgtatgttgtttcattgtctttcattgtttttcttgcttctttctttttttcttttgaatctgacatcactacaatattgatttttgtttctaccttcattttataatcatataccttaccaagctacagaaacgaggcagaaaaacaatttccattttatttcagtacatcttcctaaaactggatcctggtttgcttagttgttattaacaacacttgatgagctattattaattaaataattatcttttatctcaaatgtggaggttcttgttcctatgaagcccacccttccctttagcagcagcaacaacaaaacgacaggcagcttctcccttcatatgggtcctgacagatgagccttttggacccctcgtaaaagtagtaaatgcacctttttcttttatttacattaacatttgttttttcttaaccatgctctctctattgatttagcattaatcatgttgtttcctacagaatttaccttttgaaaaataaaaacacaggcagatacatactggttattcacaggaaaattagggtgtaattattagcagactaattgtttcagatttactatgatccatgaagtcttgtatttgacagcttaaagaactatgtggccaagaagacataaatgtgggccagtagctagcagcctctgcataatacaactccaaatcaactggtgaacatttaaattggagtaatttaattaaaaatttgaatttctgggcttccttgaaaatgtattgtttgaataacaccagcattcctgcatatcataagttacctccatgtgaatagggacagccccttttatccacaacatatcccaaacactgcatgaatcctctgccatcatggctgagcttttaatctcttcattagaatctctttttggttgattttctaatcagggaaatatgtctctcttggtcatattgctatcaaaagtaagaaagtaaaagatcaatagaacgacatgatatttataaccagccagcatcacacatttgtataaactgcttgtcttctctgagcattgaagttgtgacttctaattttagaagctacaaatcattttatctctgtcaggactggttctcgccacaagttgtgtaagtactgctcatttatgaaaataaattaattcaacctcttcttcatggccccagtgagtgtgcaggtgtcatgaagtaatggacagcacccaagttcacagtgaatcagattccctccaatgcccaaatcactgaggtgtgttcacgagcagaccacagagtactgtttttagtgttttaccagacaggacctaactgctctagcaaagaggaaagagaacattatctcacaacatgtgtaccttttgagctttactaagcctattttatggttgaggtaaaattttcacccaaaggtatgtgaaatcaaaccaaaattacagaattgttgtaatatattgcaccatatgcataacctcaaaagatactgcacacatatgtcccaatctctcacaaataagagaaaatcatttgtaccaactaatttagctttcaggaaagcacagaaagtaaaataaataaaaatgacattttttcctaatcacctattacatattgctactcgtcctgacaaatttgtaggggttgttgatggatgtatagcgttcagaacattaatgattttacaagtttaaagtaatggtgtttgttcatgtacatatgtgtggatgaatagttgtatggatggatggatgatgtattagttggttttcatgctgctgataaagatgtacccaacactgggcactttacaaaagaaagaggtttaatggacttacaattcctcatggctagggaggcctcaccatcatggcggaaggtggaggggaccttgaacatggcggcagcaagagaaagaatgagagccaagagaaacgggtttccctttatcaaaccatcagacgttgtgagacttattcactcccactagaacagtatgagggaaacggtccctatgattcagttatctcccaccagatccctcccacaacacgtgggaattatgggagtacaattcaagatgagatttgggtggagaaacagagacaaagcatatcagatgaatttgaaaaggatagcgcatagaaattttggatagctaaagaagtaacaaactaagattctgtgtaaaaattaagatggtgggaaaatgaattcgaatatgtagcgtgtttcaaagaggaatttttgacattttgtttttgttttcagggtactgtcaatttcattttaaattctgaggctttgtaatattggatttatcatacacctggagtcagccacaactgtaaattttgatctgaaattcttcagttagtataaaatccctaactgctttgaaattctgtgtagtgataatgcatcatctgaatgctttgcatcctttaatgacataggtatcttctgaattctggctttgcgtaactgttgccaacactgtaagaacatcagctcgtttgaggctgggtctttgttctctctgtttctgggccctttccacgccctttctcctctccctcactagcacaggagttatctttccaatgcaaacctggacatgcattttccacttagaataccatcattacacacatgggccctcagcttcctcagggagcattaagtctttaatcttccaattctcaccctgcacatgaattgtaagccttatgtagtaaagtcacaaacaactgagcgtttttagaacagtcgaatgtgctattcccctatctgtctgaatttatcttactcagtcttaattctcttttcactggaaagttcctgtattgttttttgtttgttttttaactcaccccattacttccacaaccccagtcttgacacaatgttatggatgtagaagatacttcagagtccagaagttgatcttagacatttaataatggtttctaaaatttgctttaaaggagctttttgcaggtctatggactaacttttgccaacaattcctaggcttttgtttgatcaaaactgatttttcacttcttttctaagatatggtaaaataattttctgtactgagtgttttctaatatagtttattagtagaaaatttgagacacagtaaggccaacatatcagaaaacacctaccgtgaaaagatactaatattttattactttattaatactttatattattgatacgatatttataaccagccagcatcacacatttgtataaactgcttgtcttctctgagcattgaagttattttattttatataaatacaattattactttattaaaatacatgacatttatttactttattacttttattactgtggcaggccatcccacagggtgtagaccagaggtagggagctcagggaagcaccaggatctgtcaggaggtagaggggatgagggaactgtgggcaaggtcctttattgtagtttccatgggaagggataggtgcagcagggtaagcaggcttaggtctggctaactggaataattattccagtgagttctggggcacagaggctgatcctagttgtcttgtacctgattctgggatgaatagggaagacggatcatggtccagaagagagaaagctggataaaggaagcagttggggtgtggactctggattgattgctttatatttggaaagtgtgcttaccatctctagaaattggctaactctgggaagaccagtccctctagggtcagcaaggccccagatgtcaaagcattggagcacagagattaaaatacatggtcaggatagaggggaagttgaagccatggcagctccaagaaatgacacaggtggctgccattacccctgctcccaccctccacagctaccagcctccgtttactcatagggataattgattttttcctcaatattatataaattactatgaaaagagtgcctaaaaacaagttgcttatcactatttgtaactaaactgctatctttatatagtatcaaaatttggacagaacactgacaatgatattttaaatggaattagaaggtgaactgaatagagattttaaaaattccgaaataaatgttgggaataatttaaatcaaaagacattctgaggagtttcttgatgtctggtttctttcctcatctgtgtagcatttacttaggatttataattctagatagtcttttcgccagcaaaaaaactagattttgtgtggtcaaaagttgtagagctattttcagtaaacagcgaaggcgagaaggcgagtctaatttatttgactttttgatttacaaaaataaataaaaacagcttccacatggatttcctacaaatagattatatgctaattttcagaaattgttattatttctgcattattggatatatgagagttataaccctgcttagaaatagatcactctgattttctgatatcttgtgggtaatgagtggatgagagcgaggacagaatataggtgtgtgcatgtgtttgtgtgtatgtgtatggggggtgtatgtgtgtgtgaatgtccattttgggaggcatagggtacctcagtgggcttttttgtctcttcacgttgaataatgtgatatctaatgctataactttaaaaagttactaatattttcctgtgtctgttttttgtgattcattgggccaaccagatgattagccatttatggtttatcatatatacattttttatggagtaagtcaaaaattaaaatatgtaggagtcaattgatcttgcctctgaaaatcaataaccatttcagattagcatacaatgactgctctaaaaggtgtttaaaacttagtgactttaatcttggaatatgcaagttcctcattaatgcatttaattcaaaggaaattatatattctttatttaaactcatacaggagttcaatgttttggcctttgacttataaacaaataactccagtgtaagtataataaaagcatgttatgtttaaaccatttattcatatcagacactcatagttgtaagagttgtgtagccttaaatcatgtataaatctgtactcttagaaagtaaactgcacggtcacaggcatagtttagaggggaaataataacacagtggaattctccttttgccttgtttcaaacctaaatgatgtttcaatcagtttagaaagtgtttatgctgccaggaatccaaaacggaacaatccaaagcctgtatcctagaagagcttcaagtccacaggaaaaatcacgcccaaaagaagataacttcaatataatgtgagaagtaaaatgataaaagtatgcaaggaactaggggacaatagaccaaggctgtttcacacaggcaggctttctagtggtgaggcttatctgaggcttagaagatgcctaaaagtaaactagaacaagaaaaatggctgctcactgaagaaagtgagcatagcccgaggaaaggtgctatgtgaagtttgcgaggaattcaatccgtttaccatcaggagcacataaaaagaaagatggcactaaaaatgagcctggacgggaaggcaggagctatatcattgagggtggtataggccacactgaagaacctggcttttgatcttttttggaaagagtttatttcaaaaaggtctttccagcttctgtgtgatggttttaagacgggagagttccctggaccccttcacgggacttgcaacaagggtgtggctccatttctcgctcaagccccttttgggaggaggagcatgcaggtgagctggagcgagcgcttttgggccctggctccacggcagtgtctaggggtgttgcagtgctcttttagctttgccatctgtggatggttaagtgttaaccagttcagtggagagtcagggtgacagccttttataccctgtcctcttgatacgcaggtccttgtctggcattcagaaagaatcaggtcacatggacttgaaggatggtgaatgcagggattttactgagtgatggaggtggctctcagcgggatggatggggagctggaaaggagatggagtgggaagatgatcttcccctggagttcaaccaccccacggccattctcctatctgactgtccccagccaaacccctcttgatgtacagacgcttcctctcttctctccttctctgctgtgccgctcttctgttctactgctcgtctgttcatggagcctggggtttggatttatgagtataggatggggagcacggcaggccagggtggttttgaaagaagcaacaattgggcaggaaaacaggataactgttctcatttagcaccacggtttgcgggcttgagggcggagcctttgccggggaaccaccctcttgtctcctgttcatatcagttggatttaagagaaataagaccaaaggatgagaattggtcatttaacaatgttaatacaataggcaacatgtgaggtaatggtaggctcatgatagtacatataaaagtaaactatgagttttaaaaatatcaaagtgaaatatcaaattgaaatatcaaatttcaattaacaatcattgcacctcaaatgaactcattggctatatgatactgccactgcacaaagctctatatttcacaggtcttggaagtcgctaaatgtaggtaggcaaaaagaaaaaaaaaaaaaaagaagctcaagaaagttccagatctctggcttgagtgactggataatggatataataaaagtagtggggcccagagaaagaattatatgttgagcaggtagagtgagatgtgcctgtggaatatccatgtggatcagccttccaagttactggattggaatctaaatggtatgcagaaatgaaatcagagtcctttgatattgttgtcactgtcctagggaatatcaagcactgaaggggaaagcaacatattttaagcagaaatattgcacaaactgtgagatgctggccttcaggaaagaagagccttgaggttttttgttttgttccattttccccaaagtagaagtgattttcagattctatctctagatcatttttaaaggatctggagaaggctcatttgctactattactctaaattagctataatgacattttgaaattattttatctgtttaggtttatatcatagatacattgaaaaaaagaaaggcagtgggttaggaggaagaaagtattcagataaaagcaatgtgtagatggaatgagattgagtccaccagagttgtgtctgttctaggactgagtcaatttaaaataatggaatacattcttgcccaccaccacagctccccaaaagtaacctaatgttaccagtcttttcatctgactattgaaacctcaagtatatttgtagttgtagcaccaagatgggtcagcgagattcttgaaatttcttccaatctagtgactctaattttttaatgaagtatgaaataatagtgtttattataccttaatccaattaatagaaatatgagtgacaacattcacacattctacaaatatttaataaatattcactgtttttcaggcactgttttaagtgctgggctttagaatggaacaaaactaagtctcagaggagatatgctgtaaatatacaaacatcaatgtatcaggtagagataaattccataaaaatgaataaagctgcgtgaatagagaggaggtaaagttggcagtcacactttttataaagaatgatcaatgtatctaaaatattgacatctgacaatgaaaataatacacagatttgcatgtgtgtgaaacttgcaaaataagcaaattctatcttctagtatttttaaacttcagtttcagaaatgaaatgtatttcaaactcttgaagtgacttggtatttatttgcataaactatatagtattcgattctgtactaactggttaatatacatttttactatttttttagattcatatgctttatatgtatttgagaaatatatatgcttttacaaaatttaaagttccaaatttactagtttttaattagtttattttttataaaagaagtctttaattttgtttccttttttctctaaaaatctatataattttttacctttattgaattattatataattgaaaaataaaaattgtatatatttgagatatatgattccacaactctgtgatattctccccaaatatcaataatgcagtctagtcctaagaaaacgtcagacaaatccaaactgagaaagattctacaaagcacctggctggtgctcttctagagggtcaaggttatgaaagacaaggaaagaattggaaactgttgcagattagaagtgactagggaggcatcataactaaatgcaatctgagatcctggattgaatcctagaacagcaacaaaaaagtattagtgaaaccctggtgaagtccaagtataatctgtatttgagtgaatgccacttaagttagtattttcattttgacaaatgtgccaggttatataaaatgttaatattagaggaagctgggtgaaacatatgagaattctatctttccaactaccttttcagcttttctctaaatctaaaatttttccaaaataaaaagtttgtgaaaataaaaacaaaacttccaccacaatttttattgaagaagttggacatttaactaatggtacatttttagctaatcaaaatcctgttttagaaaacaaaattatgaaataaggtttaaaaaatgtacagtaacaaaaatcaaacacaaactatatacagtattatccatatgtgtatctatgtacatacgtaaagattctttatatgcaatttaaaataatcacaaatagtatattatcattggttatttcagtaaaaaatgaaataatgccttttaaattttttttctttaaacctttttgtttctttcggatcccctataaaagtaactgaaaacatttgatggggaaacggtattaaaagtaactcttgaatatttatttgttgatatgctatatttacatactttttaattttttcaaataagtagactacagtttcaaattatatattcttttataagtgtcttttattaagattaataaaaaattttaattaaaccatgcaatttccctgtactataaatattatatcaccccaaactcaaattattagtgtacattttggaccatgactaactgaaatgaaattctccctctctctctcccactgtctttattcttctcccttcctccctcatatatatatatatatatatatatatatatatatatatatatatgaattattccataccttatatagttggatagatatttaggtaaatatgtaaaatgtaggatatgcaccagttaagtacccattaacactggtgatttttcgtggttgggattcactctctactttctatatttctgtattgcttaatttcttttgatcaatagacatagtttgtaataaaatatatagcaaagatatcttttaaaattaaaatatcaaataaacttaaaattttaatattaaaatgtttatatggtaaacacttcttcaaattatcttattcaaagttagaaagtgaagactaaggaacaataaaatgtttttgaaaaagcgttttctaccatgatgatttgatgaattgggcatattaccagcttgctgagcttttgttaggaacaaaattgtggaaacactatgattttgcattcattttttgactagccattattgttcagattgcttaaacagttcaaccatacatatttaatcaccgcatcgaaaacttaattctagggagtgataagcaatcaggataatagaagaaaaaagtggcttgtccccaaataagcacagcgcattattagatatcaaatgaaattttaatctatttttgtaggaaacagagccaaactgtgatggatgttctttacattgttgtagaatatcccagactttttaaagagtacatggtatgtgttaaagtgtaaatatcatagattacttctagaaattttataattttcaagccagctctgagcttacatccacaagaggatgtgctgatattttggaagcatttaacccattcatagaataacaacttttaaattttgttttagatagatggatagataggtgggaaaatatgttgaaactttttctttttctttgtagggaatctaggttacagagaattttgtttcccagctgaccctgacaacttaccatttgtaaagtgagacttggtctacatgaatagctgtccttcctgtttttattaatatcttaggattgtctgaaaaaaataagccatcttcatcttttctgtcacattttctcattgctctaaaagtaagacaggaatgcattaacatttgcgtaaatcattactctgtacctagaactaaatgtgttttgatttagaagaaagtatagaggaggtgattcttgttccctgagtaaaagctcagggaacgtttacttcctgaaagatgaattagaaatattttatgtcaattaaaatatgctaaaggtgtataaaacaagatgtgtctattatttaactgtcactgataggaaattgactgcaaaactactgtctagagttcagaatttactgtcatctgtttttcttttattcacttttcaagataaaaagtatcatcaactgctggattatacgttctcctttatttctcattgcacatgaaaaagatattgccattgaaattcagctgtgacagtatataggattaagctgaagtttaattggctttgcagtgttagcagaagccaaaattaaacgattgattttttccctcatattaaaataaacctctgtgattcacagtctcagagaacagaattctgttgattaagaaagtctttttatgggcaataaagagctgattataagaattaaaatttaaagtttaaggtcatattttttctgaatgttttataatataacattgtacaaacttatttaaaagcataaatatttgagatactagcatagatattttcaaagtatgtgaaagccatcaatgatttgaaaggcatgcttagatttcattttattcgaagtaactgtatgcacaacaattcactttatagaattaagtaaactcaacacaaaaaaggagtggatgtggttctggcagccctgcatctctactgtggcccccaaaggaatttatttggtggtatgctccacttacaaggcaaaccaaagtgttcctcgtggtgattggagtaaacaagtgccagagaactaggacatgaaatgagaaaatatttctctgacaggctttaaactggctattatttttctccaatgtctccctctggagttctttagccagaccttacccaaaacctagaggctagctttgtccagacttgtaattctaaagttattagagctgttccgtttgactaggctttctatgatttaaaaatgaaaagcttacagaaatagtctattgaaaagatttttaacagtgaagatttgatcatggtaacgaagcttctatttgaactcaatatttgatttgaatggttacattgcattttgaatcattctatgaatcgagaatgcattgaccaatagtgcctaataaataatatcatctcatttttatttctggtgtgaaataaatagtagttatcaaatgaatcctcacagtcacatatttctgatcatatttcccattttttaaaaagtttacatactttccttattttaatctattcccctgaaactaaaattagagctgctgtagtcatacgctggatatttgttctttaaactcatatatggataagtgaagatatctgtgtccaatgtagtgaaaaaacaaacaatggtgcccaattctccattccaaatgcaaggaggtaataagaaatttgagacacactgcttcctaagaataaatggtaagaagtttctgaaaattcgattggttgtaaactctgaatactacaacaaggtttactaaaattgtggtgaaatataaaaaccatttaaaaaaaagagaatagcataaaagattacattccaagtgccttcattcttacatcaaagaaaacaactttttgaataaaatatatacttaaaatcatgaagaattatcattaaggaatcaaacatttaagtctcataatctgtttgagatttaaaaattttacgattttggtctaaactctagatttctaagttaagatttgaagcatataacccattgaatttatattactaattttgtaattaaagtaaaatgttcaactgatagagcttttatgagcatttttatcaatactctccataaaacctcctttaaaacaaacacagtaaatcaaaagaaggaatagaagaaaaacagaggactgtcaatttctcaagaaaaacacttacttaattctcatttattctttgcagacacctgttggaagtggatggtaacatacatggctgaactaatatgttatttttttttttgttttaggggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggtgtgttctgactgtcagttctattctttccgttatggatgttcccattaggaatatgttcatgttgctcaattctttaaaatgtaaattataaaaagagctcatgttatatttcaattcatacttaatctataacagtaggtatataatgaaacacctagtcattcaaaaaatatttattaaacacctctactatacaagttactatactagtctttggcctacagcaaggaacaaatagacaagatccttaagctcattaagttcatgacctaacggaggaatcagaccatatagcatttattattcttattttaaaacaactaagcaaaaatgaatgtcttcaaataatatatattatgaaccagttgaacagattaatatgataaagggactaggttaatacgtcctgttcaaaggcaacagggctaatattagaatgtgtggtgaagaaagactgctctggggagaaaatatttaagatgagatcagagtgatgaaaaggaattagccatgaaaacatgagagaaagaagattacataggaagagaacatggaagaccaaaagcacgctcaagaagcaggaaggatgccgccgtgcataaatgctgtgagttattaagacaaaagatgaagtccaagaggtggaaattgcccaaatcctgtgggatcctgcagggcattacaaattgtttagatattatttttaagaataggaagctgttggaagtcattaaactgtatggctttatcatcttattttttatcaagcgcattgagacttctgtaagaagaattacttgtgtagatatgagagtcgcagcagaacttctgcatagtttgggtgagagatagtactgcttgtatgaggtggttatcaggggagatgcagagaaatatgtcaattaaggaaataattttagtggtacattcagcatgacttatgatgggttggatatagcctaagaagaaaagagtagaaataaagaatgagccctaggatttgggcttgagcaccaaatggacattagtgccattttcagaaatagagaagactttaggaggaattctagagatcagtttggacatggttaatttgagctgcttatgaaacatctaagtagaactttcgattatggaagttgatatatgagactgagagaggaagactaaaatggagactaagtaattgtgaatattgagtaggagaaaatgaagaaagtgtagtatcacagaaatcaaggaaacaaaagaggttgtcaactgttgaattcatctaaatgtcatgtaagatgaagacagagaggcaaatattgggcttaacaacatggaggttactgttaatttctactctgtggaatagaaaagacaaattttgtaggtaaaaaagagaatgaaaggcgttaagtaaatattttgactaactagagaggaagaacagttagttaactgttaactagaaagaaagaacatagagaaatgaaatgttggctgctgaaagatctgaactcaaattactgttttatgtggggttgttgttatttgtatttatttatttatttatttatttatttatttatttacttatttttgagtcagagtctcaccctgtcacccaggctggagtgcagtggcatgatctctgctcactgccacctctgcctcccaggcttaagtgatgctcctgcctcagcctcccgagtagctgggattacaggcacctaccaccatgcccggttaatttttgtatttttagtagagatggggtttcaccatgttggccaggttgttttcaaactcctgacctcaaatgatccacctgccttggccttccaaagtgctgggattacaagccaccgtgcctggccctgttgttgtttttaaatggacaagaccaatgtatgtttgtatgttgatgatgtagctaggatttacttaaagctaaagtgaagatctgcaagattggtactggcattcaaaattacagtttaggcaaagtaatggtacctttttcttttttttttttaaatttaagttcatgaatgcatgggcaggatgtacaactttgttacataggtaaacgtgtgccgtgacggttgtctgcacagatcatcccatcacctaagtattaaggctggcatccattagctattattcttgatgctttccttcctcaccacctaaacctccgacagaccccatgtgtgttgttcctctctatgtgtccatatgttctcatcattcagttctcacttataagtgagaacatgtggtatttggctttctgttcctgcattagtttgctgaggacaatagcctccagctccatccatgtgcccgcaaaggacaggatctcattcctttttatggctgcgtagtattccatggtgtatatgtaccacattttctttacccagtctatcattgatgggcatttaggttgatttcatgtctttgctattgtgaatagtgctgcaatgaacatatgtatgcatgtatctttataatagaataaattatattcctttgggtttatatccagtaatgggattgctgggtcaaatggtatttctgcctctaggtctttgaggaatcttcacgctgtcttccacaatgattgaactaatttcccctcccaccaacagcataaaagctttcctttttctctgcagcatcaccagcatctgttgttttttgactttttaataatagtcattttgactggtgtgagatggtatctcattgcagttttgatttgcatttctctaatgatcagtgatgtagagattttttttcatgtttgttggccacatgtatatcttcttttgagaattgtctgttcatgtcctttgcccacatttttatgaggttgtttttgtcttgtaaatttaagttccttgcagaagctagatattagacctttgtcagatggatagattgcaaaatttgtttctcattctgtaggttgtctgttcactctgatgacagtttcttttactgtgcagaagcacttcagtttaattatatcccatctgtcaatttttgcttttgttgcaattgcttttggcatctccatcatgaaatctttgcctgtgcccatgtcctgaatggaattgcctatatagtcttctaaggtttttagagttttgggttttaaattaaagtctttaattcattttgaattgatttttttgtacagtgtaaggaaggggtccagtttcaattttctgcatatgactagccagttcttccagcaccatttattcaatgaggaatccttttcccattgcttgtttttgtcaggtttgttgaagatcaggtggttataggtgtatggtcttatttctgagttctatactgtgtcccattggtctatgtgtctgttcatatcagtaccatgctgttttggttacagtagccttgcagtagagtttgaagttgggtagtgtgatgcctccagctttgttcttttttcttaggattgtgttggccattggactcttttttggttccatgtgaatttttaaatagtttttttaaattctctgaagaatggtcaatggtagtttaatgggaatagtattgaatctatgtattgctttgggcaatatggccattttcatgatgttgattattcctattctccctatccatgagcatggaatgtttttccatttatttgtgtcatctctgatttctttgagcagaggtttgtagttcttcttaataaggtccttcacttcccttgttagctatatcttaggtattttatattatttttggcaattgtgaatgagagttcattcataatttgactctctgattgcttattgttggcttataggaatgcttgtgatttttatacattgattttgtatcctgagactttgctgaagttgcttatcggcttaagaatcttttgggctgagatgatgaggtttcctagttacaggatcatgacatctgcaaagataatttgacttcctttcttcctatttgaataccctttgtttctttctcttgtctgattgccctggccaggatagccaatactgtgttgaatagtcacggtgagagaaggcatccttgtcttgtgacagttttctgtggaatgcttccagcttttccccattcagtatgatattggctgtgggtttgtcatagatggctcttactattttgaggtatgttccttcaaaacctagttaactgagagtttttaatataaagggatgttgaattttattcaagaacttttctgcatctactgagataatcatgtggtttttgtctttagatctctttgtgtgattaatcacatttattgatatgtgtatgttgaaccaaccctacatctcagggatgaggcctacatgattacagtgaatacccattttgatgtgctgctggattcagtttgccataactttgttaagcatttttgcatagatgttcatcaaaaatatttgcccgaagttttgttgttgttgttgttgttgttgttgttgtatatccaccaggttttggtaccaggatgatgctggcctcatagagtgtgctagagaggagtccttccttttcaggtttttggaatagtttgaataggcatgttatcagctcttctttggacctctggtagaatgcagctgtgagtctgtctcgtcctgggctttttctggttggtaggctatttattactgcctcaatttcagaagtcattattggtctggcttagggaatcaatttctttctggttcagtcttgggagggtgcatgtgtccagaaattttccatttcttctagattttctagtttatgtgcatagaggtgttcatagcattctctgatggtacagagaatactataaaaataatagagaaatacaaacatatttctatagggaaatacaaatgtatttctgtgaggtcagtggtgatgccccccttacgatttctggttgtgtttatttgaatcgtctctcttttcttctttattattctagctaatggactattttattaattatttcaaaaaaccagtgtattaaattctcacactggtataaagaactgcccaagactgagtgatttattaaaaaaaaaaaagaggtttacttgacttacagtttcacatggctggagaggcctcaggaaacttacaatcagggccgaaagggaagcaaacacatccttcttcacatggcggcaggagagagaagtgcagagtgaagtcggggaaagccctttataaaaacaccagatgtcatgagaactcaatcactatgatgagaacagcaaggggaaccacccccatgacgtccctcccccaacacatggggattataatttggattacaattcaagatacgatttgggtgggaacacagagccagatcatatcaaccagctccaggatttattgattttttgaaggatttttttgtgtgtgcctctctattccacttcagtttagctctgatcttggttatttcttgtcttctactagctttggggtttgtttgctcttggttctctaattcttttagttgtgatgctaggttgctaacttgaggtacttctagctgtttgatgtgggcatttagggccacaaatttccctcttaacactgctttaactgcatcccagagattctggtactttgtatctttgttctcattagtttcaaagaaattcttgatttctgccttaatttcattatttacccaagagtcactaaggagcaggttgttcactttccatgtagttgtgtcgttttgagagaatttcttaatcataagttctaatttgattgtgctgtggtctgagagactgttatgatttcagtcctttttcatttgctgttgagtgttttactttcaattatgtcatcaattttagagtaagtgctgtgtagtgatgagaagtatgcatattctgttgtcttgggatggagaattctgtatatatctatcaggtctacttgatccaaagctgagttcaagtcctggatgtctttgttaattttctgcctcgatgatctgtctaatattgtcagtggggtattaaagtctcccactattattgtgtaggaatctaagtctctttgaagatctctaagaacttgctttatgaatctgggtgctcctgtactgggtgcatatatatttatgatagttaactcttcttgttgaatttagccttttaccattaggtaatgcccttctttgtgttttttgatctttggtgggttaaagtctgttttgtcagaaactacaattgcaacccctgcttttttctgttttccatttgcttggtacatttttctccatcctttattttgagcttatgtgtgtgtttgcatgtgagatgggtctcttgaagacagcataccattgggtcttggctctttatccagcttgccagtctgtgtcttttaactggggcatttaacccatttacatttaaggttagtattgttatgtgtggatttgatcctgtcatcatgctgctagctggttagtttgcaggcttgtttatgtgattgcttcatagtgtcactggtctgtgtatttcgatgtgtttctgtagtggctggtaatggtttttccttttcatatttagtgctttcttcaggagctcttgcaaggcaggactggtggtaataaattctctcagcatttgcttgtctgaaaaggatcttatttctccttcacttatgaagcttagtttgactggatgtgaagttctgggttggaaattcttttctttaagaatattgattattggcccccaatctcttctagcttgtagagtttctgctgagagggctgcttttagtcagatgggcttcccttagtgggtgacctggcctttcagcctttctctctggctgcctttaacattttttctttaatttcaacctcagagaatctgatgattatgtgtcttggggatgatcatcttgtggagtatcttactgaggttctctgcatttcctgaatttgaatgttggccttcttcctaggttggggaagttctcctggatcatatcctgaagtatgttttccaacttgattccattctcccggtctctcccaggtacaccaatcagttgaaggtttagtttctttacataattccatatttctcagaggttttgttaattccttttcattcttttttctctattcttgtctgcctgtcttatttcagaaagttaggcttcaagctctgagatttcttcctctgcttggtctgcctgctattaatacttgtgattgcattgtagtagtgtgtttttcagctctaacatgtcaattatattcctctctaacctgggtgttctggctatcagatcccatattgtattaccatgattcttagcttctctgcatggggtacaacatgctcctttacttcagtgaagtttgttattacccaccttctgcagcctacttctgtcatttcagccatctcagccttagcccagttctgagcgcttgctggagaggtgttgcaatcatttggaggaaaaggggcactcggctttttgatttttcagaattttttgcattgattgcttctcatctttggtgtcttatctaccttcaatgtttgaagttgctgatttggagatggagttttgtggggtttgttgttgttgttgttttgtgtttgtttttcttttaatagccctgtagaagtctggccactcatccatagggctattgtggtttgctgggagtccactcgagacactagttgcctctgtttttcctgtacctggaagtataatatcagcaatgaagcctgcaggacagcaaagttggcagcctgctgcttcctctggaagttccatgctagggataactgacctattgctggcccaagtgtgcctggaggaagtggttggagactactgttgggaggtctcattcagtcaggaggaatgaggtcagggattgacttaaaaaagcagtctggctgctttttgatagagccactgtgctgtgttggagatttcttcagcccctaatcggtttgggctctccaaggcccacaggctggactagctgagaagcctgaatgtccaagttggtgacctgccccacccttcaggcactttgtcccgtggagaacacaggcaggggtggccagaggccccagctgggacaacctgccctgggaagaagaatggatggggggatggggcagttaaagaaacagtctggtcacaccttgacaaaacagctatgttgtggtgaggaactgcctctgcccccatcagcttggactctccaaagcccacaggctgtggaatgactgaattgtccaaacaacccaggtggtgaccctcccctcccttggtcactccatcccagggatagaaaatagctctgtcatgcaggcaggtgtggttggagggccccagctgggaggtcccacccagtaggaagaatggatcagggctctgcttaaagaagcagtctggccatgatctggcaaagccactgtgttacgctgctggggaaaccttcctccttgtctggactctttggactctccaaagcccacaggctgcaaaggcccagtcgaccaaatagcagagatggtgtctgtacctctcctcgaggctccatctggtctcaagaaggctttgtcctgatgacagtggctggctgaaattccaagccagtgggtcttttcttgtagggtgccatggaaatggggcccacagaacaatgccattcggctccctggattctgcccccttcctaggagtatgtgcagacctcccgccttgcctgagttgcagacacctttgttggaaatcccagggtggagtttgtaaagctccaccctgtctctgtgcatgattgagcagttgttctgccaagactccacacagctctgtgtgtcagacccaaggctctggtgtcatgggctcacaagatctcctaatctgtgagttgcagaaatccatgggagaagcatggtttcttggggtcacatagtcactcactgcttcccttggcaggggttgggggttcccttggctccacgtcgctcctgggtaggctgtagccccatcctgctttccttcattctccttgtgtgaagttgtttccctaatccgtctccatgtgagaacctgaatatttcatttgaaaaggctgtatttactgatcccttccattcctctccttgagcactgcagacttcagctgcttctcatcagccatcttggcccctgtctcacctgtttctcttgattggctaaaaattctaggctatttgatttatttggcaattaccaatttgagtggtccaaacattcctgaatatgacttgtatctcatatattaacttttattactttgaaattcagtattatactaaaaattgcaacttcacttaggctatttttgtaggtaatgatacattaccttaaagatgtacccttgattataaaacttttcacattaaagatctgatctgatagacacaatagcttctataacaaagaagaaaagtcacacaaaattcgccatcacttagttacataaaatattattttttacattaaaataaaagtaacattaaaatgcatgcaaaacctgggaaatacaaatgtcaaatatactggtttaatataaatcatgaataagaaattataccactgcataataataccaagacattaggagaaaatataggcaaatgatatacaagataactcataaaagaaaaaaatattatataaacacccaatgcttaatttttatcaagtaagtaaatacattttaaagtgatactttcagtgttggtatttgacaaaatggatcctttgtattgttctgcaagtcagaaaatactttcaggaaaatagctagacagtatgtcttcggacacttgaaatctcttacaatacagtattttggtccaaaaatcataaggcaaaaaaagaaatgaccactaggatttaagtccaaatatgtaatttgcaacattaattacaatgtcaaaaattgggaaaaaattaaacacatagaaatatgttgatagcatttaaaatgtgctaacttttaattgtatggggaaatatataatattaagtaaaacttgtaggatacaaaatgtatcaatctatcgatctaattaaatatatgcagtcatgtgtcactttaaaatggggatgcgttctgagaaattctgtgtgagtttcaacactttgtaaatacaagagtctgcaaagacaaacgtaaattgtatagcctattacacacctaggctatatggtagagcttattgctcctagtgtagaaatctgtatagcatgttactgtactgaatactttaggcaactgtgtaaaaaactggtaagtatttgcatatcaaaaaatagaatggatacagtgaaaatacagtattaaatttgatgttaacaccattatatatgaagcccatcgttgaaagaaatgtcattatgtggtgcatgactgtttgtggaaaacatatgaaagaaaatagaccaaattatttttagaggtggaaatatttttgcattacatttcacttgtttcttcataatattctctgcttctaataacgaacgtgtattcattgtgctaccaggggaaaatagcctgaaattatttttaaaacaagacccaatagaggaaaagaaggaagagcagggggagagtaaccagaaacaaaagacatttttgttttttgtacacataaaaacattttatgtgtacttccataaaatatgcacacatgcacacgtgtgcacacacacacactgcagttgaattatatctaaagatgtttattttttcaaacttttcattttttatcccaaatgaaacatgtagagtaaccttttaaaatcaactgtggcttatagcagtgtgacattactgttttcaaagaagtaactgactttgtgaccttaccaaaaaaagtttattagctttacattggaaagcagtttactgatggagttttactgactgactggaatttacaacagccagggagaaatatccactcaaatatctactgccattctttaatgcagttacctaaatatcagacgtgtctacctgctgctcagtctactagtgtaaatatttaaataaaactcagtgtgaccttttcacttagttctgaattttcttcctctctcttcctcttcctcctcttgtccctctccttttccttgtctcattttacgcatacacactgatttaccatcacacatcaacatttgatttcatcaccataaaagaagaaaatatgttctaggaagataatagaaaatgtaaggtatgggggcattagcatacaaagggagaaaggaaggaaggaaggaaggagggagtgtgggaggggaaagaaagggagaggaaagaaagaaagaaggaaaggaaggaaggaaggaaggaagaatttagtgtgacagtcaattgtttatctcttatttccattatgctatttattctgaaaccctattatatttttatagtgattaattttgcctgaccataaaaagcaattcttgaatagacaacatagatgaaacaaactatgtaaactttatccagggatgaccttaataaatatgttagattctaacaatcttttacttttatttatagttttgttgctatggagatcttatttcagaactaaaagctacatatataattctgaatgttatcattttaattaaaagataacaagtaaattttctatgccattaacaattgcatattgttctctttacaacaatgtcttttggagtcaatgaaaattaaaaatggtcttgctatgtggtcttaataataattataacagtcataaaagattaacaggtaacagttatgttcactatatgccagaaagtgtattaaattctttgcctgtactaactcattgaatcctcatgcaaccttacaaagcaggtactattatcttccctattgtatatatgagaaaatggagaccaagcattctcaacttgtcctggaacccaagctaaaagtggagccagcatcagaacccagaaggcttctgtaaaagcccacgtgacactgactttataacaaacctaccaaaatttagcagaattcattgcacagtcataaaacactcattttccccctttttaaaaaagcacttttttccatgtttaataacttgtacgtactttgaacataaagtatttttttactattacattttattttatttatttatttatttttcttttttttcatttattattattatactttaagttttagggtacatgtgcacaatgtgctggttagttacatatgtatacatgtgacatgctggtgcgctgcacccactaactcgtcatctagcattaggtatatctcccaatgctatccctcccccctacccccaacccacaacagtccccagaacataaagtatttttaagtgtcgttacttactggtatcccaggttaactcgaatggatagagctttgatggaatgtcagcctctaggtgctgtaaatgaaagatcttctgcttcacagagttggccatagcatcattgcattgtttctttttcacttctgtgtacgcaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgaggtacatgtgatgacgtagaaattgtaataaaatgtcaagcaattgtgtcactctcctactgtattgtattattgttaattatattactacttacaccttttttattttcttctctaaacaagacactgacaattttaaaaacctgattaattcgtttcattttatttctaaatttataatcatgagtacttgaactattataaaaatcttagtaccaatgtaataatttgaagagaggaaccatgctatccaggccatttaataaattcagaataaatttaatttgtaatcctttcattggtagttaatcatgttatcaattcttcttgagaatgtgcagtacattatatgcagagggttgtctaatatttattataaagtattgaataagaaatcttagtttctggtttatattaagtcatttagaaactcatgactgtagatgggtcttttgacaagctctgttttctcagaatcaatatcacaaaagcaataaagtaaaatacagactattttaaaaagattgttcatgaacaaaaagacatatattaccttctcaataattagagattaaaaataatcaatgatcacgtttatataaataaaaatatattctcataggttaaaagtaggtatatcatatttttaaattatttggagagcaattcaaccttaaaatatccattaaaactgttaatcatatacgtaggtgagctctttaagatgtttgtcagccgggcgtggtggcgcatgcctgtaatctcagcactttgggaggctgacgcgggcggatcacagggtcaggagttcaagaccagccggacaaacatggtgaaactccgtctctgctaaaaatacaaaaattagctggttgtggtggcacgtgcctgtaatcccagctactcaggaggctgaggcaggagaatcgcttgaacccaggaggtggaggtggcagtgagctgagattgtgcccctgcactccagcctgggcaacagagcaaaactgcctcaaaaaaaacaacaacgaaaaaaagatgtttgtcacagtattatacatcctaggagaaaaggataacactatacatacaaaagcagcagaacggtaagataaaagggacacaatgctattacttagccagaagtttccgaactttcttagttcatggagcccttagtgtcttcgaactttttccacagcagtcctgagccgttaggtccaaacaacctaaaaatttacgtcctaagactttggtagccatttagagaaataaacacaaaataaaagtgaaagtagatttttatttcattcttaaacaacagcaattattactaatgggatgagtgctattgcactgtacgactggcagaaatggggatcagatttgccaatggcattctaattttctgttccacttttactctacatgatactctgtcttaatcagagtaatgagagtaatgaccaaatccaaaattcacaaagacagcacatcattaaaaggaatgacacattatctaatactggaacagtaaactaccttaagctagagtttcacacaatgtccaaaaggtgtcaaatattgttgtgttttctttaaaaatttcaaacatgctatggcacccctattagttttctgcaccaccttcatgttccttggcacccagttctgaaattggagatgtattcatatatatatgtgtgtgttatgtatatttatgtataattttataagaatatggaatatgctcatcataaaataaatggaaaaaacaggattaatagctgtgttttctattatctttatgtttaaatagtttctagttttttgcaatatgaatatacgatatatattcttaaataaaaaatttagagtagaatatgctatataaacactgatggagactttattaacattaaatgaatttaagattattggaaagtattttatccctccccctaaaaaaaactcttaaaagcaaactgattgttaaaagaaaatgtatgtgaacatcccagaaatttctatcttctctaaattagtatgtgtcttggctcatgtgacttatctcccaatgtatgagagatcttaaagatgaattattcatcctctgttaataaactttgaagtaccatagaagaggtgaaaattctggaacattaagaatgaagaaatataattctaattttcaaaaaaccaaattaaaaatttggggtcataaaccctgttgagtgtgtgacgaagtctatgactattcacgcacacacaacacttgctatatcggatcagcagtttcatggacactttgaagcccatctatatacaatgtcgtgtttgagaactgcaggtatagactaaaatacctggaacttatttattagacagaaacagtaggaagaaatttaaattaactgacaaagaatcagggtagacttaccatttctggctactgccagattatggtcctcttagagactgcaattattggcatgaaatgtaataaaagtggctgtgcttacctttatattgctacacttttctcttaatggaaagggactccctttgcttatttgtttagaaaaaacctcagggactgggccaggcatggtggctcacgcctgtaatcctagcactttgggaggccaaggcgggtggttcacctgtgctcaggagtttaagaccagcctggccaatgtggtgaaacccccgtctccactaaaaatacaaaaattagccaggcatggtggcaggcatctgtaatcccagctacttgggaggctgaggcaggagaatcacttgaactcaggaggcagaggtttcagtgagccaaaatcatgccattgcactccagcttgggcaaaaagagtgaaattccatctcaaaaacaaaacaaaaaacaaacaaacacctcacggactgtattagagtcagtctctagttttgttgtacttatctccttgatatatccacacactaactatactcaaacctcacagactgcatgaaaattagcttcaaacctaaaataatacaaattatacaacattcattcctgaactatttaaaggctttggcctaaaggaagagaaagctcgtcttgttatcttcacaaaacctgaagatgcaatgtcctgcttccccaagattatactgcctcaatcaattcttccagagtacactaaggacaaaggcattgaggcccaaaggtggaggtatgctggtaaatgcttaacaaccagctctctccagggaggaatggtcaggaatgccctgatatatagcatttgttaattttcatggtgcgaatttcccaccatggttgatttcatgctaccatatatggaactgagcagggagttgcaaagaggtgcctaatagcactatatgacggtatttccatcatatagttgcaataaatataaatgacctcaagaacatatacgaaagtaaagtgtagagataaattctgaataggtatgaattttgtgtttcatgtaatttacttaatttatagcttatgtagtggaagttttaataatagctctgcttagcagtcggttcttgtgaaccagtatgagtgggattcagcacagcactgctagcgtaaattaaatatacttaccacaatttctggagatgaacatcatgaaagaagtgatggaatacaagttcactcctttgatgtaactctatgtggacatttcctttttttcctttttttttttttttttttttttgagatgaagtcttgctctatcactaggctggagtgcagtggcgcgattttggctcactgcaacctccgcctcccgggttcaagtgattctcctggctcagcctcctgagtagctgggactacaggcacctgccactatgcccggctatttttttgtatttttagtagagatggggtttcactgtgttagccaggatggtctcgatctcctgacctcatgatccacccacctcggcctcccaaagtgctgggattacaggtgtaagccaccccacccagccctaatttttgtatttttagtatagatggggtttcaccatgtcgaccaggatggtctcgatctcttggcctcgtgatctgcccgcctcagcctcccaaaatgctgggattacagacataagtcaccgctcccggcatatatggacattttttgtgacctagtcctaagagtttgtctcatcccctcctcttgtagctgcctacactgcaaagtgggccaatcaccacctgcaatgaggctgctagctacagggtggcttgagactgtgtggtgatatatacgtgcacttcacttcatttttcctcagcgtagtcaataaaaaccaaaggggagagcagcaaaatggtgtttggcttagattctctctgttcttcagaggacacccactgtggatattatgctgttgtcttttgcaatacagctctgctagggaagtagaggaatgactctcttgaccattgcagaaccacagactgcctaggaagaaaatcagtcacaggaggagaagcccgagtttgaacctgtttctgccctttaatggttgtgtgacagtggacaattcatattcccctttgatgaaatgaatctaatcgcattctttccatagggtttatgaggaggcaacaggaagtaatagaaaaaaatgtgtgtgagttaagattacataggctacatttaatggatgcacgtttattctcctttatgtaaaagaagactggaggcaaatggctgctccacgatcttcaagatcacagtcctttttaatcttgctcttcctctatccctgttgcaaatcactcaaagacggctgctaacatttcactttgcacttcagctagcaagaaggaagagagagtaaacaagactgtgtcctccccctcttaatgacagttcttagaatcgcatacagcccttccacttaaatatcatgagaccaaaactggcttcaaagaagttgataatttattatattgactggggagcaatgtgcccagctgaaaagcattattttttttccctaatgagggtaggaagaaaggatatgtagaggtatccaatagtccctgcgacattttgtgtacacttgaaagctaacaaaatcgttactgcagttatttctttagaggcaaggttattggatggcaaggtcattaataaatgtatcatatgagccacaggaataattgaatattaatcggacaactgcaacaatatttgttactatcagcttcgttaaagtgtcagaaaatattctgtggtccaaccagtttattttaccaatgagaattttattttattattattaatatttgagacggactctttctctgtatgcccaggctggagtgcaatggcaagatctcagctcaccgcaatctccgcctcctgggttcaagttattctcctgtttcagcctcccaaatagctgggattacaggcatgcaccaccacgcccagctaattttgtatttttagtagagatggggtttctccatgttgatcaggctggtctcgaactcctgatctcaggtgatccacccgccttggcctcccaaagtgctgggattacaggtgtgagccaccatgcctggcccaccaatgagaatttataactagaaagaataaatgacaacctaatatcctataattagttaccttaggaattggggtcagaattcactaaattgttcggatctgttaacttgagcctgcattgcttttccagagcaccttgatgaggtggacttgtgcctagagttgctgaaaacagggaaactgtaaggataatttgaatcccctgcagaaagtgaaaggtccgaattaaagaaatatgcacacagaggaatatgtatttaataatattaaacattgacggtattattactgtcagttggggaaaaattgttcaaaaagattgtaaacaggagacgtagtactccattttagtatcaaaaatgattgcctttggtactaggcacacttaggtagtacctaatatgttcatttcagtgcaacttgaaaacattttcccaataattctactttagattactatttcttctttgtagttttctgattctttgggatatatttttcctcaattttccttttaccttcttatatatgaactgtgtggcaaataatacatattcagctaaccattattaataataattgattttattgtaaatgaggcctttgtttttttttttaccatcacctcataaaccacaatttgtgtttccccccctaaaagtacttaagcatttaagatgccataacactaaatcatagaacataatttgttcatggaccttccagaacacagaatatttgacttatgcttcaaatatgaagtcgtgatttttaaaaatgtcttcactgttgctttcatttcaccccatcaaacatgctctggaaaagcaccacaggctcaagttaacagattcctaaccatttagtgagttctaaccccaatccctaatgtaactaatgataggatattaggctgtcattgattctttatagttatatattctcattgaaaataaagtggttggaccacagagcattttctgacattttaatgaagctgatagtaaaaaaaatagataatggtaatattgtatgataatttaaaagatatatattacaagtattgtatatcttgatattataattagcggttggcttcatttactactaattcactattcatagtaaatatcatccttgaccatgcaaatactaaatgcaattttgtatcatataaatttaatgctatagtgtatattgatcaaaaatgtataagaaatggatattttctttctataagcgatagcagccagagaaacacagtaagtagcattgtcttatttcttaagatttaaaagacctataatatctttaagcctacacagctcaactttgagttcccaaatcctaagtggtccctaatcaatattgtaatgatattttttgaactattttctacatccaaaataaatctaatgaatttttgacaataatggtcattagactacaagtctgcatagggtaaatacgatatcccttgctttgggctgcagttttatcagcttattaaattagtgctgattatctcatgcttactggaggcatttattgatagtatgtctttgaatgataaacataaaaatatatttctaatattatttgatacaagaagtttgctgaataaaaatcttttaaaatattctcaagaaaatttataaaatgcctttggggcagtaaaattgcaaaggatcattgcttttttttgttcaagttataatctaattatcagaatgaatgactccattagacacttcaacaacaacataatttaatatgccatagattttggaggcagaatgctataatatttgtatattttggttgaggtatagatacttgaccttcactgtattcatagttttgtctagttcatcataatacaatgtggacgtttacatttaatttctttttctcaaagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtggtaaggattttcacccgcaaaatattggtctataaaatatcaagtaacatttttgttttttggattattgaacaacaacaaaatcatgacatttttcatcatatttgtgtttgggcaaaatgatgtaaaacaaacattagagttatcagaattagtatagatacttgctattctttgagaatagctaatgggactagcttgaagtaggtggttggttttattcccacggagcacagaatgttagactcaatatttctggatgactcgtggcacgtgcttcatcccagcagttagcagcccttaaaccggcagcatcgtgttttcaaatatctcatcacatgtgctctaagttacttgcttatggtttaatttaatatttttaaagtttttaaatcagggactttattatatttactcctgtgcttccaaagatgatttgtttgaatatgtaaataaatacactttttagcaaatctctaaccagactaaatattacacagttaaataaagcttgatttccactgcatagccaaagctgtgccacagaagttcacagtgatttttttctgccttttgtgtgagttggtgccaggtttcattagattttggaaggagagcaaaagtcaaagaaagccccagcacacatgcttccaaacgacactactccacatccctaaaagacacttagtttgcaattttagtatgagagttccctatggctctgcaagaccaggagctgctttagcccagagaggctatttgggagagcttagaattccagagacccatacaataagaagatattatgcactataagtacaataatgtcatgagtgtttgcactgtgctccaaaagagctctgatggtctcgttgcctcaaatttgagcccagggtttcataaaatgatttgacaaatggaaatccctgaatgaataaacagttcaggttgaatatggaaggtttaaaacaataacttcatgcaaatgattatttaataaataattttcttaaagtaatcataaatttatactagaaattaaaacttgaactttggttaaattttctcataaagtatattgactatggaaaaataataatagctccatttataggcaacaggtattgtgctaggcaagtcgtattttatatttaggatgatctgagaacaatactgcaagaaggatacaaacattttgtagatgaaaacattgcgatttaacatggaaaaaataagttattttatgagaaaaataacttttattttatgagtaggagataaaaagatagatgtatagcctggtatagtgggttgctgctgtaatcccaacactgtgggaggccaaggcaggaggatcacttgagtccaggagtttgagaccagcctgggcaacatagtgagaccatgtctctacaacaagttaagaaaattaaaattaaaaaaataaatcaaattgaattaaaaaattagctgggcataatggtgcatgcatgtagtcctagctgcttgagaggctgaggtaggaggatcacttgagcccacaagtttgaggctgcagtgagccatgattgaactactgcattccagcctgggcaacagactgagactctgtccccccaaaaataaaagaataaaaaaagattatggattcacaatatgtgagtttgattatgctctataattacattttattttaacaaataattgcagtgagaaaacatagaataaacttttgaatcaaaatatacatacatacagaaaatcttagatgggatagagacaaataggacattttgcaagcaaccctgcaaagacaagtgtttatataagaaatgtactttcaaagatgttgggtgctggtatttcagtgaaattgactgagcactcattctacctcctcttcccccacatactcattccctcattatgcattgactccaaagtcagcaccgttactctggaaggatctttaattttgctagggagacaatcccctcaaaagaggtatgtggtcagttataaaatctcaattattatgcataggcagttctttttatcagtaaaagcgagcatttaaaaataatcatctgtgatggtacagagcaaatttaatttgaatattaattcagagagactgcctgccttagatttaatggttattgtgctaaaatggaagaaatcagcatcaggtatatatatatatacacatatatatatgtgtatatatatgtgtgtatatatatgtatatatgtgtatatatacacacacatatatataccatatacatatatataccatatacatatacatgtaccatatacatatatatgtaccatatacatatacatataccatacacatgtataccatatacatatacatataccatacacatgtataccatatacatataccatatacatatatatggtgttgttaaaaatatatagagaaaaagagagacagacatagagatagaaccaatgaaaatatcatccaattacattccttaaaatattatgataggataaaagaagttagaagcaaatacagatttttagacctgtaaagagaatgtagttaggcactgaaatatacaatttagtgtatctgaatgataaatatttttttcttttttttcttttgcttataccaaggaggaggagtatagaaggggaggggaaagcctgaattattgcaaattttatctccatttagcccatttatagtgctagttatacaggaattaatgcattgtgatataagcacaattcatgggaatttaaatgggattttgagttggatactaaaataatctccaacaaccacaattacattaatgctgaaaacttaatatctatctatctatatatgcatatacaaggtatatagataaaaatccaaatatatttccctaaaatatcagtttcataaattgcaaacatatgaccatagtccccactgagaccagagtaatatgttaattaatgttggcattgaccacccagaataggacagagcatctctctccctgacttatgttcggccagcagtagctttgctgtcttcagaaagtctagtgatccacagtcacacccacaacacacatacacactttacaactcatggtcagcctatcacatcaggctgtctggctgtcaatcccatggtggaagctgcttgttatagttagacagccaactgctgctcagtagtaggtcttacactccaagtagatccgtagtggtgcatccagtcactgaatccatgctctgctgctgtgtgtgagtttagcttaggctcaggctgtgcttcaaaacttgtagaactatactttcatcagtggtctgacatggatgttcattttattctgtgttttcctcagagcctgtctttctattttacagggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggtcagtgaaacctatttgacatttgttcctgaaacttattgcaatttccagagttaatgttgtgctttgtttggttttgctggtgttacacgctcaggattaggttttaattcagatcttcaagacgcttacttggttgtagtgtgtgctgattgaataaagaaaacttggaaagttgttgagagagcaaggcatgggtgaaggagaaaattggttgagattggaaaagcaaaatctattccttaccaatgctagtttatttttaatagataaattgctcttcttttaagtgaataatttatgtttaaaaacaaggaatgtttattttaaaaacacaattgtatctggtatcttttctctttatcaacattcgtgtaccttttactattagtaacaagattatactaattttaactttaaggaatattccactgctggaatcagaacttcaaaatgatcttgctaaaattatgcaaatggttggaaaagaaaacgaaagtgaatataaaggtggaatgacaagatttgtgtatcaactgacggaagactggcttaggcaaaaataggataattttaaatttggctttgtagtgatatgacaaatagaggcttaggtaatattcttgttatttgaatagacttcgcaaccttggaagttctttgataaatacagtacaaagaaaggtgacattgtaaattgtgatgttataagcaaagaaaaattagtctcaatattggactgataaatagtaactgttttcatctatttttcttgagatagtctttgcaatagtcatacatatatattgtgaagaactacttagaaatgggagatacaaagaaaactaacatttactgaacacttagtacagatgtagcagatactgaaaggagtcatgacagagagctcaattgggtgaccatggactctgatttctgaatatgccatatactctcatggcaccctatgcatatacctgacacggtttctaacacactatgatttttgtccctctcttttcccctctaggctccatgctccttgacagcagggaccatgctcctttttcttctgtctctggcatatagaatagtacctgtaagaggtgctctccaatatttgttgaattcaatactctgacccctttcaactaacagaatatcccctgctatagaacatatatattttcttgtaaaataggctttatgtttgtgtgtggcctgaatgtatggtctattactgaaaaggattcaaggaagccacaagaaatgttatgtcagagatgtgcctaaattattgaaatcaaaggtattgggaaatacctagttattcactttctccatttctgctttattagttttgctttttccttgaatgtctagtcaaaatgattaatcaaccatattttatcactacattcgtttataagtatacctagggaggtttacagcaaatcgaaaatatctggagagaccagaaaaacagataaaacaaaaacaaaagcaaatgtttgccacagttgaaaaactcccacattatattgttatgattaatgattattgcctaatgactaaacataaaaatattagtatgaaggcctgtctccttgcagtctctgagcaaatccgatttgctggtgggtttccatgtaacaggagccaatatatttgaaaggataagatattaaccctagtggtcaataaacatgtattaatttgatttggtgtaatttagtactccaagatactctcacctaatttaagctgtgtttattttgaaaattaaagatagaatgaacaaagaaatccaatacatgacagttaattcaccttaatagatttgcttaaacctaataaaaatggactgaagagtttttgtcaatttagccaagaatctgtgcaaattaattgaaaagatataaaatctaaagatttccgtagtattacccttctataatccagtgaaaataccttactgcttcaagcattttatataaatatatatatatacagacatacatacacacatacatacatagtggaaactaagtgctcatatttgagaaacattagttgaaaaaaaaattcaaccatttaaaaaagttatattttatattcattcattcaatctaaaagtacatatggaaaccataggacataatttcctctgtcttttaatgtattttatcaaattcaattaaatgtgtaaataagttagtaaagtggcaacactgagaaaacagttaagtcaggattctaatgtttgctttaacaaagggaaatatatctgtatcacagctattctactcttatcagcatgagcattgaagaatgtcagtccacttctccttttgtcaaatattttgattgaaagaatttagaaaatgcagaaaatctagaaaagaaaaataaccagtgataaaattttggtgtacacacacaaagtagtgcactgagaaggtaatatagagactctcagatactgttaatatatactggtaacttagtttttatttaataaattccatggtccaggatgaatgtaacccaattagatcaaaaacctttttttccatcttggtcaacactgttctttgggaattaatttaaaatattaaatacatcttacaagtaaaataatgtttaatatattgttcaccctatctttgtatctttctttccaagttgtgattactgtcttcaagagtctcattagtaatcaacagtagacttgacttatgaaattcagtcaaactcagtagccttgaatttacagagtggattatcttaccatgaaaatattgaacaagttgcaacatcaacgttttctgatggatagccaaaaacaaacaaacaaacaacaacaacaaaaaaccctacttactttttgaaataagtttttatttcaaagtgactcaattttatcccagtacatcattttttaggacagaagttactgatttatgaatacatatttaggcattacttttaactaggcataaatgataatattaaacaggtgcaaaaagggtctaatgaataatagctgttcattctgggcataattttcattttaactttaaaattcaaaactctggggaaggtggacctagaaccatgtttttcaaataattttgatcaaagtacagtaagaaaatattttatgtcatacccaaaacctactgacacaaagtttgatgaaataaaacttgccttgctattttagatgcactatgataagtgtgatattttcttttcttttgctttattcttaaaaaaaaaaaaagccataacccactataataatttcatgtcctaaatacagtttggaaaacaccgacctgacctgcattctttttcttatttgaagtgttggaatttttaaaagttttagttgcctggaagtattaactccatcactctatattggaaaactaaatttgtcttatgggaacagtattataatattataatggtagtaaaaaagcattaatgtacattactatttgaattatagcaaaaaaaaaaacctaccttttgaagtaagtttttatttcaaaatgcctcaattttatgccactaaatacaaacatatttagaacaatactcagttgtcgtctgccaatattaacaaggtaatacaatgtgattcagcatttattatagtggggagaaagtgatttatcttaatattctctctcagttattggaaaaaaattaacttctctccatgtataaacaaagcctttccaaaaagtcattcagaatatgtcctgtcctaaatcagctgttttcttatactcaagtattggaacatccttgttttgttaatgtaggtattgcttcaattttcgaatggctgttcagtgtccacactgtctcagaaatatgtaatcagaaaagattttctcatttgtattttcatctccaaaggaaatcttctgtggacttgttttatttactttgcttcttagtaaaatttcctttgtaaatcattgtgttccattgggtgtctcaagggaggagtgggagttttcttggttcagtgtgtggctgggagcatgctgggaaatagttctcagttcaatctgggcaaatgtgtttgggaacactccaggcagtgtctattctaagcaattaaaatatctctgttcttgattttatgaacacttggaaatgtagccagcatattaatatttctttaaaaaattaatttataccgttttccaaagttcagtgataacttgccccatgagacatccttttcatcatatgagaaaaaaggtctcatttgaaatacaatttttgatgttttagttgtttactgaaaattttttttcagttctatactgatattatttcaaaatgtcttaaattcttgtaactcaaaaactaaatgtttcagcattactacaaatactttaagagatttgttttattatgttttacagcaaaataattggagacttatttaacaagatatgttctctaattcaagtttaaaccatatttattagaagccttaaaagatgttacttccctttgatccattaaatttaagtttttctgattctaagaaaataaagaagcacccagagttatttatcacaacatatatacaataaccaaagtaattgaaaacaaactactgaaaatggacatgtgattttaaagagtgtatttttatgtggaatactattatgtcattataaatcacatttcttatataaaatttaataacatggtaaaaaatgctaagaataaaatttttaataaaaacttaagtagactatgaatctaatgtcattattataaatataggaattttatttcattccaaatcagaatgaaataatataatactaatgttgatcatctctaattggtgggttatcagtccattatattaactttttaatatattttctctaatatctatattttctccaataaacatcaattgttctcagaagtcaaaaacaatatgctacaaaacaattgaggataaaatgatatttctgaaaagtatgatgcttaacaatgttacaaatggaaattaaatagcatatcaatttaaaaattctaatttccttacttagaaacatgtacagccaatttcttaaaagtttcaccttaaataataagcttcaacagaatttcaattgcatttacatacaaatggagcattttataatcaggtgcagaaatttggaggttgtgtctataatgtttaattatttgaaaatattcataactcattttgaacaaattccgcaccatctatgtaattttaaaactatttttcaacctgggtaaataattggatagataagtagataaatgattggaaaatagatagatacgtagatagatagatagatagatagatagatagatagatagataggtagatagataaaaagtattgtcccttaaaactattgctagctatcaggtaacaacatattcctttttctcaataaaggaatagattgaataaataaataaatcatcactttattcccaaataatctacatacaccatacttttacaaaataagtggctaaaaagtaatttttagatttttgtaccttttgatgggcttgtagatatctaaaaatttccggtaaaggcaaatccatcatcttaagatacaaaagataaaacatggctctgtattcttagggcgaaaatggagcctaagaaattctgattcatagagcactgtactcactttaattaggagcctagaactgagctggaaaggaatagattctattgtttggtggatcccaaaagtgagatagataaagatctgagtactagatctaaatagacacatagaaataagatacccttggacatatctaaaacatattttgctgattttattccctgaaattcacaaatagacttgctgtgagagccacatggtaccaagtaaaaggcatttgagtcaatggtatgttgctcctgggtagcttcacccaactgactttttattatatatcaattcctagtgtggctgtaccactatcatgcgaactgagtggaaatctacctttaattatactgcagtgaatgctggtgcacatttttcatcaatagaagcattatagtgcagaatgaaaggaaaaaaaggaccgggggagagttttatgatgttagatattgacttattctttagaaagcaaaagggacattttaatttataatcacactccaggacaccatttccattctagtttctacaatatttttgagccttttaaaatgttctatgcctttttcagggaagatgaataaaacatgttgtgtgtatgtgtgtataataattttttaaaattccaaaaaggcaataaagttttagtaactttgttggataaaatggaggcaaaaggtgccaatgagaaccagactgtgtttcaaaagcttcagtttactgtacaaataaatcgaagagaaaaaaaaatcagatatcactagttgatactaagagaataaaaatgaattatgaaagaatagcaaagaacatagcccaggaactccaaaaataatatatgcatgtagttgaagatgtttctaagacaagaacagggaggacatagaagcaaattaactttgctgaaaagccagtatatttctcagttaacagataatattgtatctacttaacatgtacagaatgatgtcctgaagtacatatacaatgtggtcctttacctttcatttaagtgtaagggctgacacttcatgtaaggttgaaacttttgtagtggataaatgagtaattggtaaatttaagcaatatggatttacatagtagagatatatctaagtcaactttagatgtttttgcaattgcgtgtctaattttgtttcaaatagttaacaaaataaatagtgttggcatgaaacaatcagggatgatgtaccttcataatcagaaaaaacacaaagcagtcattggtttggaaccttccccacaccacttcccactccccccattaacctcatgttgagaattaccagggataattaacttgaccaggaaattcagactgtgagatagtatcattgcccagcatctacctccctcaccttttaatttttaagtaatttgggaagaatgtaggctcattaggttatctgttgcttggttgtaactagatgtggaaatcagccttcttgggggagggattctgcagattctgtgagcctctgaaagtgacttgggatcagctgaaagaatgactcctttggaaactcagtatcatgtttagccacatatatttcttagtctctttcctttcttcatcaaggtttttcacaagaaaattttgggagagtcattcaacatgcatagaaagtaattacctttggtaaacatggtatcaggaaataattatggatatggccccatctgcaatcatgactacattttctgacttattttattctgatatatttcccttgaggcttttctaacctgagctcagaccctacttctgggaactgaaattctgtgctatttctgagtcctctttcttctctccagtcagtgcttttttcctttcattcattctctacgattcaattttataattacagttgtgcctagattcttactgtagcgcttggtagactctgatgttttctgaaagatactgatgacctgcctagatgtctgttctctctacaatcacttctagtctttcttctagcacttccaggctttctgagtgtctttccgagattgaatctctattgctgaacctctgtccagaggccgagatcttgctacccctagacgtacaacctgctgcctgttccctgcctggatattggagtactgctcacctccaatttcccaggattctctccttccctcattccaatcctctgctattttatttttaaccctgacatggttgacttgattattttaggtcataacttcctcttgcctatgaatattgcttacccttttgggcatgaattttaactacctcccaatctcaactgctgctatcaatccttgtgcacacctgtgccaaatctcagccacccctgtattctttgtcatcaaattcctattgcttcttggaatgcaaatctaacatatagtggattggggaaaactacaagcagaaaactagtaaagttcacatagtcccctaagatcttagctttggttgagcacagcttgtcagctaaccccatggccaagatcctaggatcgagagacctgcatctgtaatgctgtacataattttatgggcaggggccagaaaagttgtcctgttaggaaaggagagcctctggagctcattggtagttatcaggcaacttctcttttgtgctccctcagatctgctgagctagctccttgctgtactgctataaaggctggcgagaatgagactccggggccatccagatatgcctcttatctactgctaagattatgatgacaactgtgataatagataataactattgaatgcttacactatacctgtcactgtgctaaagcctttgcattaattatcttgctatggctccaataacctcgtaagttaggtcctgcattattgagaaacctttctatctcatttatacaaatggtaaagtcattcttctggtgacacgagttcaaaactttgagaaaaatcaaattttgccttttatcttttcctgacacatgcgaagatttaacaatcaccacccttcttttaaagtgcctcattcatccattatctctttaccctaattcaaaaattcataccttgaaaaactaatcaagggcatcttattgcctaaaagaatgtttatcttcaattgctgacctatttgttagggtataggcgttatgagcatggactctggagccagattgcctactggctatcatggattgagttctttctctgtttcagtcactgttgaaacaaacataatgtacacaacggttttaagccatttaatgcttggaacaactccacaagatgaaggacattatcatctgcatttcatagattaaaaaaaaacacaggaatagacatgagtaactcaccagggcccctttcagctagtgaatagaagagctttaaaaattgcccagagcatttgagtctaaagtcactaaccttggccactacctctcatattcatgaaacactttggtgttacatgatcacacaggatcaggtactgtggaatatgacacatctgaaatatttgttgaaggcagaacctgacatcaatgatgtccttatcatgtccattggggttctcacaggagcattttaagtaatctcccttatgtttctaattctgtctcccatattatccaagtttctatttctacaatacaaggaagataattcaatagtttcccattactaaagaataagtcctgagactttgctgaagttgcctatcagcttaaggagattttgggctgagatgatggggttttctagatacacaatcatgtcatctgcgaacagtgacaatttgacttcctcttttcctaattgaataccctttatttccttctcctgcctgattgccctggccagaacttccaacactgtgttgaataggagtggtgagagagggtatccctgtcttgtgccagttttcaaagggaacgcttccagtttttgcccattcagtatgttattggctgtgggtttgtcatagacagctcttattattttgagatatgtcccatcaatacctaatttattgagagtttttagcatgaagtgttgttgaattttgtcaaaggccttttctgcatctattgagataatcatgtggtttttgtcattggttctgtttatatgctggattatgtttattgattttcttatattgaaccagccttgcatcccagggatgaagcccacttgatcatggtggataagcttcttgatgtgctgctggattcagtttgccagtattttattgaggatttttgcatcaaagttcatcagggatattggtctaaaattctctttttttgttgtgtctctgccaggctttggtatcaggatgatgctggcctcataaaatgagttagggaggattccctctttttctattgattcgaatagtttcagaaggaatggcaccagctcctcctaatgggtgcagcacaccaacatggcacatgtatacatatgtaactaacctgcatgttgtgcacatgtaccctaaaacttaaagtataattaaacaaaaaaagaataagtcctgatttcttagcatgccacacaagaacatgcacaaactatgctccactggagcatttggcctcatttctcctactttgcgtcatattgactactttccactccctgacaaggatttccttctctatattccatcctagcaaactgccatttatcatttattgcccaattttagtatactttccttccccaaaccccaggaaacaatctaccatcctctagtatagtgccttgtatcttgaataacaattattttttgttacatattaaatcacatactcctctactattatgtctccctcatatctgtactcctaacgccactcatgtgtcaggaaataggtaatcaatactttcatctttgcttttttggtttgattcacacctagactgttgcagtttccttgctcttctctctgcctcctgcctctctaaacaagtccattccacacatttcctcctgattacaatttcaaaatgactgcttccattgagtcatgttcccattcaacaatctttcatgaacccccaagttttaaagatggtctcacatgtcctctacaaaaagcctgaatactaattccatggcgatctcaaatcctttacaaattttaaattattgtttacatttgtttgacatgatttattatattgttaagatatttgatactctgttcaaaaatgcttcatcttctaaatttttttaagaacaacaatcccacttttcctttgtctgtccacctctgagtttagcacaatgtcttacttatggcatgtttctagatatccagttgattgatttttttaatgtactgataccaagatgttataaactataactttacaattctgttatcttcatcagtttatataaaccaaattcattataaaagaagagtagcaaatatctcaaaggaaataattgcttcactgtgggaggctaatgtgtgtgaaattgatcaggaattaaattttaatttgatacttttataataagagattttttttaaagatattaaagcctagagatgtactgggtaaactatttcaggagtaaaatgaaagcgtgtatacatttgccagaaaatgtattctcaggagcatgacgtgaagtaaagccttgaaattagtcatattccctttgtatttatttttttcacacagaatacaaaatataaatgtgcatgattaaaactaatttagttttattcttttcttcaggcttgggaatgcatttgacacgattaactccagggaaaaacaagagaataaattttttttgtaccttctacttgagatctcagatctctagtcagttctacacgattaaaacagagactgtccctttattgtgggagtctagtctgacttgctttgttaagtgaaatggcatctattgatgatcaaatcatgttgtctctgaagtattttatttgaaaactccaagcaataagattactgtttagaaaaccaaacagaaaaacataaactttagagtaactttatacgagacattacgtgtggacacggagaagtaaatttcacccccaccatacttccatcctgaccccagcacctttatcttgggttcacgtaagaccatacagcatacacatactacacttccagcacactttgttcagctatggttgacagaatagagctaacacattctccacttttaccacgtattctttataatgcaatattctatagggaaatgtgaaatctggatcacatgtagatctattggcaggtacgtttctaatctttttctctccaaaatctactgtatcctatttcatgcaggataatcagtgtcatcggcatacatagcaaatggtttgttcataaaaaagcttgatgagggaaataaacccttgatagtctctataggaattatttccattaggaaactgaaagaaaaagagggtgttctatatgtattgttttactgcccatagcagttttgtaatacacaataagtttattacatagaatagccaataggcatcaatattgaaaaatagagaatgtgagctgtattcctgtacatgcgtgcattctcagcaatgttgtgtggctgatcggtattgtgtgagtgcgtgggtgtgtgcaggagtacatgcatgctttttaaaaaatcctctaatctttgatgaagtaaaaaacgttaaaattcaataattctaattgagtgctataatgtctccatttgccacgtttgaatgatttagaatagaaaagattaaatcagtaagatgatatgacattagacaagtcagaattatagctcatctaaaacttgtattaagtgtttgatttctttcattcctcttctcaaacatttgcatattaactgttaagcaacaaaatacagcaattcctaccatttctaatttccttttgttctcttaataaaaccatgacaaataatgcaggcaagtaaggagaagaaatattcagtgaagaatcctcaaaatcggtggttctcagctaggagtgattttgacccccaggggatatttggcaatacctggagacattgttggttgtcacagctggagagtggggggtaggatgctactggcacacaatgaatagaggccaaaaatcctactgaatatcctgcaaagcacaggacaatacctacccacctgcacctcccaccaaacaaaggtttatttgtcaccaaatgtcaatagcatgcaggttgaccaccctgacctgaaggagctcctctgttgcactctggaagttgagtgccccagagggagaagcctagacctcccacccaccccactccacggacttccattttctcccatactgaataacaagttaacacgtttagacaagctgattcctgtagtcccttttaggtttgtttagagcttttctcctgttttatcattttgctctatgttgttatggtttcctgttttcctttcccaacatacatatttagaaaaattccagactcctttctttgatttcacttttgctttctttgtggaaattttgtatttcaaagcaatgaagagacgttgtcaattcctcttgggtatggtcagaataaagtataagataagagagttctcccggtacacactttatgtactattctaaggcatattttgttatttgttttctacagatgtcaagctctatttttctaaatatttgactctctagtacactgcatcactatgacttgttcctaccatttttatcattagtagatgcaaacataaattatgcaactttgtgtgagcttgacatgaggcagcagataattatcgcactggtcaacataacagattgccaatattaggttcaggtgttatgaaaatttaattatattacagcatgagaaaaaaattgagcggggaaaggagccttaactagcctgtgttagcctgcaaagtgtgttctaggggctcattctgcactttcttgttcttccgtctctctcctctgctcaccttctcagtctgccatgccctgctctgaagaggcacccatcatttgccccagcaagccacctagcctgtggagcagagtgacaaacagctccactttgcttagctctgggaggaggccatggtcctgacccaggggtccgtggggaccacaggctatgacctggacagtccctacaactataaaatgccaccaatggaggaagctcttgtgaaaacagacattcagatagctcttctgggtgttataaacgagtaactccttgttctggcttggatgcaaaacagattataaatgtatggctagtatcatacttgaagattatagaggaaatgttgctgttctactgtttaatttaggcaaggaaagtttgaagtaaaaaagaaaaagtgatccagttgcacagctcatttgtgaacagattttttatctaaatatagaagaagtttaaattttgaataacactgaagtgggttcaggaggtttggctttcatcggaaacaattaaaatgtatgccaagaatagaagatgagaaatcgtacctttttcttaaaaataaagagtttttgcttaaagtgctttagtgttttgcaattctgtcaacttattagctttactttctaaaaaataaattttcttatgatcaaggaaagagtacttctgctgggatcacatagaagcttaatttcttgttttcccacaattgatgattgtatgtgtattagtccattttcacactgctgtgaagaaatatcagagactgggtaattcataaagaaaagaggtttaattgactcacagttctacatgactggggaggcctcgggaaacttacaatcatggcagaagcgaaggggaagcaaacttggaacttttcacatggcagcagaagaaagagagtgagtagcgaaggggaaagacccccttataaaaccatcatatctcatgagaattcactcactatcaccagaacagcatgagggaaactgccccatgatccaataacctcccaccaggtctctccctagacacttgggaattatagggattacaattcaagatgagatttgggtggagatacaaccaaaccatatcagtatataaatctgctttgtggtgacctaatgcaaacagtttctttttaaaatcaaatgtacatcaactacttacacaaaaaacctctattatttaattcaataaatgattccttttcagcaaaaaaaacaaaaacaaagtgtgtcccttagagctctaagtgggagagagctgaaggcatgatagagcaaggagagtgagcactgaacacctttgtccttccacggctcagcatcctctgcgtggactgtggtcaggatgattttgcatcttctttcagtagtcagcttagaagttcctcctcctcatcatgtgttcctcctttctattaccagctcccaagtgggcctcttgttttgctactgataacacctgacatgctactgcctttctatagtagccgaacagaggagaacaatctttcttcctctacctttactaacttgctctttgatcgctacaaaaaaaagtacccagtatcctgtgagagtaataaatgagatgaaaaaattatataatgagagaaaaaaagtaacagtcctccatgactatcatctcatctctgtgattttattcatacgtgaatattgcaaacacacacacaccccacagagtctttcattttgggtacataatatattaagcactgagggtataaacagagtgccctcactgtatagataaatacataaaacattatagattagaaaaaagctataaagaaatcatgcaacattatatggtaaaaagtggtgggggccgggcgcggtggctcacgcctgtaatcccagcactttgggaggccgaggcgggcggatcatgaggtcaggagatcgagaccatcccggctaaaacggtgaaaccccgtctctactaaaaatacaaaaaaatagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagtggtgggtattcaatttagactcagacagaaaagataagaaaaagtcacgcttggataggaaaaacctaaaatacagaagtcctatgacttgtaaatgtgtccagaattggttccttccagtgggtttttggtctcgctgacttcgagaatgaagctgcggaccctcacagtgattgttacagttcttaaagatggcgtgtccagagtttgttccttctgatgttcagatgtgtccgaagtttcttccttcctgtgggttcgtggtctcactgacttcaggagtgaagccacagaccttcacagtgagtgttacagctgttaaaggtggcacatctggagttgtttattcctcctggagggttcatggtctcactgacttcgggagtgaagccgcaaacctttgcagtgagtgttacagctcttaaagctggtgcatccagagttgtttgttcctccaggtgggttcatggtctcactgacttcaggaatgaagccgcagacccttgtggtgggtgttacagctcataaaggtagcacagacacaaagagtgagcagcagcaagatttattgtgaagagcgaaagaacacatcttccacagcatggaaggggacgagcaagttgccgctgctggctggggtggctgctggctggggtggctagctcttattccgttatttgaccccgcacacatcctgctgattagtccattttacagagagctgattggtccattttatagagtgctgattggcccattttatggagtgctgattggtgcatttacaagcctttagctagacacagagtgctgattggtgcatttttacagagttctgattgatgcatttacaatcctttagctagacacagagtgctgattggtgtgtttttacagagcgctgattggtgtgtttacaatcctctagctagacacagaatgctgactggtgcatttacaatcttctagctagacagaaaagttccccaagtccccactcgacccaggaagtccagctggcttcacctctcataaacatatcactattcaatgaatacaaaaaagggcaaaaagaaagaaattagtttggagaggtaggtagaggccagattatggaaggtataataaactatggtaagaaattagaatgcaagcccactggaggatttcttttaagggaattgaatgatatgatttttaaaagatagctctatctactatgtggatagtggatagatagatggatggatagataggtagatagatctctatctactgtgtggatagtggataggtacatggatggatggatagatagatacatagatagaacagaaggttatacagattatggagtgggaggtgagaacagggaaaatgagataaggtggaaagcattgcataatccaggagtaagtaatcgtagttttatctatgatgatagccatgtatatgaagagaagttggaggatgtgagaaatagttaaaagatataactatcacaacttggcaataggtctatgcagagtgtgaaagaaaggtaggaatcaagactgaattgtaggttcctcactttatttataggtaacagtccctttagctgatatggaaaagaatgcaaagagtttggagagaatccagtcctgttgtggacgtgtcacgttttagatgtctgctacctatttaggaggacaaggcaagttgtcagttagggatgtgagtctggagctcagagaagagtcaaggcttatgttatcagcatgaggatggcattggtattggaagccatagattatttactaagtaagaacagataaacagagaagaggaaagaattccaagccaagcctccaggagcttcatctttcaaaatttggtaagaggaggaaaagccagcaaaaagacagagaatgggcaatcagataagaagaactcaaagagtactgaaaggaacaggagcacgtcttaagaacagtattgtaattttgttaaaagaaaaaatgtagagtagagtatagttcagaagtacaaagaagataatagaaaaaaaagtaataaacctaagcaggcaactacataataggaaattcacaacttagatcttgactaagtgcaaggcagaattgtaagtagtctaagaattattttccaacatctactgcttactaattttatggaaggcttagacaggaaagatactaatttcactagatagagaaaacctaggctaatgctctttgaaaactgaaaaatattgttatatacgtatgaattatgaatgttgatttattgtctactccttgttcaaccccttcctccccactccttatgagaaatctgctcaaaatggtgaaagtacaaaaaacagaacaagacgacaacagagtaggtaagtaatcacactgtataataaagaaaataaactggaactacttggaatgactattgaggggagatggaaggatcagacaaaaccccaaaagaaacccaaaggactataaagaaatagaatatcagccaagggatgtttttaatgaaaaccaagaaacagaaagctcagaactaacatcggctaaggggcagtctgtggcaactaagaggtgcttgatgtattttaattcacaaaattgtcccaacacattgtgaaatgcatatgatcaaccttttgtaaagagaaggccaaagcttaaaaggtcacacaaattctcatagttttatctgtgatgatagccatggatatgtgagagtatccaagttttacagaggccgagttggtacttgaaatgaatttggctttatttttaaactcctatactttctagtaccctaggctagtgaaaaacaatgaagtggcaaatgttccaaagccagggaaaatgttaagtaaacccaacgctaagagggaactggtgtaacgggaatgataaacatgagtataattactcttttgtaatgttaggctgtgaaaaaagtgagaaataggccgacaaaatgatagtaaagtcacatatatctagcatgcaaactattgaataaaacaaatagccaaatataactaaatataaactataatttttttcagctaatccctagaaataacttaaagatgacaatgcaaatattcacatcttgtttgggcaattcaggcaaaagtctaatttaatggccttaagtttagtgtttccattcttcactttcacctgtgtaaacataattgttttgtttctttgccaataattttatggaaagctttttctaaagggtaaaaacaaaactaaaaaaaaaatcatgtacacataaaacataatttttatttaacatgtatttggcagtctgttttgtttgcaaatccaaaaaaggatagttccttttagggatttttttaatgtgttactccaacatgttttcactgctcctgagcagttacaaacacagcacagagctgggaagagcagctgggtctatctttggctttcatgcactaatgtggaaatggaactgtctttgggaagccttccttgttaattgctaagattggatgtacttttgcatccaaattcattttccctgatctagttatggaaaaaaatgtgctatcttgtactttaccaatggaaaatggtggaaagcatcatgtcttctgcccccaaatgtgtattttgaatttgataattacagcaatgctgacatagccaatacccagcctaagcagtttatagcaaagacaatgactcatgtacataggggattaaatctgcttctggaaactacataattatctagtcgtattcaaaaatgttatagtcagaaaagcacctaatgattcattggttctgttctctgccttctgcttgcttaaataactaaaatatattgagtaataaattaggagcagtaggttgtggtggttaattacatagactctagaacctgaatgcctgggttcaaatctaccacatacttaaatgcctatgaattatacttaatctgtgtgtgccacaggcttttcctttgtaaaatggtataatggggataaaaatagtatctgaattcctaggctagctataagaattaagtgtgaaatgattaggagggtaagtggctcttacaagtattagacttcttgttgttattatgttattggtactgatcttggtagtacgaaaacaaaaaggacaataatcaatacctcaagtaatgtgtttacagtatagttgaggagataactgcataaaggaacatttagcttatcatatgtgtttaaaaacattattagatttgatggtaaaataaccagtttagaatgccttcttattagacaaatatatactgtaaacattgtgtttaaattatgcttaaagtcataaaaaattagaattaaaagaaatcttacagatcagagtattcactgtattatttaaaatggggaaattgaggctcagatgttcagagaacagcccaggattacacggctatgcactgacatgacccaaagcatagtaagtctgatgttcattcctgagctttttccattggttcatgctggctttacaaactgagaacaaggaggtcagtgtggatcagagtagagctctggagtacttttacaattcagctgggtgagggaggaaaggcatttaggaagaaaatcataaagataggtatgctaccgtctcctctgttaaaaaaaaaattaggacatcatttgagggaagcagagacttttcatggagaatgagtggttacataagtttctacactcatgtaacaaatatttactaaacattttctctatagtaagcctactgtgttctgggcatataatataaattggggaacaaaaagctttctgaactatagagagcttaaactgttgtagaagtagcaaacatagcttataattgttatatataaataaagtatatagaaatgatatagaatgttagaagatgacaagtgaaaataccgtgaaaaagaaaggaggagaataagagggatttggagtgtaggtggagagggccctcaacagtgcaaaacacatcagcataaaccttataacaaaggtgataaacccatttcaaacagatgagggagttagttaagtagatatctgggggaaaaacattccaggcagagagaaaagccaaagctaaggcccaaggataggagcctgacttaagtgtttgaagtacagtaaagagtaaatgtttcctgaacaaaagtgaatgacgagagagtagtaacagaagaaacataatgcagtgaacagcgcatgtaaggctgagcacacaaaagtccaccttgaaaacgctgactttcactcttcatgaaactggaagcaactaaagttttgagcatagaagtgacataatctgtttcacattgtaaaaggtcattctgactctgtgctaaaaggtagattttcaaatccagtaatagaaacagagagttgctaaatccatttgagagctgattgtgtggtagtagaagaagagttgaagtgctgagaagtggttggatttggagtataagttgaaggcaatttcctgatggactggatatactgtctaggagctgtcaaggattgctctttcaagaaagtcaaggattgctcttccaagaaagtgcagtgtgaggaggtaaagaaattacatcaaggagaagatctgatactattaagatgcccgccctccccccacaaaaaaaaagaagaataattacccactagatgtaataacattcataatggcattgataagataaaacagtttctatgcattggtaaaggtgaaacctggataaagtggttttaattgaaaacgagaataagcaagatcagagtaattagagacagagtacaaccatctcatgtgagacgttgggcataaaagaaatgagtagcaggatgggaaatttaggatgattatttttcagttaaagagagtgtatgtttgacaatggaatgatccaataggttatacaaaattatggagtgcttttaatcttttctgaattgagtactgtttaaaggaagtatggatttttacctcaaatttaaaaacattttaaacttacttgtttatcataaacaattgtagacactgatagataatacttgctgacttttaaatcatcttccattttatatattaattttgtgcactctagtctctaaaaaatgacagtctgtcctatttctcaggaaaggcatggcagctgtcattaccacttctcacaaattgaaatgaaatgcacatagcacaccaaaatggagagttctgttttaaactgccaccccctaaaagatactgaactgaaatcagcaacttctaaaactatccttgtctccaagaaggtttcaaactactaatcattgaatgtttaaaatacttgaagtacaggtaaatatttctctgatatagtttctgatagaaaaaaaaaagaaacaaaaacatatagttagattatgtcttcgattcattatatattgttgtaattaataaggggcaagtcaggaaagtggaaatcacccagttatttcaacagagataatttaatagagagaaatggctaaaaagacatcggcagactgaaaaggctcaagaggaacactggagcaccacagctgtgaaggtctgaatgtttctccccaccactcccgctccctgccaaaagtcatgttgaaatcctaaccgcggaggtgagagtatttggagataagactttgcaaggtgattaggtatggaggacaaaaccctcatgagtgatgttagtgcccttataaaagagagctcagagagatcccttgagccttctgccatgtgaggacacagtgagaagacaggcatcaacgaggaagtggtccctcaccagacactgaacctgccagtgccttgatctggacttctcaaccttcctaactgtgagaaataagtatctgttgtttataagccacccactctatgctatcttgttatagtagcccaaacaaaccaagacagcaggtagcatagttactgaaggaacaaaggggaagagtttgaactattagaacatagacatttggaggaggccccctagagaaccggtacccagacttctgcatagctgatatgaatgttggcagggatgtaattaacagagtgcactatttacaattaaagatttaatgcccaatataaatggaagacgagccattggtaaagaatattcatagagacaatattgtacacaattaagcataatatatgacatgtattgtattttaccatgaataacatgttaatgcttctattggtgtattctacaatttgtatgggtgatagcacatagtatgtactatgtaaaactaagcctatgtagtagtagtatatatattagtggggaaaggtgcccctgagaagttgatgttgcccagcttgtgctaataccctaagaaattggaagagggaccctgaggagcttagatcagacctctgagtacaggtgcctgccatgtgtgctaatatatctcagagtgtgggaaaaatctggaaatggtaaccaaatgctactgataccatttagtaggtgcatggattaaaggaccatttttgtggcaacactggaaagaataggaaatgcaacaggaacaagtccctactttttcctcacgccttacagtcttcctccagtacttgtatcatagagtgtaatgcagagccagctggtaaaggagaaaggtagatttcggagcctcatacccagcatcacaaagcaaaatataagagaagtgatgaactgagagacaatggtttgttattcaactaaaattgtcatatatgtgtttggtccattgataggttaaaactctgttgaattgccacttttggtattacacaaattgatgacccaaaaaagattttaggatcatttgtgtgaattcagcacctaccgtatatgtgggaaatgtactgaataaacacagaaagatatgctttgttctcattctgacatttaaataaacctcacaaaggctttcctttgtttgccagagaaaaatcaatgcaaaattgtcaaatatattacaatggtctttgcccttctcttaggaattctcacctgacttctcttgcttttgctgcattgcataaaccctgcatatgcacactgtgccttaaaccattcaatgtgctgtcattgatgtcatctcatctgagtcttaaaagaattttgagaggcaatgagaaaaggtacagctcttctaagagggcaaacaaggatatgtcaaggactgtcaaggatatggtagagaagattttttatttgggacagatgacctttacagttcttccccaacattgagctttaataactggactgaccatgggtatgtcctcatcatattctgtaccaaaaatgaaagtaattatggcatcttcctagaggagattgttacttttaccttcacactagtatggttgcaagcatatgtcacctttgatatcacacaactctggtaccctatatagagaatcacaagaaaagaaaatacttgtgcttgtttacccccatatccacatttctgcttcattaaaaatccagaaaggtcagaaagcctaaactcacctggcttcactctccatttgtctccaggcatggctttttgatgccctgacagtagcccaagaaaacagaatattttcaagaaactcagcaggagtgaccttcagttgttgcctcattggcatatatttcttggtaaccagggaaagctctccatgacaccctccaggtccccaaaatatactgaatgcatgatgccagaaacattcacattagagcactatttctttctatggtgataatgggggttttgacctctgttgacatgcaaatatttctgaaagaagttccacatcttcttccctgagatccaattttgatgtgaatattgtataagaagtgatcaggaggaagaggctacttaaaagagaggcaaataagatagcctgaatggaaacaaatataactgtttttgcaaaggccagtgcctgcccataaatgtactttttcagaacaattgtcaagtttcttttcatccaccagggttgaggtgcttcctcaaagacactcttgtgtagtcaaggctcacctttatttcccttattgaactctgctcgtttcctttaacatctattttaatactgtgcaatggtattatatttttctgtgtttcctttttaactctagcactaatataaactttttgaaaattaggcttccacatccctcatttgtcattgttttgcaagatcctagcccagtgcctggcacagatatatgtgcttaatgcacttggctagatggatgaacaaatgaatgaataaatggtatgaataagtttcatatgctttttagtccacccagattccaatgtaccatatttatcagaaatgatataataaattattaaactttaattcaaaggtttatattcttattgatgtttttattatcagtaattcaattagtaggacatagtgggatattttattgatttttaagggatttaataatttcacattaaatcagcaataacaaaaacaatttatatgcttttcatgtccttaagaagtaataaaaacactcagctaaatgacaatttaataaggtgaagtttcatttgcaaatctctcgtttctttgagttcactctgacattgtcttctgtttccctgtttccccagtgacttcttatctttagtttaaaatggaaaagtgattaaacatgtcaaaacaaataactctacattttaggttttcaagtaaattaaaatttcatggacctcttaaaaacagacatatggaaatatctaataataactacatgaactgctaatggagtaagtttccaccaagcttaaaaaacacctttaatgtttttataaagccattttgaatgatagctgaaaaaaattaagttcaactcattcctaataatgctatttatgataatagttcttcagtgactttattctgcaccatggattacatgcacaaaaggaacacatatcgactgtatttgtgaaaaggaactacttttttcacactgctaagttaaatcccatcttattcagctgacctgcgattcagcacaattaacctgttcattagttgcaagtaaaatgggacatcaagtgatggtttaatgcaagcattaccacatctgaaaaataaatgtaggtgtttgtgtctcagagtgatttttcttcaatatcaaaaagcactggaaacgcctaaatctaaagcaaaacctgaatgatggagttttctgtctctatcattttcccttcctatatgtgccagaatgaattacgttcttgttgagcaactactagaggccatgcaccaagcaatacacttagaagataaggagaggaataaaacaggctccctgagcagaaagaatttattctctaaaggagaaaacagatctcaaacaaaaaattacaatacagtgtaataaaatccataaaactgatgtataaaagttgttttatgtataaaggaaagagtaacttgcttccctgaggattcagtggttatttgacagaggaagtaacatttgatctgagacataagggaaaggtcagggttcttgatttgggcaagaggatgagtcagtctaaacaggcaaagggaacagcattgacaaggtatgaaactgcacaacatcttcgggcaattttagaggtttctgaagcatgtgggccataaggaaaaagagcagaaagggcttacatgaattcaaattgggaagtcatgtgtatcttttaggggattcagattttattctatcgagatctattagaagtatataggtaagagaatcatatgatcgaatttgcatttcagaaatacgattattctggcattcttaacttttatgtttttaatttttaaaagataatatgcattattaacatatctacacctgagattagagttgaactaaaataaaattaggtgaatcatgtatttggaaagtcagatatacctatttatctttgatgttcagatattgtttgatttggatgcaatcttttaagaaataactttttaaaacatataaccaactctattcatttttaaacacagattaaatgcatcagtcttcatattaatattttaaatatgcggaacaaggtaaagtagtctcatctcgttttagtcaaccatatgttctgaaggccagaatcactgcatggtctacaaataatttttccatacttatgaattctcttatgtaatatgacttacccaggtgtacaaataaattccaattaatgatgtatctaatagactgtcatcattttgagtcatctaaccctatggtcacgcctaccaactcacaatatgtgaggagggcatatcactgcctccgaaactgataaatcttcaaataaagtgcagaaaccttaattaagaaattggtatatctattacttctctatgaatcatacttttttatatgatatgaatcaaagtttttttttggtacaaaagttgcaaaacagaagtgacataaattatccaatggttttggttacctggttgagaaaatataattggtaagaacctagaaacataaaaggtttgcttggataagtttaatattatttttaactatgcagccactgaaccactgtgactgacaaattggtttgtcaatatcacaagcaattgcaaagcgagatagctgttttcttaaatgctatcataaaactaggaagtgtttccaggataatttcagttgatgtaaaaataaatattcaatatacagaaccatacgtgatgttagtggatgcttatcaattattatatccaggccatttatttcatttatgttcatattctcaggaaccaaatttgtttatcaaattatggaaatatggaataaaatgccccagttaacctctggctcagaggataataatgttgctgggagtttataattgcagaagttttatccagattacaaaccagattgctaggtgcctctgtcactgtcaagattttattttttattattataggtttattttaattacaaccccctccttttattaattaagcatatgtttattaaacactagcagctttattgcatacaatatgcccattataggaaatttagatatttcaaaccctaatagagttcagcatttaataaacaagatataaaattgtaatatgatgtgttaagtactgtctgcatatgtatgcatttagaggcaactaaatcttaaaggggagattgtttacttatttttattgttgttgaggatgtaatatttaagctaaaatatgcagaggcataaaggaattaaagatgaaaagtaatgccatcaatagacacagaatgctcaaatgcacagagataatttcatactcagaagcctaagagaagaaagaagcaatgaatctgctgagtaactagagaggctgatcctaaagactttttcttgcttactaaataaatttggattatttcctaaaagtactgggaaactattgaaatattttggaaataacttagatttttagctgcgacattagacatggccagaaagggacattcaagagacagtgaacaggtaagtgtgaaagaacgtagtgaccagttgcaaggggtgggtaagcaagtaaagaggagataatgaggtctccctagtttaagacttgggtaacttggtaagtgatgttgatgataatattagagatacaaagtatagaaaaagaaatctctatggggatgatgaattctgcttaagacatgcaatatatgaagtaccagttgcatagcgcaactcagatttgctataaccataatttggagaatgtgggataaggataagtgagcctcctcctgtgaggctgttttatatcctgggtactgttgttcagctggcctatcttttgagcacatatgtgtatattaacatatagatatgtttatgtgtaattaaggaatatgtatctgtttataactatatacttggagccaagtatactggctggcactcagcaggaactcaataccaatatgctgaatgtatgtggggatccacccagtggttttccctaagaaggattttgctgactgtcttggtacaagttctcttgctttgattccaacttaaaagaaaagagctgactcatcattcagtattctctctctcatagggtacgctggcatcttcactgaagtatctgctaatctctttactagaacctctgttcacagtttgaagaggttaattttgcttcactcaaaattgaaatattttcctgtgaatctatccattctagcatgtcctttcttacctgtgatggtatagattttatcccaggagaaccttacaagtttatgtgatgagcattcattccaggaactctaatgctgtttccatttttatgaccaatatgctttgacctcctttctgttccagaacaaaaggagagcacagaaagggtggatattttatcataatacttcttcaaggccttgaaattgcatattgcctcctatatgctaccaaggcctatgctatgaatggaatctttactcttaaacagatcaacaacaaaaaccatacccagtgtcttgtacccttaaggcaaaaggcatcctgggcaatccctcaactcactttttgcacactcacaaatattctatctctcagtactaaagatttatcaatattcaactctgggacatgtgggaacacccatttatagatggtctactaaatggtccaccagtattcttatttagcttagtgtttatgtgactccatatatcactgcttaaaatttaatctttaggttatctgcagagcacatttagtaaaagaaaaatagcaatttgtcttttaactattattatgaataatgttgtacagtacaaaattaaaaaaagactgttttcataagctaatagttgttcttccctctgatctgttaataattagtcaatccatcattaatggcaaaggcaattcagcattcctccatgtgttgcacatgggtgtagacaggtattaacttagaaattgaaaatgtcttctgtggatctaattatgctgaaaatatttgtttataatagtccttttacacagtatttactgcccactttattttctttgttcccacccagaaatcaaaccacagaatttaggttggatagcatgttaggtttgggagctgttgtagtagttaaccagcaccctcaaagcattactcagtttcagcacatctagaagcataagcatcggtaattttggctaatgtatgtcagctgaactaagtaagcataaaaacatgtctgacatttaggaaaagaagagccacccactctcttacttaagtatatatattaataatgtttctcagcaatcatgttacacatgcacagtgacttctagcaatggagctttgcttctcgctcttgggttttcacgtcggctggggttgtgttcatgtctgctccatgtgcacttcatcctggaccagcagcttctccaggagtgctcttctcgtggcgatgataaacatgcagtgccctaggccaaatctcacaagtgtgagcctctgtcatgaaaactaggaaagggtgaaggaaagccagggaaatgaaattcaggctgtagaagcatcacatcccaggctgttatatctgcaagaacacagaaagttaaggagagtctcagtgtagttgatggtggcaagaaccagaagacagaggacaatgagtctcatgtcagaaaactcagaaaggaatggatggctaggctgtgcataaaagaagaacaacaacaatatcttaactgttatctccttaaaaggtctgaaaaattggaaaccagtctattaaacagaaataaataataacacagcaccaattactagtaacttaaaagatgtggcatatctttttagtatgctatttttaattgtttcagtgaatttaaaatatttataactactttaatgagttttattattcttttcttcaagttacttacccaatttctccttctaaatggttccttaatctcctatctcctatggtttgggaacaactacaaccttaggaaatcctctttattattctgacataaaattctttaggtcttattttgccatgcaatttttatatggctatcttattattccaattaaaatttaactttaagtcaggcaatgtgtgacatcctctatggtatctagaagagagctcacaagttaggtgtgaagaaatttctataaataagtatgtaccatatcaatgaaattcatgagttctgggatttgtaaattggacatctcaaatggaagaacagagtagatggctcacacccccttttcccattttctacattttctgtttttgaacaaaatcatcttagtttttcccagcatcagacattcacttgtataagattgaatttacaaaaaaatgagattcattcgaaaactcaggataaagcaaaattcaaggagaaaatgaaaatctgttctaccataaatccctccacaactagagagatacatattgacttttttggtagcagagacttacgtgacaggtgtttatgcctgaactgttccacagataaatggaagactttattctcaagtgatcctggcatactcatgtggaaaaagcaaaaacataattgaaagaacgttatttcattctcctattttggtaagttaagaaacaaagggaactgtttgtaactatttcttatattttgaaagccaggtgtgacagttgacattatttactaggactgagtttataaagcagacccaatagaggctgcttattcattgtgagacatcatgcctgcagctgcctccaggtaaatggtgacttgtcttacaatgcataaaccaagtagttaggctctgcgccaagcaggacttgaaaagacttatagaaagcacatggttcccattcagatgtgcttttattttttaaaaagtactaaaataattattgcatttattctttttatgttttatttttaattgacacataacaattgtacatatttatggagtacactgtgaaccataagagatagttaacataaggaggaatacatttaaataaatgcaatatttaggtctcatggatttttagaattgtaagcgaaatttaaggttgcttaggtaacactcttcattttaaatattagactgtggaagtcaagagggattaagaggttagtttttctcagtttaaactttattcccttccccttgttgcagattctaaatatgcgcttttcaaattgaggggcgaccacatcaactggctacaattgtcccctctgtgatttttgttgtgttttaatgctccaggctggatctcttctgctactttaaagatttcaaatgagacccaatgcttgagaagaaaatttgatgttttagaaatcattttcatttcttttgatgggaaaataatttctttatacacttaatttcattacctgaaacacttgtcaaagaatgactgaatcttataagacaattacttgacttagttgtttcaaggaaatctattgagttggaatatcaatctacatattatttgaaagcttgaacaagagatcctgatatagatccctatttaaaaagtactggttaagtccaacatccttttatcaaaacagtgggatttaaaatccaaagtattttttgatttttttttctttatggccattcttgcaggagtaagggggtattgcattgtggttttgatttgtacttccctgatcattagtgacattgagcattttttcacatatttgttggccatttgtatattttcttttgagaattgtctcttcatgtccttattctactttttgatgggattgttggtttttttttctggctaatttgtttgacttccttgtaaagtctggatattagtcctttgtcagatgtatagattgtgaagattttctcccagtctgtgggttgtctgtttactctgctgactgttccctttgctgtgcagataagtcccatctatttatctttgtttctgttgcatttgcttttgggttcttggccatgaaatctgtgcctaagccaatgtctggaagggtttttctgatgttatcttatagaatttttatagttgcaggttttagatttaagtccttgatccatcttggatcgatttttgtataaggttcagtttcattcttctgtatgtggcttgccagttatccagcaccatttgttgaatagggtgtcctttcccaacttgatgtttttgtttgctttgttgaagatcagttggctttaagcatttgggtttatttctgagttctctgttttgttccactggtctgcatgcctattttataccagtaccatgctgtttaaaaaaatccaaaaataatagatgttgacatggatgtggtgaaaagggaacgcttctacactgctggtgggaatgtaaactagtacaaccactatggaaaacagtgtggagattctttaaagaactaaaagtagaactaccctttgatccagcagtcctactactgggtatctacccagaggaaaagaagtcattacatgaaaaagatacttggacacaaaagtttatagcaacaaaattcacagttgcaaaaatatggaaccagcccaaatgaccatcaatcaatgagtgtgtaaagaaattatgagatagatagatagatagataggtatggaatatacactcaaccatgaaaaggaattaattaatggcactcacagctatctgaatggaactggagactattattctaagtgaagtatacaaggaatggaaaaccaaacatcatatgttctcactcataagttggagctaagctatgaggatacaaaggcataagaatgatacaatggactttggggactccggaggaaggatgggaggcgggtgagggatcaaagactacaaattgagttcagtgtataccgctcgggtgatgggtgcaccaaaatctcacaaatcaccacgaaagaacttactcatgtaccaaataccagctgttccccaaaaacctgtggaaataaaaaatgttaagtttcttgtgcgtccgtgtgaagagaccaccaaacaggctttgtgtgagcaataaagctgtttatttcacctgggtgcaggcgggctgagtctgaaaagagagttagtgaagggagataggggtggggccattttataggatttgggtaggtaaaggaaaattacagtcaaaggggggtttctctggtgggcagagtgggggtcacaaggtactcagtaggggagcttttgagccaggatgagccagaagtaggaatttcacaagacaatgtcatcaattaagacaggaacggccatctggatgtgtacatgcaggtcacaggggatatgatggcttagcttgggctcagaggcctgacattaagataataaaataaaacaaaatctgaaagtaaaattgtttgcccagtttttaaacaaacccagtagtagttttgttatatctagaattaccccatcactgtaaggctgctttgtttttttaatctcttttcctctgaacaaccctgacaaaaatcggatggaaactgacattttcctttctcaaccatgctcatccatgcagctttgacatctacatgaatggttaatatcattgattcttgttattcctgtatctattatgctctcacatgcaaggatcttcatgttctttgccaggattcccagaaagatgctccctttaatattaactggtcaattttgataatggagttgatttttctttaacgtttataatcactgtaaacttcttgacaagatggtgctattataacactgactgtttctgccgaaagaagaatgttcagtactaagacatttctgccaaacgttactacaactttgaaaagcccttcctctggcttgctaggaagctcattggagaccctaacttggagtttgttgccatgcctgcccctgccccactggaggttgccatggacccagctttgacagagcattataagcatgacttagaggttcttcagacaactgctctcccagatgacgatgatgacctgtgagaatgaagctggagcccagcatcagaagtctagttttatatgcagctgtcctgtgatatcagcggagcagggtatgggccaccttattattatctagctaggtggggcatgtggttcatctgtgggatgctgaaggagatgagtgggcttcggagtgaatgtggcagtttgaaaaataccttcattgtttggacctgcatattgagctgttttggaatgcagttgattccttcttgagtttcaaatgtaagactgctgcaatcacattagtgaattcaggggtgagatcttgttactgccatttctactccttttcatttagaatcagaataaagttgtatttcaaatatctttttaaaaatatatttacattatatgtgtatatatacatatatgtatatagtatatgtataaatttacatgcatatatatacatatatgtatatgtgtgtttacatatgtatatataaaatgtatataaacatatatatatttatacatatatatgacacatatatgtataaatatatctatgacattagacataatgtatttctatatctaatgtcatgcatatatttatacatataatagatatataaatacatatatattaatgtctacatttgacattacatatgcatgtcacttgaaaatttgtgtatataaaatatatgtataaaactcaattcaaagatatgtttccagtgatgggtcttgtcaatgtagacatttaaaatgatatttgggaattactgatgttattttaagagcttggtatgtcagagattttcaaatggaagcagttgctatagtaaatatggattttctcctaattaattcagacattaaaaagttactaattgcctacttttttcctaaattgcttctggaatataaatatttataatcttcataatattcccatctgataaaggttaggtttgatttcactttctttctaaaacatctgagcattttcaggctctaactccaaaagaacaaaactcgtgaagatttaaaatattttaatagattatattggaattccatttccattatattgaagttactttttccattgctatcatattaggaaaattaaatttatacatgttctatacttaaagttaagttttagaagtatcttttccctaattgttattgagaaattaattttaatacacttttcatctttccaacagactactgcaaacaaataataagctagaagtttagtttattccctttcctaaagctcttctataaatattgactccagcaatggaaaaagcaaaagtatagtcagcattctgtatcatatatgacatatagaatatagaataggctataccatcaataagataaatcagtgcctttataagaccaaatgagtatatcaatctcagattaaacaatgcaaagcacttcgttcaagtggcattttcaccctttcaaataactccactaaatatataatactcatgaacactaataaaataaaaatatatgtgttactcttctgtatatatctgtaaattgggctccaaacactacattttccatttatctatacgactctaatgaaagcatcttggcttaagaaaactaatagatctgaggtggtaaagtctttattattgaatcacagaactttgcctaaatgcgaagttctagcttcaagttaaaaaaatttataaatatttcaacatttaatttagatacagcaggtacaagcacaggtttgttaaatggaaatattgcatgatgctgaggattgcagtatggatcctgtcacctaggtagtgagcattgtacccaataggtagtttttcaatcaacgccctccctctttcccctctctagtactctgcagtgtctactgttcccatgtttatatgttcatgtgtgtccaatgtttagctcttacttataagtgagaacacgcggtatttggttttcttttcctgtgttaattttcttaggataatggcctccagctccatccatatttctgtaaaggacacaatttcattaaggaaggagggaaggaaggaaggaaggaaagaaggaagggagggagggagggagggaaatctagaggaatggataaattcttggaagcccacaatctgccaagactgaaccaggaagaaattcaaaccctggatagaccaatatcaacttctaaaactgaatcagtaataaagtttgggtctttcttaaaatttctattttgcctttcagctcttaaatgatattactggattgcttggtttccttgaattgaatttcaacgtttccctggatcttgatgtgctttcttgctctccagattctgaatttcatctgtctgtcattttattaatagttatttaagattgcttaagaaccattgctgaggaggtagtgggctcgtttgggggtaaggaggcactctggcttcttgaatttccagagttcctgtgctgattctttctcatcttggtgggtctctggtcctttaactgtggcagaaattgagtatagtcagttgacttcatttctggacattttcagaaggccacacaagactctgtgcaggggtttttgtttgctgttgaattcttgtccttggcttccaaggcgggtgaatggttttgtggtggtgtagtttggggtgcaatccgtagatggtgctttagagctatgggtggtagatggatactcagcgctggggactgtgtatcctcgcgtgtgcagctgtgctctgaagtgtgagggggagaggggtaaccccctcaccagttccactaataggccttcggaagccactgctgatcaccggcactgtgccgtggctttgtttgtttgtttgtttgtttgatgtttctggctgtgggcttccctggggcaggtgttgggcagggggatagaccacgcccttactgggccagctctgtggaaggaggcattccaggtgccacaccagcctgtgaacctgtgcatctcacccttctgagtgtgggctcctctcctactcaagttccgagcacaggtaccagctcagcactcctgagccataggatccaaccctgcagtgccagaacctgctcacggctccctcctctggactgggttgggttgggttctgggtgtgctggggatctaaggggccgcaggctgccagaacacactccagtggaacacagcacccaggctgggcagcagacgcttcactgtgcatgtgctgctgcggggcagccaggcaggagccctgggaggggctgacaggcaggcggggctgcgggacagatgtgcctcagtgccgtggggaagctcgccctgctttctcccagtccaggagttttctggggccagggcctctcagagggagatggagagccctgagagacgggtgcctatagctgggctctgtcagatctgttccacacacaaatgtccccagctccatgtctgctgaatccccgcctctatcaaatctcccaggagatgcccctgccagctcaaacatccattggggttttggggttccctgcagctaggatcccagaagtctgcatgagcgtgggctgtcccccaggctcttcactcaccccttcctcaggagccatttgaggcccggaatcagctttagcattcaggcacctcccacagggcttccagcctcctcttgcttcagccttagcatctgcgtgttttcttcatccacattcggtattttctctctgaagatctttttaaattacagtggtttagaggtggtagcggcccttcctggctgcctctagttggccatcttaaaactcctctcctgaaaagaaaatgttatggaaacatgaggagaacaaatgcctgcaaggaaatcaaaacagtgctgtgacaccattcagtgtcagctacacaaaagaccaaaaagtgaagctacctgtaatagactagaatctgttggttaaccaaatggtacagaggtcagtttacttactcctaactggtaaattcagtttataggtacagtgtttcagtgggacttaaatcatgtagttggttcagctttgttatgaggatcgtgaaatacctctgtaataatttcatttctgccttctccaaatatacatgtggtatatgtcatgtaaattaccttatatatttaagaaaccaaataagaagtttcgagcttggaataattcatgtgagctaactagtttctgattaaaatagcatcaggaaactgagtcaggcattttttttttcatttgccattccctgtaaattgggtattacatcgtgatcatgaaacttaccagtgaaatatgttctatgaaaaaaacgagaatacctgcaattaaataactcaaaatgccattcatttaaaacacatttattatatgcccagaattttcaagatactatgcaagacactgtcgggaatacagagatgattaacatgatgtttctgccctctctggatatgatcttcactaatactggttcattgtaatttccacttttattacctttcttaatgatgatattctcagtcggtgattttgaagataagcagatttctcgatgactatttaatgcataccaataatagctttatttttgttatgtctgggtaaagaaacaaaggtttatttcttttccttgacatttatagcatcctatgtatctgtgttccatgaaaggttacctaaatcacatttattccaaatgggcaatatttaactttaaaaatgtcaaaggaagggtacaattctctgtagggcaatattgaattggttgactgaatgataattatggaataatgcattatgcattctcttttcatttcaaatattgattaatattattgattctaaaactcatttaatctgttattcagtagaatcattgccatatactcacttaccttttaattttgatgttgataattaattgaatcaaatattttttcagagtcatttgtaacttcatggttataatttctcaattcatgttaatgtaagctttgtaagatatgccattgttcaggtaattatgtataattaggcacaaagagaaaatagttacctacctttaaaaaaaagccatcaagatttttcagttgaaaaattgagctaaaaacagaattagaaagatttcttggagctaaactcaaggatctaaaatgaaggatgagctcaggacattttgtaatttaatattggactcatatgcacgagttccttgcaggagctactcccactcctagtcttgactacaagggcaggtgagataatatctgcattgtttggtatatttaaaccctgcttctttaagtgttatcatttaccacaaaatatcgtaatataactgtcacagaaagacaaatcaagaagaaaggaaagaagaaagaatacatattgattgtcagcattaacacacaggctataatttgatgtaatattcaactctatactttatggcaaccaagatacacaagaaaacacaacatttacatagatcttctcaaaaagaaagaaccatacctgaagaaataaatgtgtcttgatggtattaaagtctgcactttctcacttgagtcctaaaacagggaaatgagcattattcccaacaactataataacatatttaaaaatggatttcttaaatctgatgacaaatgtttagaactaccatttacataagccaagtcctactttttttttttaacaaatcctttctcctgtctcctccagatgccattgccattttaaatttcctgactgacaatctcccaacttcccaaaaagtgtttatgaagtacctaagaaacaatttgaaacttataatgagatccagaactagtactgactttgaatccattgtatggagggaatgttattacctataaagcagatgagattagatttataaaaacaaatggggatcatcaggatgttgctaccagaaagagacccagctggcatagacacctgttagtaaaaggaaaaacattttgtgtatttcgtctactgacccccacttcagaaatgctcgatctgtataaaccgtacaactagacaggcattcacctggtggatgctgatattctgaagtagccagagtgatttctccaccctaaataaaactttcttccgaatttcattcagagatgacaaaaatgaggaagtgaagtgggatggggacatcacaagtgggacattgcatcccgggaagcaaggggactctgcacacgttgctgctaactgcagcggcacctgaggtggttctgaccgctgtaaactctgtcacagaattggggagtgagtatacatggagaaaatttgttttgagtacaatttcataaccagaaaatgatacagaatcatgtaaaacaccctataattcaagggcatcaatagcaagcatagggaactgattatgcctaaaacagaggcaggtcctctatattcctccctctgaatcatgtatgtcctcaaaaatgtcccatcagcacaaaaaaaccagcaaaccacagtccatcctgatagcctcctttttcatattaatagcagcattatactgtagtttttctgtctcaaaaactgaattttttaaaactttcattttcttccctatatctgattacttgtcacctccctcccaaactcccttacatatgtaattgtcttttcccatggtcaccatatccaagttctgattaccttttaataaaatgaatgaattagcttcaacaatgcaatttcttatccaggtatccattctttcaatccttcctaattttgacatacctgtagtagtttcaaagcacagatcacatcgtgacactcctgcttatcattttcaatactactccattgcaaatattaagaaagcaaaactgagagccagacaacacccaacagatattgtctctcaatccttacattcccatgaagaaaggatatatgtaataagagagaaaggaaccgtgacttagaaactctataaaatataatccacatagattatacatatgcttatggtgatattactatactgactttacggtgctttctagaatttagactctgggccattttggcaaaataaggagcctgcagactgcttatgcctttgaagagaaaaaagaatgtgaaagatgttatttttgtgatacatcaagagagaatatgataattaatattgtatttttattcatgatggaaataaaaataggcaaacactatatatgctgtaaacctttggagtactcctttgtcgcactgggaacatggtaaaatatataattttttcatagatagatcgcactataagagacaataataatggaaactgtcatagttccctgaaattcaagttgaaatactatttacatcaaccataccgccgactccatcataatgaggaaacatctcagggattattaatggggtaaatttcactatatagagaaaaaagacagataaaaacatgtatatgcccaaacttcatttgaaaggagggcatgtagggaaaggtagattaacagctgaacttcattagccatttacagaaaagttaaatattatatctaggatacatttgtcttaaatcacccaggattaaatcttccaagattaaggatttcatctaatcaatttcacctaattgaaatatgcagcccttctgctctttttttgtaactcctatattccctcctatcctttaaattatttttcatttaaaccattcagcagtttaaaccattctagactactctggcctgaagtacttcatcagaaatctttacactttagcttaaatattcatttaataatgaacaattcatcttctattaaatgctactactcaatttttgtttcaaactatatgtacatttcttgttaggcataattttatatatttattaattggtttcccttccaagacacagaacctgcccttccctcccagtgaaaccactatgaggtgaaaaatagtgttgaagaaggaagagggacacagagaaagaaataacttcacacatctatttaaagatggccctgaggtccacccacagcatcgcagggatgagttcatgagggagtatgcagccacaatacctcttaactccccatgacttccttgagcttccttgtgtgggagtagaaggttgatggaatggttagcctttcctggtatctgtgttcatcatggttctcagcagatccagctgcataaaatgtctctatctgttaggatcaataaaacaagctctctaactgctctataatcagcatcaatttgcgaacctttatcaaacttcccccctcttttcaccaagtattcaggatgacatgatgaacaactggaccaatgattggtcaaacatatcctaatatcaaatactggcagttacctggagtaaagaaggacattttgtgtgtccctactttaaacgagatccttaaagctttttgtatggctggtctgagtatttaacagaagtcccgtactcataaggatggctagacctgaaaggagcctctcacctgcagggtaatgattcggtttaatgaggaccttttggaagttacttggctctaaggccagaaagcctaactgagatcaagacataattgaataggaattgaagatccatttacctcatcagttggaaaataagcatttttcaaaatagagagataattaaatgtggtcccttcagtgctacggattaagttagtattatagttttaatatacatttcaaacagtttccctcttattctgtcataggacattgcaattaatttaatcaacctttaaacagacatttaccaagaatttatgataatttagatattgtgcagatggatgttcaatgactttttcttcttaagtcaaaatatttaaattcttcaaaatagaaaatgtgtaatatgtgctgcatattatatgcctttttcctctttcccagaatgccttttactagttttgtgaaataaacaagatagattatatcttatatacatatgtataatatacttacatacacacgtataatataatatttataatataatagaattatattctgtattttatataatatataatagaattatatattatatataatagaattatatattatatataatagaattataattataatatataattataattatatagaattatatataattataattatatattataatatataatagatatagaataattataatatataattatatattataatatataatagatattatagaataattataatatataattatatattataataattataatatataattttaataatataatatataatagaattataattctaaatataattataattctatatataaaattatagatataattctatatctataattatatataattctatatagaattatataatatataatagaattatattctgtataatacatacacacgtataatataatagaatcatattctgtcatcttttcacttcagtctatctctttctgtgtcattttactcctttacaaagaccatatcttctttaatcctgctgagggaagcaacttaaaaataactttgatatggtttggctctgtgtcttcacccaaatctcaccttgaattgtaataatctccacatgttaaaggtggaaccaggtggagttaattaaatgatgggagcggtttcccccatgctggtttcctgatagtaagttctcacgagagctgatggttttgtaaggggcttcccctctttgattggcactcatttctctctcttgctgccctgtgaagaggtgccttccgccgtgattctaagttttctgaggcctccccagccatgcagaactgtgagtccattaaacctcttttctttataaattacccgttctcaggtattgcttcatagcagcatgagaacatactaatatgtacttctagcttctgtagtcaatgatttctggatacatactcttcttctaacactttaagataatattcctttctcttcatttaaaaatatgtaggcaacttcatattcttctcttcaaaccaaaatataggggaaactgcatagacttggtgtttgttggtaggatggattgctttctgcttgcagtatgtgaagcccattcagggttgagggagatccagtttcagcacatgggtaggctaattcacgtaactcttacttcaatttctaatatccaaaagcaattatgtagcacaaccctaaatgggtaactgaggtgggatttttttgcttctgctcatatccaccatacttataaaaattgaaaataccttacgtctaggctgtatgatcctgatcacccacctgactataatacttacatgcagagaatccactaatttctagcttacccctcaactctatctgtggaaggcagaataatgccccatccgcccccccaccacgaagatatccatgtcctaactccaagaacctgtgaatgtgttgccttacatggcaaaagggactttgcagatatgcttaagattacagaccttgagatggagagattattgggtttatccaggtgggctgagtgtcatcacatgagtccttcaaaacggagactgtttattatctgtggtcagaaaatgataggtcaaaggaaggaggcagaagaaatctgaagtgtgagaaggactcagtctgttactgctggtttgaagacagaaaatggtggccaagagctaaggaacgtggaccccatttagaaggtggaaaaggcaaggaaacagtttcttacctagagcctccagaaaggaatgtagtcctgccaacactgggttttagtccagtctgacttttgctggacctctgacctacaaatgtgcaagataatgaatgtgtgttgttttaagccactaattttgtagtagtataacattctggagtttaagagtctgaatggatacttaaagatagaaagaaatgatacaacatcactctgcccctcttacccaaatactgtctatgccctaggaatggctaccctgattttctcattagtgcagtgtccgggtctctgaaacatggaggagaaaataatgcaagaataaagtgcctttgaccatatttaagctaagagaactgctctgttttatgacaaagtagaggaatttttaatttcttgatgtaggttatgttcgacctttagtttgaaaaaacaaaaaccgttgattaaggcagtagttattatttttaaattttttagtcactgtttgttagcatattccatctgttttggcaagttcattgtggaaagatgactctgttaggattaaggactccagataaagcaggggtctttcattttcatcagaagactgatcagggtgctggagttcaggggctagctgagcactcatcccaactgcagtgctgtggccttgtgattgtcatctaacctttctgagactccatatccttactttttaactaagcatactctgttaagtgccgtcttaagagtcttctagatttctatgcctgtaattccaataaattcattaattctttcaacaattatatagtgaacaattatatatcaaacttggaataacagcaaaaggttcttcaattttaagaaacaaaatattaagactagaagcttagttggatattgtggtatatgcgataaagaaaagtaaagaggatgttatgttcaagattattgaaagtggttagggaagtcctctctgaggagacaatattataatgaaacaagcctacagaattagaagctcccagtcttgcaaatattggaggaagaaaactccagacaaagaggaggctaaacacaaaggttttgaaataagattatctaccagattctaggaacaaatggttgacctgtacacccaggcttggcatgtgagtgagaataatattattataaacttagagtgaaaccagttgacccattttgttatcttttacagataaaattcaccaaaagggtaggtaattagtcttatcaaaatcggttttatttacaaatatgaaggatggaagagtgggcacaggagatgagagcctatattaagtagttggtaactcagtaaacaatggagtctaggccagacaaggagggagagaaatataggaaaactccagtggttttgggaaagaggatagattcaaaacaaaaactttaaagggttacaatgatagttatatgggtactagagtaagtgatcttgaggacaagaggcatttttgagaagaaaatgtttgaaatgaagatgcaagatgtgcccctgccccaggttgtgacaaaagtgaattgagtccataggaacaggtgtcagggatagaggatgcggttgtttgagggagggtatcaggacctgagaagccaaacttgatgagtcattttacgaagggtgacctgttaaagaatacccaggaacaggcctggagtagtcctgaaagagggaggcaggtgccatggactaagggaccaggaaggtgcacacaatctcacaagactccagctgccatcacccatgttcatttccttgaagaaatcatcttattccttaatttttccccaatatatagtttgagactttctgattctctttctataaatacaaagccctagagatttttattatctggtgatccaaccctttttggagtgactaatcaaaaaagcacatgacagtatgcatattttataattttggaaattactcttcctatttacatatactttggagtatatcacaactccaatttagtacattttgttattagataccagaaaatcatgagttcatactacagtccctctgctgccccatttccaacttaaaatagaattaccaacttaaaataggagaaacaagcttaaaatagaagaaacaagccatcacttaagtagatatagaaatatagttgataaaatttaacacctgtaccagataaaaatttagtaaactagaaatagagctttaccttagtaagagcagccattaaaaaaatgcatagtaaatgccattgtatatattaataatttcatttaaaattaaatatgtgacaggaatgcctactgaagttaccttcattcaatttttaactagagatccaagccagcatacttgtacgctgtactgattgaaatgacaatcaaattagtggaataaaaatgggaaaaaagaaaatgaactgtcattatttgctgatcataaaattatttacataggaagctactaaagaatacagagaaaacattataaaatagcaatggatcagcaaaatggttaatataaaattaatatatagtagccaattgcatttctataacaaacacctagaacacaaaattaaaaataaattatagcttaaaatatgtcagtaactattttcaaaatattttgaaaaggaaatggcagggaatatttcacaggtgggaatagtatatgcatgggacaatgagggcacaatttgaagtaagtcactataagccaagaagcttcatgataaagctgactttaggaaggttaacctggaagcaaagtaaaatagtttgagctggggggacagcaggtggcccagagagaccagaagccggagatccgggaaaacacatctccaaagggcacagaggcagagtgaatggactgaacaggagagaattagacctcacacctttcttgaggaaggtggatctcagtgcatattttaaagattagaattcacatagatatattattttactagaaaacattttctcatgtctaaaactttttaaagcaaaattacttaaaatctttggtaagttttaaaagtttagataatgtaaatgtttatatacttttgaaaagtaaactaagtattacctttaatatttgtaaactttcataacctatcactgatatttactaaagaagagagtttaacaacactgagaaatattccaacagaaaggtgaactgttttgtttttaagcaggtgaagtacaagaagtttgatggaggccattttacttaattaaaaacttcatcaaaatgctgttttcactatctgagttgtcagaatttctacaaggctttttcatattcagtcctttcaaaaatataaaatacttgaaggcagttctttatagaagaatttaaagttacatgtcaaatgtagctcttctttttttaattactgaagccatatatggtcaagagtaacttcaggctggccgcagtggctcacgcctgtagttccagcactttgggaggccgaggtgggtggatcactaggtcagtagttcgagaccagcctgaccaacatggtgaaaccccgtccatactaaaaatacaaaaattagctgggcatggtggcatgcacctgtaatcccagctactcaggaggctgaggcaggagaattgcttgaatccaggaggcagatgatctcagtggcctgagatcgtgccactgcaccccagcctgggcaagagagtgagactccatctcaaaaaaaaaaaaaaaaaaaaagaaagtaacttccacattaaacaagagaaataaaaacaaaagcaaagttctttgtctaagcaaagcctgttaactctaattaaccagctttgcacagctgtgatagtacagcccattaattattaataagaaaataatcaatattaacctcctcttttttattggtaaatgttttttggggtctttgtgttaatttgttattttttaaattactgttttaataaatttcattatagatgctggagtaattacattacctaaaaataagatatagtcatgtagcacattactttgaagagaaaaataatatttgtaactttattaaccctatactaagcacattagtttcatttttgaaccttgaaccttggtatttgatttgcagtcctttccaaatatttaaatttccatatttactctctattctttactaaactctactcattgccttagattgaaacctaagtatctttttaaaaaaaaacccttttatgtggctatagaacagaattaggaagtttgctaatcttgaaccttgctttcttaaatggtatttttgttcattctcttcctaaactttatttttttattatttctctgctttacaatttaataagccattttactggagcttcatactctactttctatatcatataatgggaatagttttaatgcttgtgaagacagcatgtattcagtacacaaagatgaaaataatttaatcatcttcatacttattagaaatacttatattattcagtcagtaactgtgactattgaacttatctcccaaggatattataaaaataaatgtgataagagctaaagaaatttttaaagtcatcaatgattcattttaatctaatttcatcactggaatttcttgaatgttgtaagagtttatgttagtgtgtcatctaatcatagttactctaactggctagcagcttagaacaagcttgaataaggttcaaactaacagtggatgactgccaatggttagaaaaaaaaaaaggaaacattaagctacttctaatctaaattaaaatacaaaaaaatcattaaaatctacttttattttatgtcaaaattgtatctcagatactctgatttttaagtcatcaatactgttttgaaaactggacagaaatagtcactggctaacagctaaataaagagattaatcataaataagcactatctttaagcagctcacagtctactaaagcctaattaagatttataattagaaagttaaattatacagcaaatctcagacttggaggagtcctttacaccatctcgtccaaccactccatgacacagatggccaatctgtacttcattctcgttagttgccttttcagcatgccagagctattcattgacatattcagccactttgttaaataagtgtgtgtgtgtgtgtgtttttccttacaagttgagtgaaaaattaaaatgtaacaaaatagtgtgaaagcactaatcccctattccctattttcttagtctgaagcttggtgcaaaggcatcaatatcacgggcttgggattggtcacagttgagttctgtgacccttctctgtcacagactgactctggggatagtctccatggtctcagaatggagattactacctgagctgcaggaggggaatgctacctctgcctgctaaaattgttgccacctcctattgtggctgaaacatggtacttgcccagtaaagtggtgcctactatagtttttatttctgtatcaagctaaacacaaagtaaataatctggcagtagtgatcagtgatgcattgtatttactatacattaagaagaatttgtaggtctttaaaaacatcacagggatgtcatctattgcaataaatgaaaatgggatatttaattacccattaaaaattattagaagaaagagtgactatacttcccaaatgagtattgataagcctgagttcctgtaaaatggcctcgggaagctttgccttcatagcttctacattcttcacctgaaatacaaatgtgggctgttcaaagatacataggaaatactttactttgaaactgaaataggagctggggagaagtgtttctctggagggactggatcgctcctaaggctgcccaacttgtgggttttccaatgcctgaggtctttaccatttaagtcgttggatttggattttctcttgctttaaatcagaattattttatctgaggcagacagaaaaattctcaaaattgagatgaagtttcatctgatgcattaagagagtatatagaactcttgtatacttatatactcttacagactcttgtataaactatggcaaaggattctttaagacagaggccaggtaaagaacaaaatgactgaaccagactgaaaacacagcccacaccagggacagggactagtagcatcaggtgcagaattccaatcatctcctggcttgtagaaattcaaattaagatagcaacaagtacactaaacagtaattgtgagtcagcacattaattggagaggaaatgagggaaggaaaagggaaaaagagagaagttggaaggagaagaaagaaggggatgggaggaaagaaaagaagggatcgcaatgtacttaaatgtccaaaacgaaccaaaaatgttaaagaaagaacatgttgggaaaattcaacacttctaaatgctgaaaacaattaacaatggaaatgtaaaatgcttggaaccaagtgatccatatctactacaaatcaaagctaaaacattggtactattgggaaaacgttggtaatgccagccatgtaaatactgtctatataaaataacaataatatctaacacataggggaggaaaaagccacttaaatgggcaaaaataccctgtaaaccaggaggacatctaaaatggtttatgtggggaatgttatcagctaaaacacttacattacaaaaggaaggctaaaaattaattatacaaatattaatcttaaaaagtaaaaaagagcaacaaaatcccaggaaaatagaaagaagtaatataaataagaacattagataaatgttaataaaaagaccaaaagcaaattatttcataaagaccaattggtataaatatattcattaataatcataacatctttagataattatttagcattatcaaataaagttgagcttgcacgtaatctacaaatcagcaactctacttcttttaggtatatatactagagaaattcttggatggaggcacagaaaatttgtatgaatatgttcatattaacattctccataataataaaacctggaaacaaccaaactgtttatatcattatactatcagcagtagaatgctaaataaattatggaataatcaaattatagaatatgacccagtgttaagactgaattaaccacaactacatacagaaatagagatgaatcttagaaatctaatgttaagcaacaactttaaaaaaccaaaattcagaatactaggaacactaggacactatttttataaaactcaaatgagtataaaacaaaacactatgcaatgatgtggtttaggtgtgtccccacccaaatctcatcttgaattgtggctcccataattcccatgtgtcgagggaggtacctggtgggaggtaattgaatcatggggacaggtttttcctgtgctgttctcgtgacagtgagtaaatctcatgatatctgatggctttataagggagagtttccctgcacaaactctttgtttttgtctgctgccatgtaagacatgactttgcttcttttctgccttccaccatgattgtgaactcgctaaccacgtggaactgtgagtccatcaaactctttcctttataaatcacccagtctctggtacgtctttattagcagtatgagaacagactaacatgtgcatatgttaaaacgacattttgaaagggaagagaaggaaaatattacatttcagaatagttattctgggtgaaagtgaagaagatgggaatggaaggagacactgggagcatcaatcttaatgcttacactaaattctcttgttgggtcatagactcaagaggatttgtttaattggtatgccatataatctaattattaataatatatgggttcttctgtatcaagtattacataataaaatatttttaaaggcatagaagatcttttctgttctgtgcctcatataaattatctcatttactttgaagcaaacttttgaggcatttattattgccctcattttaaagatgaggaagctgaggtttagagaagccaagaaacacagttcttgagagacatagctagagttcaggtctgtaccgtagccccttcctttaaccattacactgtctttctccatttggaccctttatagagggaagatcacagcactgacccctgttctcattggagtaggaggtgctgagagagctatgtaaaaagtacacactggagagtggaaaattttcacagaaatattgacacataaacttaggcaaacagaaggtagaaaagatgtttcaccaccaaaaactgtccacgtagagatgtggagagaaccaagaacctggaggatgtgagcacagtgggccttctggcatggcagaagcagagggaagtgaaggagggaacagcagtgctaaggatagaaatgcaggtttggtccagttgaagaaggcacttgatcttttcgggctgaccagtaggtcttaaactgtagtgcatattgttatcacctggcagacttgttaaactgaaggttgctgagccccattctcaaaatttcagactcaataagaatgagtggagcctaaacatttccattctaacaaatgctcaggtggaaatcactttgaaaagcaaagctttagggctggcatataaggaggattgcttttagaatgtcagtgatggtgaagctgtggagaatgggctggggagaaagaatgaacatggagagtatagttaagccactgcaggagctcaggtaggtctgaaacagtggtggtggagatggagagagagtgctgcagttgaggcatgtctgaagtctatgaacataaagtagtaaggcatgagttgggggcataaagatagagaggctcccaagctcctgccagaggtactgagtgaagagtagactcattaatcaatgcagggacaacagagaatcaactcaggtgcccatcaacggtagactggttaaagaaaatatggtcacaaataccatggaatactaggtagccataaaaaagaacagaattatgtcctatgaagcaacatggatgtagctggaggccattatgctaagtgaactaacctagaaacagaaaaccaaatactacatgttcccacttgtaagtgggaactaaacattggggacataaatatgggagcaatagaccctggggactgctacagcagagagagacggattggggcaagggctgaaaaactgcctattggatactctgctcactaccagtcacaccccataccttagcatcacactatatatctttgtaaaaacctgcatctgtacccctgaagctaaaataaaatttggaaaagaaaaataatcgatacataaaataaagagttatgctggctcacacctctaatcccagcattttgggaggccaaggcagatggatcacttgagctcaggagttcgagatcagcctgggccacatggtgaaaccctgtctctaccaaaaatataaaatattagccaggtatggtggtgcacacctgtggtcccagctacttgggaggctgaagtgggaggaccatttaagcccgggaggtgtaggttgcagtgagctgagattgtgccactgcactccagccagggtgaccaagtgagacttcatctcaaataaataaataaataaaatgagagaaaaaagaacaaacaaatactcttttcctccaagagggcactagaaagaggatacataatagtaacttttagaagagatttataaaaaatagagtgtgaattaattgtctctccccttggaaacaagagtttaacataaacaacatgggtttgcagatgtgtgtgggcaggatagggcaagaccaaggacagcatggtatcagtgaaggaaatgtgtaggagagtccagaaaacagcagccagttgagaagttcgaagcctgtcaaggaggatattttgatactatttacaaggtacttcacatacacgcatgatattttgtggcaggtaatagtaaggatgtaatattgatagaagagggagagctatgaaattgactatccccaagtagcaaacaagaattatagggtgaattatcctctcctatccctgagagaaagcaccagattgggcttctgtaaatgcaaaatacaggatgaaataaaggctcagtctgacagcggaagcttttggtttgttttctttggttgtccctcaaagtagaaagtaaagagaaggaggaagtagttcaaggtgcaaagatattctgaagtggagaaggaagaagtccacaggagtcatatgcagttaggtaatctggataagagcaaaagtaaactgaaatatgcagtagggtttgcatcatgggaacaaagaagattaatttgatgtgagtgatatgagctagggaaataatttaaaaattgaaaaaaatgtgaataataattgtagagattattccttttataaattgtgttaatacacacttcttttttaggggctagcatcacaaaattaccagaagcattgtgttgttttgccaattaaaggaatccaaataactccaaaatgattaattaccactttctgtaaatcctcaggtgaactcatttgcacagaattccctgcagttgtaaagaaaacagaacacttgacaacttgtcaggcacctacattcttttttccttttatttattaaattcttttactattacatgttattttccacagatgttatgtgaaatttctctcctaagcaaaataaataacttttttaagaattagaaaatctaaaggacaaaattttatattataaaactatacatagtattttattttgctggcataaatgcaaataatcatcttacagaaaaacattaatattacgttttgacttctttccacatgacatctacaaggcaaataacattacaaatcctcagtactttctaactgatatatggaaatagtgtggaaaatcacatgtagaattacatgtagtatgcttgtaatactgatttcctacaatgtacagatagggtaatactctgtccttggaactttgctgagaaagtatcaggaaacataacaggaaacatatcagaaacaactaaatggtgatttgtactaacattaatatattgtttatatataaataactctatacacatctctaagtataaatgcacacatctgtatgcatacatttattaacatccattgatataccacaaaaagtttgattaatcattttgagaaatacattaaaaaagaaacaaaatttttaatcttctccttactctatgacttccaatcttgggctcacattaacaccacttttttttgttgttgttgttgagacggagtctcactctgtcgcccaggctggagtgcagtggcgcgatctcggctcactgtaagctccgccccccaagttcacaccattctcctgcctcagcctcccgagtagctgggactacaggtgcccgccaccacgcccggctaattttttgtatttttagtagagatggggtttcaccgtgttagccaggatgatctccatctcttgacctcgtgatccacccgcctcggcctcccaaagagctaggattacaggtgtgagccaccgtgcccacccttaacaccactttttgaagatatctttaccttcaaggggtatttgtatcccaaatatattcagtccattgtctggcacatcatctgtcacatatagagctgcaagaagctcttccagtatcctagcatcaaaagaacattctcttcatgaccatttcactgcacctcagaaaaacaagaggccgaattcatcttcctagtcatgttgtggtgtaattaaatttaaaggaatcactacttatgtaatgtattttttccctttaagttgtctggagtaagttttggagaaacttgcatgataatatcaaaacttgttttcttattgtgttcagaaagcaaaagagaaatattaacattatttttagccttcttgtgttactggaaccatgtcacagaatgagagtttctctgggaataagatgtattgcaatattctgactaacagaatgtcagagtaagaaatttttatcagttgttctttgggtcattgtcacacatcatctgcatataatttccatagcagtgaacagtgaatgtgacattagcttcgcaatggtgttggcttgagggctggatataccgatgtgcattccagtcatggcaattcctggagaaaaaaaaattaattataatcattttgcataaatcaccatgaacaatgaggtactcatcaccttgtcagttagtttgcagcattcagttggctggcaaactggtgactttatgaagcattaaactatgtcaccgttagccagattaaactcactgtaacattatacttacataaagtgctttgtgaaggaaatatgaaaaatgttaactgaaccgatctcagaagacaggaaaatgattgtgatataatgcttgggttgaatattgtcactttcctggtgtaagcccattatggtttccaaaggactatattcaaataataagaaaaaagtcaggactctaacttggaagatgtaaagacatatatatattagatgaaatactctaaatgagaaagaaagaaaagaagaaaagggggctgtaaaatgactcaccatgtacagtctagaatcatagagacagggtgggagaggcccagagagagttgaagggtccagtatatttcacccctcagattctgtggattagaaaccaaagtctggagaaggttaagtgtctagcccaagacatagctagaaggtggtgggtccctaacctcgaatatagtatattttcacaggagcctaaatgaaatggaattcagggagtaagataaagaccagttttcattaacatttgcgttaaagttaaatatcatttttatgagaagacaaaagtaagatcaaatcctgaagtcaaagtaaataaccctgtgtaaaaacgcaaagttcatgggctttacaggctgtgctcacaagtctatgaccactgcttggaaggaacaggagtggaggctgtggcttattttcctggtggcatgtggtatgagccacaattttagtgaaagggtacagtcatgtcttaggtctctggaaactgcctaatgatttgatatcctggagattttttctggtctgctttatggaagacatttatatataggacagtgaaaaacactatttctggaggggaaagaacaatacggttaagtctaggttttctatttcttcttgagtttgttttcttttttgcttttagatttctaatcagctcaaaagatctccaagtctccaaacccttcacgaattaaaaaaaatgtaaaccctacaaatttcttaactccatctgcataacactgccacagatagaaaagtgtaaacaagataacaagagcatgggcaactctgtttttaaaaaagcaaaactgaattttattccagaagattctgtcctgtcctgtttgtaagctacgctgccaaaaatgagtgccaacactttgggagtggggagtgtatattgtttgaggtataaacatgattataatgtacaaaaataataatttacaaatgaaccacaatttctaaggttgcttcatatatgtcaattagtaaataaataaatgcataattaaaagaaaattgaagtaaaatagtcatttggtctcagcaagactctcaacaccagccaaagcatgaaggaagtaatgtccttttctctattcaagctgttacagctttctccagtggtcggaaacattttactcttcaccttctgataaaatcccagtcagctgcctttccctggtccgttcctccagcctcccatgaagaagtgatccttctcttttttaataccacttcttctcctctttatgtcttttgtcacatatcactgaaattttacccaaggactataccctctttctcctaaaagttccacctccctacttctatattctgatccattagttctcagtgtggtcctgggaacttgttaaacatgcaaattatctggccccactgcaaacctactgcatcacaaactctggggtacagtccagtattctgtgttttccccaccctctccaagtgactcagaaacaggctaacatttgggaaccacagctctaatatattctatcttaaagagaaaaaaaaaatggtactgcagccctgggtttcccttctactttccttcttccctgaactgtcaaattcctcagagtacttgttccctttcctttctcttattacatttgttttccaactcactggtcatactcagtgtcgtttggcattttgaggaattacatgttcggattgatttttgtgctgccaaataactacaatgctttctaaagttggaaatacagttgtgactagtggatgattagattcttctttgtagctctatttgactgtaatgggcgcaacttactggttttaccccagactagtccagaaaattatttagtgaacagaattgtatttttgcagtctaccaattatatcactagatatcttggaaaaaaacgccttgcaaagtagtgatagctggacaacctgggttgtgatcttggcttcttcattgtgtgacaataatataatacttaattattcttcacaataatattagtagttaattactcgttgctattagtaattattttgcttgctcacaaaattcaaggttattcatgtatttttctatctaaagcctcataaagcacagtgaagtatatttaatatcaattttcagataaataaatggaagtttagtgctattagggaacttgtccaagttaatgtagctaaaagtaggcaatgagctggatttccaaccaaggtctgtctaagcctgtcgaacaggctgctaatgaaaccttctgggaagttgttgtgtagattattctatttatgtattttattagttcattcaaaagcagtgttaagcctctgctttctggggtgcactaggctaagccctggaaacacagagaagaaagatacagcccacaaggaatcacattctggtgaaacaacagataactaaactatttaagtagatttttgtaagagtcatgatttagaggcacacagagcattgagggaacatggagactatatgaggtacataacctgggatggggagctcatggaagccctgctagggtcagtgaccttagtgttttgttagagaaacaagagccaggaaataaattgaatgaaaggaatgtaggaaaggaacctcagacataaagaataccagttgcaaagcaggagagagtaaataaataggcagaggtaagattacaaaaacttccatgcccttcaaaggaatcagaatgtctagaaggcaagaggaggagagtagggatacttttaagacaaaatgagagttagaaatctcataatgacaatactgtggaaagtggatttaagcattagaaggaatgaatgccaataattatcttagattgttttttttttcttctaaaaaaaagtggggggagatacatgtgcagaaggtgcaggtttgttacatagttatacatgtgccacggtggtttgctgtacctattgacccctcctctaagttccatcccctgaccccccaccccccaacaggccctggtgtgtgatgttcccctccgtgtgtccatgtgctctcattgttcaactcccacttatgagtgagaacatgcagtatttggtttttggttcctgtgttagtttgctgagaatgatggcttccagcttcatccatgtccctgcaaaggacatgatctcattcctttttatggccgcctagtattccatggtgtatatgtaccacattttctttatccagtctatcattgatgggcatttgggttggttccatgtcttttctgttgtaaatagtgctgcaataaatatacgtgggcatgtgtctttatagtagaatggtctctattcttttgggtatatacaaagtaatgggattgctggatcaaatggtatttctggttctagatccttgaggactactgtcttccaaatggttgaactaatttacactcccaccaacagtgtaaaagtgttcctatttctccacatcctctccagcatctattgtttcctgactttttaatattcgcccttctcactggaatgagatggtatctaattgtggttttgacttgcatttctctgatgatcagtgacgttgagctttttttcatatgtttgttggctgcataaatgtgtttgagaagtgtctgttcatatcctttgcccactttttgatggggttgtttgttttttctggtaaatttgtttaagttatttgtaaattctggatattagaactttgtcagatgggtagattgcaaaaattttctcccgttctgtaggttgcctgttcactttgatgatagtttcttttgctatgtggaagctctttagtttaatcagatcccatttgtcaattttggcttttgttgtaattgcttttggcatttttgtcatgaagtctttgcccatgcttatgtcctaaatggtattgcctaggttttcttcaagggtttttatggtttggggttttacatttaagtctttaatccatcttgagttaatttttgtataaggtgtaaggaagcagtccagtttcggttttctgcatacagctagccggttttcccattaccatttactgaataggagatcatttccccattgcttgtttttggcaggtttgtcaaagatcagatgattgtacatgtgtggtgtgatttctaaggtctctattctgctccattagtctatatgtctgttttggtaccagtaccatgctgttttggttactgtggtcttataggatagtttgaagttaggtagcgtgatgcctccagctttgttctttttgcttaggattgtcttggctctatggcgtcttctttgattccatatgaaatttaaaatagtttttttttctaattctgtgaagaatgtcactagtagtttcatgggagtatcattgaatctataaattactttgggcagtatggctaatttcacaatatttcctatccatgagcatggaatgtttttccatttgtttgtgtcctctcttattttcttgaaaagtggtttttagttctccttgaagaggtccttcatgtcccttgttaactatattcctaggtattttattctctttgtagtgattatgaatggagttcatgatttggctttctgcttgtctattgttggtgttaaggaatgcttgtggtttttgcacattgattttgtatcctgagacttggctgaagttgcttatcaatttaaggagtttttggtatgagatgatggggttttaagaggagccagctatctggattctagattttatgggctaaatggtgtctctcccaccacaacatttatattaaagggagcttggtactctaagccccagtaactcagaatttgactgtagtgagagatagattctttaaagaggtaattacgttaaaatgaggtcatatgaatatactgtaatacagtaaaactagagtccttataagaaggggaaattaggacacagacccatacagatgaaagaccatgtgaagacagggagaaggttaccatctaaaaggcaaggagagacagtagaagaaaccaaccctgctcacaccttggtcgcagacttctagcctcaaaaatcataagaaaataaatgtctatggtttaaatcacctgctgtggtgctttgttatggcagcccacaccaactaacacacaaaactgaaatttcatattttcattgatggctaccattttagatcagaatgacaactatatgctggacagattcttctgtagataacatcagacccacctagcaaatgtgtgctgaatttgctaaaagtaaaatattagctaggaatggaccatgttttcctttaatacttttgttaagacacaaacaccaaagactttccatttttgccactgtcttttctaaaggatgaattagtatgatataaagcatttgaagccttaagatgaaggaacactgcattaagttcaatgtaatcttcactttaaatctcttcttgagtgaagagtgcaaacatgcatccctgcctgaacacaaaggaataaaacctcgcctaagcactcctgacagtctttcatgcccacttgagaactggtcatctggaaccagccatccctacagctaccagaaaatacaacttcctctgtcactttcctgcagtatcacaaattacagaatggcacaagcgtgaaagagcaactactgaatgacgcgaaaaatatacagctaagagtgtgcaggcgagtgcaatggtgaggctcaaaagacttggtggagggtaaaacacagtgtgatcctcaagatttgccaccacagctgacttcctaattactactatactgctgttgaggcaggagaatagggtctggaggcagggaacctaaggctgatttacgcggacttctagaactaaatcaaaaggaaaaccccaactttccacacctaagtaacaaaaggactggaggatacgccctttgcaatcccccctccttttctgtgtggcagatagaaaattgaaagtatctctgattggttgctttctgcaaccaatcagatgattgcataggagtataactttgtaacttcacttcagcctctgattggttgctttccacaaccaatcagactagttgcacaggccactacttcatttacgtagggtatacaccaagtaaccaatggaaaaacctctagggggtatttaaaccccagtaaattctgtaaactggcccttgagtccctatgctcgggcctgcccccccgccccccgtggagtgtactttcgttttcgataaataatctgcttttgtcacttgattcttttcttgctctgtgtgtttcgtccagctctttgttcaaaacgccaagaacctgtacatcctccactggtaacactatctctgaataagataaggagtaatattagagctatcgttaataatataaataataggagatctctcttgccggaaaaaaggggaagcaataggcaagaaattagacaattcacccacatctacgctgctattaacaaaccaatgaacaggtttttctcagaagatggagaatatccagtaatactctgcgtgaattagaacatttggtgtgattaactgatttttgaagtgcacatattttgcctgactcttctaacttataaacaatgtctaaggatattaaaacattttcttcaatagctttatattggtttctaagatatctttatgaaaatatttgttttctaagatgttgaggtaattcagtattctttcagtaacttttgttttttctttaaaattgtccaaaaattttgagctctaaagtttaaaatatttgaagacttttgcagaaagtttttactaagacttaagcaaaagcgacttcagaaacttggtaatatggtattgcatgcctaaatacttgaaaaattcctatgattctttaaaaatactttttgaaagttcatgcctaaagacaaatgaaaaacttgattatttcaaaaacttattgataaatctattttactttaaaaatatctatttaaaacgtttatttataaaatggaatatataaaatgtgttaacactgcctaaagaaaagctttaagtaaaacttggctaaccaaaatgccagcatagttggtttccaatatcctttttttttttttttttttttgagacgaagtctcgtaggcccgggctagagtgcaatggtgtgatctcggctcaccacaacctctgccacccaggttccagcaattttcctgcctcagtctccagggtagctgagattacaggcacctgtcaccaggccaggctaatttttgtatttttagtagagacagggtttcaccgttttggtcaggctggtcttgaattcctgacctcaggcgatccacccacctcagcctcccagagtgctgggattacaggtgtgagccaccgcgccaggctggtttccaatattctttgttgaaattgtctgttgttgttatttggaaacaaagacaaattgcaatttgcggattttaccatcactgctgttttgttgtttaccaaacgaactttaaatttactttctggaagcttactcagatgcctcctaatcctgtacattttatacatttatagtaattttcagtgatagtttgtcatatgaataatgaacctaaaaccctgaatcatttgtatttatcaaggaaagactactataaattcattgaaatgtctttattacaacaagaaactgcaacaacaaacttttgaaagatttataggaagaaggaatgggtgattgtggataccagagctgagccagaatttaacaagaaagagcaatggcctggaatattgccctctaactagctaatcaaaggacttttttttttttttttttttttttgagacagaatgatgctctgtcacccaggctggagtgcaatggcgtggtctcagctcactgcaaccttcgcctcctgggttcaagcaattctcctgtctcagcctcccgtgtagctgggactacaggcgcacaccgtcatggctggctaattttttgtattttattagagatggagtttcactgcattgcccaggctggtcttgaaccactgagctcaggtaatgcacccgccttggcctcccaaagtgctgggattacaggcgtgagccaccgcgcccggccctaatcaagatcttagcatcatagcatgagttaagggcaaatacaggttctcctcacagtctaagggctattaattgaataattaatagtattaaaatttcacagcaagatgccctatgaaaataaattcaacttaagtgatagatattaagaaatgcaaaactttcattttcagataatatactatgaaagctaaaacagtatactacgtttcaaactcatttagtaattattcaaacatataacaatctcctgctggtttttaaatggatgttttacattatgtgccttctcttcaaatgtggccttttctaagttttgattgaatagaatgggtttttttttttcaagatcaagtctttttgtagggcttgttgttgttttttattgctagctaagtggttccttggagattgtggatgaatattgagattctttagagaaatgaagttcgtctgttacaattacactggcatgcttccttgagaaaagcagaggatatacagaaacatctaggaaagcctgtacatttttgagaagttagaaaattagttcccgattttcttttcttttgaaaaaaaaaaattttgtttcattatctcaagaaatgtggaattagctagagagggttgtcttatttttaatttgaaggagtggattcaagtgagaattaatataaacacatgctaatagggctgctttatgcttatgaggggcaagttcttcaccttcagccacactcaggcacaaccatgaagtgggttgagttggctctcagatcctcagccagtttccccctccccctccccctcctcctttctcaccacttgctgtaccctgttttcttccctctggcacctggtgttctctttacccactgctgcttctcccctgttgctccagagacaaccagtgctcaagaaaaaaaaatagtaaatgacttccatgaaagcatcttgaaactccggtttagacagagtaatgccaagacttgtgagagggctgagatttcactctgcttacaaaccaacaagcttgctaactcctgcaacagctccacggatgctggcagaagacatggcttctgggtctgggatgaaggacagcttattgctcgtagcaatagtggacagaatatcaacattttcatggattccctgagccctaattcagagggtctgcatacagcagggtggatttcaggagagaggtctcaagcttaggaaaccacaatcctttaaaaaggactgcaaccaaagctgcccaacatacaccccagagggacattatctttgttctagtggacagcaaatacaccttcattctgcacaggcagacgccaccatttctaccttccaaagtggttcactataaaaagttttttagaaaatgtccagaacaaaagatgattagtgtctctgctcacaagggcagaaaagcaacagactcatggagaagtctctcccaacatgcatatgttctgtgtatgcaggagggaggaattcatgggtgtaaagttaaaatagggcattctataaagcctacccaataaaataatgtaatcttacatttgtatggagaagagaaagtcttcgttgtttttgtctgcttgtttttgtaagatgaactataaaacataaagctcaaaaaatgcatggttgagatgtgtatgtaattgaagtattttcaactgagggtcatgttagtgttttaatattggcatattttagaagagtgaagatggatttaaaaggtagagaaacactggcttaatcaccgattatccacagggatgtttacattcagtggaggctaaagcctaattctaacatgatttcagtcatcggccaggatgtggggcagtgttttgagggtcagagagaggccttttcacagaaattactccaaaagaatggaggcctactctatatctaaaacattgtctgaataatgaacacaataattaatttgcttacattccttttaggaaatactgaacaatttctttgaattccttcagggatcttcgatatttattatacacatttcagtaaagaatgttaaaataagtatccctgtcccaaacacccagtctgtttctggtattttgaaggcgtgaatgtctcattaaccgagacaatgggaatgatgctaagaaaagctcttttttatttaactctcatgctcagtttatttttattctcatagttattatattctttagaaatattatatcctggtttctgcagttacactacttaagcaatgtcagtaacacagtcttctgcatagctccttgttagaaaaaagcttccctaatgcacagacataggagagggagaatcaaacagtaacacctcttgacatcctcaccagcactgtcactgggaactaattggaagataaactcggagaagcttattaaccctcctaatgtggataggaattggataggggcagggtgatagaaatcagtgcagggcaaaatgtgggtgtccctttcactttcacagttcagtaagatataaatactgtgtcatttttgttttcttgtttgctttttatttttagagatagagggagaaataatctagcattgtacattaaagtaatacattagaaaaggaggaaaactaatacaatatttttcctgtagcaaaaccccagaaatgcaaaaagacaagcaaaaagcaaggacttgagcttacacaatagaacgaatgtcctttacataaaatgttagcatatctgtaccaataaactaatttctaaccataaatatttgcattacgagaataaagatgaaaataaaccaatactttattaaatgggggtaagaaaattctcaagatagaatgaaagaaaaaatagtaaagataaaagtaggaattaatgaaaaagaataaaaattaattctcataaaagacagttgccaaaataataaaatagtctaacatccaaaatcgggctagcctgatttaaaaaaaaaaaagaaatctaaatgctccaaaatagtgatggaactacaacatgcaatctgaaacagtagagaaaatgaagacacaatttaaagcatgagaaaatgaaaataaatggtaaaaagtatcatgcacaatgagattatgcatgattcttttacaaatctgaaaatgtgtgaaacaagttattctgaagggaatataggttgccaaaataaaataaaaaaacatttatagatgaagaaaggtacagtatcaaactgtccattaaccattgatcaaaaattaatgtcctctaagagatattaggagaggccccaagaatgatagactggagtaggaaaatgtggcacatatacaccatggaatacagccataaaaaaacggatgagttcacatcctttgcagggacatggatgaagctggaaaccatcattctaagcaaactgtcccaaggacagaaaaccaaacaccgcatgttctcactcataggtgggagttgaacaatgagaacacatggacacagggcagggaacataacacaccagggcctgtaggggggtagggggctggggtagtgatagcattaggagaaatacctaaagtataattaaaaaaaaatatatatatatatagtcaatctttcaaggaatagatcaatattgttatggacacatttccagactgtagagaaatatgaacaactcttatgttcaaatattccataagtctgattcttacacatgataaaatctgtctaccacaggaaaaaaaaaagcttcaagccaaactcatttttgattatagatgctaagattgaaataaagaaaaagtaagttacattgagctgtatagacatataaaatagcactttaatacattaataggtaaacttagtttgcaaaattatttacattgacacaaaaagttatttgataaattcaatactcatttctgattaaaattttttgtaactgaggggggaacacttatttcatttaatttaatattttaatttattttgggatggagtctcactctgttgccctggctggagtgcaatggtgtgatcttggctcactgcaaactcggcctcccaggttcaagcaattctccccagtagctgggattacaggtacccaccaccatgcccagctaattttcgtatttttagtagagatagtgtttcatcatgttggccaggctggtctcgaactcctgacctcaggtgatccgcccgcctcggccttccaaagtgctgggattacaggcatgagccaccacgcccaggctcttaattttaattttaattgtctaatgacagaaaccatgagaatagtccagaaatacttcttagaataacactttaatacacatagattcttgatataatttaaaactatattattaaagtaaataccttccaatgtttgcttttgcattaatattaccatgggtatcaagatagtactattgaaacaaaaacagaaaaaaatataaaacagaattcaaatttgcaaatgatatggaagctgaactatgtatacctgacactgatagttgcaatgctgtatcaagagtttccctgataagctctactactaattgtaccagctagaataaaaagcaacaatagattataatagcaaaatgtaagaaattagatctgataattaacgtagtagggaggggatgtgaagatatgttgtttagaataacttagtttttctgaaggacgtaagatagcttagaaaattaaaaagaaaggttgtgtcataagagtgtgtaatgtaaagctcttaactttccacaaagtaattattatgtttaattatattataataaaaatttcaaaaagactttttgaagacaaattgattctatagttaatctagaagaataataggatgatatagattattctgaaagaaaataagagagcagcttatgccaatatatatgaaaaaatatatgcatatagaataaatgtaatagtaaggaattgaaacaaaaatagaatagcatcaatcaataaaatagagtccaaaagtatgtataaaaatgttgcatttaaattgaagatgaaattaattatttaatacataatcctggaagatgtgtttcacaatgaaggggaaggtaaatttagattatttgctcaattttccaaagtacttagcaaatagattaaatgtgtgtctataaataaactggaaaataaacttatcttaataagcatttgttgggtctcaagatgaggaacaccatgctatatgaaacagtgaaatccatagtaaactccatgaaaggagcaattaaacacaaaatcaatttttaaaaaaatatttaaaaaccacaaatcagtgtttctcaatttgggtttctaggtacctagtgttgatgatttatatttatgattttataggtaatgtaatgtatcaatattgcttcattaattttaacaaatgtaccacgctaatgtaatgaataaatattaggggaaactgggtgcagagtatatgtaaatctaaaactctcttaaaataactcattttaaaaaatggaaaatgttaatactaagcaattcagaaaatctattacaagtaatagaaattgctaaggtaagaaaatatcattaatctcttcagcatgaaacaaatgtaccaataagttgccttgtttaacatattaaagtaataaatgggtggatttatatctgggtgctctattctgttccattggtctctgtgtctgtttttgtgccagtaccatgctgttttagttactatagctttgtagtacactatgaagttcaatatgaattcaggtaatgtgatgcctccagctttgctatatatatttcaggaccttttgtggtacaaaagtttttgggttacatgaatgaattggatagtgatagtctgatattttagttctcccatcaccagagtagtgtacatcgtattcaatatgtagttttctatctctcattccccccgccaccctccctccttctaagtctccagtgtgcattataccactctatgtctttgagtgcccatcaactttgttctttttgctcagggttgctttggctattctgggtattttgtggttccatatacactttaagattattttttctatttctgtgaagaatgttattggtactttgaaacggattgcattagatctgtagattgctttgagtatggatattttaacaatttgattctttcaatctaaaaacatggaatatctttacatttttgtgtcctcttcaatttctaatataatattattcaactatgaaaaagaataaaatcctgtcatttttaacaaagtggatgggaagtggtgaacattatgttaagtaaaataaggcagacagaaaaagataaagtagcatgttctcactcttatgtgggagctaaaaaaaataaaattttaaaaaaaaaaaggaactcagggtgatagtaagatgatacttaccagcagctgggaagggaaagaggagaaggtgattaagaagagttgcttaatgagtcaaacatacagttagaaggaataaaaactagtgtttggtagcacaataggttgactatagtccacaattaatttattgcatatttcaaagtacctaaaagagtggaactggaaagttcctaaaacaaagaaataataaatgcttgacatgatggatatccctattaccctgatttaatcattacacattatatacttacatcaaaatttcacatttaccccataaatatgtacaactattatgtatcagtaattaaatatttgaaaatgttcaaggaagcatgcttataattatcctttaaatctgtatatgtaaactcttcataataaagactaatgtagaaaaaaaagaaacgtaaaaacttcttctcaactcatgcttacaagcttctttgttaaacacttccattcactgaaagaaacaacacataaagcaactttaaagaagtatgcttagatttactttttaaacctgtataaaaaaaaaaaaaaagtaggaccaggcacagtggctcacacctgtaatcccagcactttgggaggctgaggcaggcggatcacttgaggtcaggagttcaagaccagcctgggcaacattgtgaaacccaatctactaaaaatacaaaatttagccaggcatggtggtgtatgcctgtaatcccagctactcaggtggctgaggcacgagaatcacttgaacctgggcagcggaggttgcagtgagtcgagatcgtgacactgcactccagcctgggttctctatctccaatgaataaataaaataaaataaaataaattagcagaggcttttaaacacctacattacacagtggcattaatgtagggaaggttacttttatatattatagtgttaataaagtatcacacattttctgaaagcctctttggcaatatatatcagaaaccttaaaaagattcctattttttgactcactcatttttgtaatctacctcattaaaacaatcataaaaacaaaacaggacttaacttagatggttttatttatgactatttattttgcttcggattttctcagaagaccacaaacccctctagatattttaaatagaatgagatacaatacagagaatcagaagcttacaaaatcatcagaactactggtggagcaaaggtgacggaaattactgctcatttcagtaaatcagaaactggggaagttacagaaaactgttactgatctcatatttgcaccaaggaagtgagttaatacacctgcccactgcagtccctagagcaatagtgacttccttcactccaccttcaaaattctgctgaaatgcctctcgttggcagaatttaatgtgaaaaactgttgtcaggaactctggaaaacatagttctctggctcccagccttttaataaagaggaaaatataaatgtgtatggggaagtggtggtagtggcactgtactgttaacaaaaaatgcaagaatggaaaaaataagtcagcaatttaaatgccaatactcttcagtggggaatagtttactacattggagtattcatttgatgagattgtatgcagtcattaaatatcctattctgcaatacatgataaatcatgtatcattatgttttaataaaatgagaacatttttactattaattggatgaaaatgtagttcataaagcagtagagtacaaacctactttattatataatatagcatcattctattcaagttcaactttatagtaaaactaaagattttctaaatccaaaattcaattttctagacatagttctaaaattccatttttaaaagtctatggaaagaaaatgaagttctgttaaggtatatgtagaatacctggaaaacaaagttctataagtttttttagcttaatgtaacattaagagcccataatctaaaatattacattgtccagtgatattgtcatgtattctagttgtagttacttttaaaataaatgctaagttggaaaagaaagcacattttttatggctaggttttgtaataaccaggtgactattctaaagatctcattcacttataaaccataaaattaaaaaatgttttctcaatggccataatagtggagaaataggttgcttttctccagacatagtgctttgagtctgtacttcatgaaatatcatctgtaatcatctttgtacttacgaaattatcaagatgtaattatcaagatggacactatgggctattgttggatgaacacgccttgacaaacagtcaatactttaaaacaaaacaagcagtacatgaacatattcctttcctttgcagagagtttataccctatttctaattgttgtttgagaaggtattttaatagaatggagttatttactctagaggcacactctggggggtctgcataggaatgtgagtcccaggtgttttccaggtctctctctccttactaatattactcagccactctgtcttctattagttctgttttgcctcaggtttcctaaattgtcaatattttgttttgatttaatgtctagaaagaattccaggatatatttttatactaacttttgttcaaaatgcaattatctctctttatcctcacttcagcttccataagagcatttaaaggtcagggaagagtttttaagcagatcagtttggagaagcagaaaatctctatggaaaagtgcagggtctagtaggaaagaccatgtagaaatcactatatattgttttatttactgtcccctatgactatctgaaagacctagcttaatgaagattgaataaaagcattaaaaagtaatgaagccatataaattctgggcttgggtttaaaaattataattctaaccattttataatagttgttaagatacactcacctatgcacacatatattcagaaatgtttctaatatatgcaagtagtactgtgtgtatgattatgaagggcataatcaatgtaattcaaaaaacaataatgtaatttgattataagaatattaggatttgaaaaataatagtcatattcttgctaaatgaacaattcaaattagtcacattaaagaaaataataaactttaatctgtgaaacccattattaagaaacttcatttaatggattaatctcattgcaaattgcatagtgctatacaaaaaatgattactaaattgaaaagtttccccttatgtacaagttagatatataatctgtttgtttttatgtatattgtgtttaaaatcctcatattgctcaggattaccttggttatccggggtcctttatggttccctattaattttagaattgttttctaattctgtgaaaaatgatattgctagattgataagaatagcattgaatttgcagattgctttgggcaatatgagtatttggccacttaaacaatattaattcttctaattcatgagcaaggaatgtttttctatttgcttgtgtcatctgtgatttctgtcagcagtgttttgtccttctcctggtagagatctttcacttccttggttacatgtattcctaggtatcttgtgtgggtgtggatattgtaaatgaggccatttccttgatttggctctgagcttgaacacttttgctatatagaaatgctactgattttttaaattgattttataccctgaaactttatcgaattagttatctgttctaggagactttaggcagagtcctcaaggcttttatagaatcagatcatcagtgaagagagatcatttgatttcttttctgattttcaatgccttttatttcattctcttgcttgattgctctggctagtacttccagtactatattatataggaatggtgaaagtgggcatcctctgcttgtttcagttctcaagaggaatgctttcaactttttcccatgcagtatgatgttggctgtgggttgtcatagatggatcttactattttgaggtatgttcctttgatgcctagtatgttgagggtttctatcatgaagggatgttgaattttattataaactttttctgcatctgttgagatgatcacacactttttgcttttaattctgtttatgtggtgaatcacatttatcgacttgtgtatgttgaaccagccttgcatttcaggaataaagcctgcttgattgtggtgcattaactttttgatgtgctgctggagtcacaaaatactaatttgctagtattttcttaaggatttttgcatctttgttcatcagggatactgacttgaagttttctttttcattgtgtcttttccaggtttgggtattaggatgatgctagctttgtacagtgagttagggtggaacccctcctccttggttttttggaatcgtttgaggagaattgctaccaggtctttttttggatgtctggtagaattcagctgttaatccatctgattcagggcttttattggttagtaggctttttattaatgattcagtttcagaatttgatattggtttgttaagggtttcagttccttcctaattcaatcttgggagattgtatgttttcaggaatttatccatttcctttagacattctgttttgtgtgcatggagtgtttacaacagtctgtgaggatcttttgtgtttctgagggattggttgtaatgtcacctttgtcattttttaatatgcttatttaaatcttctctcagattttcatttgttaatctagttattggtctattgatcttatttatactttaatatagccaacttaatttcattgattctttgtaatggtttttggcttcaattttgttcagttctcagattttagttctttcttttcttctgctggctttaggcttagtttgctcttgtttttctcctttctctaagtgtgatgttagatcattaatttgagatatttctaattttttgaggtaagttttagcactataaagtttcctcttcacactgctcttgctggatgttgtatctctgttttcatttattttttaaaaatgtattaatttctgccttaattttcctgttcattcaaaagtcattcagaaacaagtcatttaatttccatgtaatcatgtagttttgagggattttctttgtattgatttctatttatattccactgtgatctgagagagtatgcttcgtatgatttagatttttttgtatttattgagacttgctttatggctgaacatgtggtcagtcttggagtaggtttttttttttatttattgagacttgctttatggctgaacatgtggtcagtcttggagtaggttttatgtgcagatgataatgtattgtatagttgataggtgatgtattctgtatgtgtctactaggtccaattagtcaaatgtcaaatttaagtctagaatttcttagttttattccctgatgatctgtctaatgctgtcagtggggtgtttaagtgccttattattattgtgtggctgtctagttcttttcataggtctagaagtacttgttttatgaatctgggtactccaaggttgggttcatatatgtttatgacagttacgtcttctcattgaattgaactctttatcattatgtaatgctcttctttgccatagctcaacatcaaactatactataaagctaaagtaaccaaaacagcatagcactggcacaaaaacaggcacatagaccaatagaagagaacagataacccagaaataaagccacacacctccaataatatggtctttgacaagtcaccaaaaaattaggaatggagaaacaactccctattcaacacacggtgctgggatagactaaccgtatgagaaactagacctctgcctttcaccatatacaaaagttaactaaagatagattaaaggtttaaatgtaagacctcaaactataagaatcctagaagaagacctaagaaacaacattctggactccagccttgggaaaaaaattataactaagtcctcaaacacaattgcaacaaaaacaaaaattgacaggtgggatccaattaaactaaagaaaatgtgtacagcaaaagaaactgttaacaaagtaaacacaacctacaaaatgggagacaatatttgcaaactatgcatcctaaaaacaaccccattaaaaagtggacaaaagacatgaacagatgctgatcaaaataagatacacaagcagctaacaaatgtgtgcaaaaattctcgacatcactaatcatcagagaaatgcaaatcaaaactgcaatgagatatcatctcacacaagtcagaatggctaatattaaaaagtcataaaacaacacatactggtgaggctgcagagaaaagggaatgcttacatgctgttggtaggaatataaattagcccatccaccatggaaagcagtttggagatttctcaaagaacttagaattgttatccagcacaacaatcccattactggatatatatccaaaagaaaacatatcattttaccaaaagatacatgcactcatatgttcagcatagcattgttcaaaatagcaatggcatggaatcaacctaggtacccatcaatggtgcattggataaagtatggtacatgtacaccatgtaatactgtgcagccattaaataaatgaagtcatgtactttgctacaacatggatgcagctgaaggcctctattctaactagattaacacagaacagaaaaccaaataccctatgttcacaattataagtgagagctaaacattggtactcattgacaaaaagatggcaacagtagacactggggacaatcagagtgaagaggtagggatgtggagaagtgttgaaaagctgcctattcagtattatgcccacaacccaggtgatgggatcagttgtatcccaaacctcagcatcacaaatatacccatacaacacacttgaacatgttcccctgaatctaaaattaaagttgaaattattaaaaacaaaattgtattcttgcattaaaaatgagtacaacaaatttaaatggattgtgtgtagtttaaatattaacagttcttaaatagaaaaatgaaatgtgaacactaagagttaacttacactaaaatatattctcaaattcctggtgtgtttttaagtgaagtttccctaacatcaggatgttaaattaataatctctgagacatttaaattttgttatccagtatattagtcagtattctccagagaaacataaccaacagaatgggatatatatacacacacactcacacacatgcatggtgatttattgtaggaatttgttcatgcaataatggatactgataagtcccacaatccgctctctacaaattgaaaaatgagaaaagctattgctgtaattcagtgtgaatctgaagacctaagaatcagggaaggcaatttctgagggcggaagaggagggatgtcccaactcaaacagaagcaaattcaccctctcttcgtctctttgttctatccaaaccctcaatggattaaataatgtctatccacattggtgagggccatcttctttactcagtttgctgattcaaataataatctcttccagaaacattgtcacaggcacacccaaaaataatattttaacctcactttaggcatctcttagcccagttgagttgacacatcaaactaaccataacaccaaggaaatcatgttagtattattgcaaagatatccacaatgcatttttctcacaaatgccctttttcctgtaaattgtatcacttcatctcttaaatgccctcatcgcaaaaaaaaaaataacattgtattggtcagtgttcttcagagagatagaatcaaaaagatatatgtgaatacagatattttaaagagatttattagggatactagctcacatggttatggaggcaaagtcccgtgataggttgtctgcaggctggaaaccctgagatgctggcagcatgactcagtttaagtccaaagccccaggaactagggaaacctatgacataactctcagtctgagtctgaaggcctgagaactcagggggccactggtgtaaatcctggagtgtctgtgtagaagatcctagatttctgatgtcccaggacaggagaagagtatatcccagctccaagagaaagagggcatcacctttttgtgcttatcctcgtcctcagatgattgaatggtgcccagacacactgagggcagatcttccccacttagtccaccaactcacctgccaatctcctctggaagcaccttcacagaaaaacccagaaataatcccttaccggttctcttggtaattcttaatccagtcaagtcaacacctaaaattaaccatcagaaacatataactttgaacaatttgcgtttacctttacccactcacataaaaacaccatacgtaggagttcaaaggaatttaaattgtttgcaatttttttcttttataactaggaatgttagcaaaacaccatacggtgagacagcaaagcacagtggcttaggagcacagactccaggttcacactgcataagtttgatcctagctctgttatttaataatataggacactggctaagttatttaacctctctgccttggtttgctcctttgtaaaatggagataataaatattttctaccttatatgattggtatgatgattaaatttacttatgtatgttaataagtatattgaacaatggcctgtaagtacttaatgattaattgaaattattatatctcttattaaagatggtttgcttatatctcatatagccataagagatattttgtgattgggatcaggaaaacaggttatatcaaaggcaggtagtcacctgtttctctttgcaatatttttaaagatttgatacttttagaacagttttagttcaaagcaaatttgaaaggaaggtacagagatatcctgtatatttcctgcccccacacatgcatagcctcctccattatcaacatccttgtattagtccattttcacactgctatgaagaactacttgagactgggtaatttataaaggaaagaggtttagttgactcacagttccacatggccggggaggcctcagcatacttacggtcatgatagaaggtgagggggaatcaagcaccttcctcacaaggcagcaggagacagagagagcgagcaaagaaggaaaccaccagacacttttaaacaatcagatcttgtgagaattccctcactatcatgaggacagcatgggggaaactacccccatgatccaatcacctcccaccaagtccctgcctcaacatgtgaggattataatttgagataagatttgggtggggacccagagcaaattatatcaatgaagtgtggtaaattggttacaattgatgagcctatactgaaacatgattatcacccaaagtccatagttcacattaagatttattttgtattgaacatcctatgggttttgacaaatatataatgaaatatagccaacactatagtagcatacagagtgttttcactaccccaaaaatctgccatgctgtatctattcatccctcactccccacaacctctggcaacaattgaactctgtttttctccatagtttagccttgtccatagtgtcacatggttggactcatacagtatgtagccttttcatattggcatctttcacttagtaatatgtgtttaaccttatgtcttttcatggcatttttttcagtgctgaataatattctattttctggtctgtttgtagcacagttcatttatccattcacctactgcaagaaatcttcattgcttccaagttttgacaattatgaataaagctgcttataaacattcttgttcaggtttatgtgtgaacatatgttttcaactcttttgggtaaataccaagaagtgagattgctggatcataccataagagtatgtttaattttaggagaaactgccaaactgtctttcaaagtggccggaccattttgtattttcactggtaataaatgagagttcctgttgttttgcatcctggccaatatttggtttttaaagtgttctggattttggccattttaggtatgtaatgatatctcattgttgttttaatttgtagttccctgatgacatatgatgtagaacatctttttatatgcttatttgccatctgtaaatattttttgagatgtctgttaagggttttggtccattttagttaagtaatttgttttcttattgatgagtgttaaaagtttcttttatgttttgaaaaacagtagtttatctggtatgtgttttgcaagtattagttcccagtctgtgttttttttttcatcttctttatagtcttttggcaaagcagaaatttttagttttaatgcagtctagttcaccaactgtttctttcatgaatagtgccttgggtgtcatatctaaaaattattgccaaacctaaggtcatgcagattttctcatgtgttaatttctaggagctttctagctttgtatattacctttaggtctgtgatccactttgagttaatttttgtgaaggatataaggtctatgtagaggttcactattttctgtgtggatgtccagtagtaaagcatcatttgttaagactttctttgctccatcgtatagcctttgcttctttgtcaaagatgattgtgggtctatttctagactctctgttatgttccatttatctatttgcctattccttcaccaacactaaacactaaacttatttacagtcttatttactgtagcttcacagtaaatctgaaagtcagataatatcaaagcttcaactttgttcttctccttcaacattttgttaaatgttctgggtcttttgcatccccatataaactctagaatcagtttgtcaatttctacaacataatttgctggggttttgtttgggatggtattgaatctatagattaagttggaaaaagctgacatcttaacaatattgagtcatcctttccttgaacatacattatctatccatctatttagtttgtccttgatttctttcatcagaattttgtagtttacctcatattaattttgtaattctgatggatttttcataagcatttcatttttggagatgctaatgtaaatggaagtatgttcttaatttcaaattctacttgttcattgctggtatatagaaaagcatttgactttttcttattaacctcatattctgcaactatgctataattattaattccaggaggatttttgttgttgttgattttaaaaaaattctacatagactatcatgtcatcagaaaaaacatgatttcttccttttttctttttctttcttgctgcattagataggactctcagtacaatggcgaaaataagtggtaagaggagacatccttgcctgttcttgatcttagagggaaagcttctagtttcttaccattaagtatgatgttggctgtagattttttgtagatattctttttcatgttgaggaagtttccccttattcctaggttactgattgtttttatcataaatgggtgatagattttttttcagataatttctctgcatttattaatatacttatgtgattttttaaatttagtttgttgatgtgatggattacattaattgatttttaaatattgaaccagtcttgtatacctgagataaatctaagtaggtcatgttgtataattctttttgtatatatttggattcaatttgctaatattttgttgaggatatttgtatctatatttataggaggtattggtcatagttttcttctactgtctctgtctaggtttgttgctaagatgaggctagcctcatagaatgaggtagaaagtttttcctcagcttctatcttttgaaagtaattgtagagaattggtataatttattctttaaaagtttggtggaattaccagcgaacacttacggacctgatgctttctgttttggaaagattattaataattgctttaatttattaaatacatatagacctattcaaattctctatttttgcttttattagatagattttattttctttcaaggaattggttaatttcatctaggttatcaaagttttggacatagacttgttcataatattcgttatcttttaaatgtccatgagatctatagtaatggcccacctttaatttctaatattagtaatttacatcctctcttctttttagttagcctagctagaggcttattgattcaatttatcttttcaaagaaacagcctttggtttccttgacttttccctattgatttcttattttcaattgcattggtttcttctccatgttttattatttattttcttcttcttactttgagtttaattggctcttctttttctcatttcctaatttagaagcttagataaatgactttagatatttcttttctaacagatgctttcaatactgtaaatgtccctcaaagcattgtttttactacatccaacaaatgttaataaattatatttttatttttatttacttaaaaatatgaatatttctcttgaaatttttcattttacccatgtgttatttagaagtgtgttcattgtttaatctccatgtattttaatctccaaaatatttaaaaatatttttaaatttctcttgaaatttcccactttatccatgtgttatttagaatggttttcattgcttaatctccatgtattttaggatcttccagctatttttttctgttttttttttcttgtttaatttcattccggactataaagtaatttcaaatttgtcaaggtgtgttttattgcctagaatatgatgtgtcttattgaatatttcctgtgagcttgagaagaatgtgtattctgttgttggataaagtagtctgtagatattcattatatccagttgattcatgatattgctaagttcaactatgtttttactgattttctgcctgccatggtcatctatttctgatagaggggtgttaaagtctccaactataatggtggatttatctatttctcttgcaattctatcagtttttgcctcacatactttgctgctctcttgttaggcacatacatgttaagaattcttattatcatagttcattttgagctgctataacaataccacagactaatttataataaacagaaatgtattggctcatagttctagaggttgggaagtccaagatggagaggctggcttcctgcaaaagctttcttgctgcattatccaatggcagaaaggcaaagagagggtgagagagcaagaaggggctgaacccattcttttataatgaacccattttcacagtaatgaactcactccctgtattagtcagggttctttaaagggacagaactaataggctatatgtatatatgaaggggagtttattaggataattgactcacaggatcacaaggtgaggtcccacaataggccatctgcaagctgaggagcaaggaagctagttggagtcccaaaacctcaaaagcagggaagccgacagtgcagccttcaatctatagcagaagacccaagagcccctggtaaatcactggtctaagtccaagagtccaaaagctgaagaacttggagtctgatgttccgagggcaagaagcatccagcatgggacaaagatgaaggccagaagactaagcacacctcttcattccactttcttttgcctgctttattctagccacactggtagctgattaaatggtgcctacccagattgaaggtgggtctgcctctctcagtctagattcaaatgttaatctcctttggcaaaaccctcacagacatacctatgtacaacattttgcatcctttaatccaatgaagttgacattcaatattaaccatcacatttacataataatggcattaatccactcatgagagcaaagccctcctggcttcatcactttttttgttgttgttgagacggactctctgtcgcccaggctggagtgcagtggcgccatctcggctcactgcaagctccgcctcccgggttcacgccatgcttctgcctcagcctcccaagtagctgggactacaggcacccaccaccacgcccagctaattttttttttttttttttttgtatttttagtggagacgggttttcaccgtgttagccaggatggtctctatctcctgagctcgtgatctgcctgcctctgcctcccaaagtgctgggattacaggcgtgaaccaccacacccggcaggctgcatcacttcttaaaggtcctgcctctcaacactattgcactggggattaagttttcaacacatacttttggagggacaaattcaaaccacagcagttatggccaataattttctcctttatcaatatgagattttcctctttattcccaatatattttattgctttgaaacctactctgtctgaaattagtatagctactcttgctttcttttgattagtgttaacaaggtacttctttctccatccgtttacttttaatctacacgtgtctttatatttaaactgagtttctcatagacaacacagagttgagtcttatttcttgattcattctgacaatctctatcttttaattagtgcatttagacaattgatgttcaaaactgattattgatatagttgtaataatatctaccagcataccaactataccaattgatatagttgaagaattaatagtgatataattggattaatatttagtactgctttgtatttgttgcctttctttgttcctatttttgtcttccagtcttttttctgccttttgtagtttcaattgagcattttgtatgattacgtgttctctcctcacttagcatacaaattacacttctttttttttatttttattttttgagatggagtctcactctcttgcccaggctggagtgtagtggcatgatctcggctctctcaacctccacctcccaagttccagtgattctcctgcctcagcctcccgagtagctgggattataggcattcatcaccatgtctgactaatttttgtgttttttagttgagatggggttttgccatgttggccaggatggtctcaaactcctgatctgtgatctgcctgcctcctcctcccaaagtgctgggattacaggcgtgatccaccacacctggccacacttctttttaatactttttttttaaattgttgtcctggagttgcaatatgcatttatatataatccaagcccactttcaagtaacaatataccacttcatgggtagtgtgagtaacttataataaaaaaaaactcttaatttcttcctcccatcccttgtatcattaatgtcattcattttacttatatgtaagtatacacacacatacacaatatatacattaagtatacataattaaatacatttttcatggtatttttttgaacaaatatttacttgttaaatcaattaagaataagtaaactagagcatgggaaagctcagaaaccaacacaagatcccagaaaatggggccaggcatgcagggaaactgagcagccagcaatacctgtcaatgtcatgttccttgatatgcagcagtgatgctgggctgcagctgagagtgccgtcccattgcaaggaatatcaggtccatgcttctgctgtctcaggtgcccaagcttagcatgggttctctcagctcaagccaccagccctccctaggacccgagaaggtgaagcccttgtgtgaagtcctggctcttgtcaaggcagggtgctaaagaagaaacagaaaagaagttaagaaaaaattttaattttatctttacttacttcttctttgatgctcttccattctttgcatacatttgagattttgacctatatcattttccttgtctccaaatgacttaggatgttttgcaaagcaggtctactgacaagtccccttaatttttttctttggccagacaaagtctccatgtctccttaaccattgaaagatagtttcacaaggtacaggattctaggtttgtgggctttttctctctcaacactaaataattcactctactcttttcttgcttgcatggtttctgagaagaagtcagatgtaatttttgttgttgctgttcctctgtaggtaaggtgtcacccaccccctctctggcttctttcaggattttttctttacctttaattttatataatttgaaaattgtgtgcctacatacagttttttgacacttatccttctttatgttctctgaggtttctggatacatggtttcatgtcagacattaatttgagaaagttctcagtcattcttgtttgaaatatttatttggttcatctgtctcttctctttcttgtattcctattacactttcgtagtttccccacagttgttgtatattctgttatagttttttttttcagtttttattctttatgcttttcaattttggaggtttctattgagataccatccagctcagagaatttttcctggaccatattcagtatactgttaaccacatcaaagttacttttatttctgttacagtgttttttagctctagcatttctctttagctcttaagatttccatctctctgcttactttacctatctgttcatgcatgctgtcacctttatccatttagagcccttagcatattatcataattgttttaaattccgtgtctgataatccaatatccctgccatgtctatctgtgaggcttgctttggcccttcaaactgttttttgtctttttgtatgctttgtaattttttttctttatagccagacacaatgtactgggcaaaagggagcactttaaacaggcctttagtaatgtggtggtaaggtatatggggagggaatatgttctacagtactctgattaggtctcagtctcttagtacccctatgcctttggactgtgaacatcacaagtgtttctcagggttttttttttttttttttttttctgcctcgttaggtgggacaggatggttacattgggctggagttggttatttcctttcttccaggaaagttgggttatgatagaaccccaacaggttgaattctggttaaccagtttctcctgaaggcagaccttgttaagaacacagcgttctggcatattgcaaaatgattcattttcatcttttcctgctagaaggacaaaaagatttttctccaatatttgctgtgaaaacctggttgagtcccttggagcaaaactcacaaagtgtgggacccgtcctttgactgggtcctcctggagttttaactctcagactccttcatacttagcctctagcaatttgtcaattacagttcaagtttctatacccaacctgtgaagaaggttcatggcattctagttactatttcaaagggaggactctaaacatttccacccactgcactttgggtgcacaaatctatagtgagacagaatactttcacacaacacattccatgaagcagatttattacagataggcagcaagggacaacagaagcctaggactcatgacaaagctgtcccccaaggttcaggaaagcttcatgagatggatggaatctcatctgcatgcaacttatgtcacactgcagctaagggaccccaaaaagcagcctgtcctcggctttataccctgaggcattgtgatgcactggggaaaagcattgtaggatattctgctctaggaggaacaggaacgcagtgtgggatattctagccagttattccttatctcaagatgttgcattcccagcacatttacagctattaagaactacaagggccaggagcggtggctcacgcctctaatcccagcactttgggaggccgaggcaggcggatcatgaggtcaggagatcgagaccatcctgacaaacatggtggaaccccatctctactaaaaatataaaaattagctgggtgtggtggcacacacctgtagtcctagctacttgggaggccaaggcagaagaatcgcttgaacccagaaggcaaagcttgcagtgagccaagatccagccactgcactccagcctggcaatagagcaagactcaatctcaaaaaaaaaaaaaaaaagaaagaaagaaaaaagaaaagaaaaaagaaaaataactacaagcaagaaatcaaagagagttgggttggcccaaggccacctggagaactgtcagccagcgcttgttcccatagaggtttttgcttcagcatgttgtgattctctgtatccctcatctgtctctttaatctggggggcagcagtttgccctgtgaccttacttctgttttggatctaagaagagttgttggtttttcaatttgctctgctttttatgtgttgttagaatagaatggcaacttccaagctccttacatgaagaaccagaaactacaagtctccataccatttttcaagtatggctttacatttttaaatgattgaaaaatcaaaacaatgatatattctgacatatgaaagctacacaatatcaaaatgttagggtccataaataaagttttattggaacacacacagcagagttaaatatggcccaaagcctaaaatatttactataaccctttagagaaaaatgtagctgacctgtgggctatgtgtgctaccgtaacagtgtgacactttctacccttcttgactagaatactaaaataatccaataattattttatgttttccaggaaatcaagtaaagcagaatattattaagaaacctttagttagaatttttaaattagaaataatttctttcatagtcccagaaagtatataatgggtgaagtatgaatgggtgaagtatgaatgggtgaagtatgaatgggtgaagtatgaatgagtttgaatttgcataactgttaacattatccatgtttcccccctctctatatatacacatatacacacacataaacacacatatacaccagtgatatcctctacaatgaaacatattaattattcctgtactttatttaacaccaaagtttcttgattttgtttttttattagtagatagggctattttctgaaccctcttaccaagtcctctaatgactttagagacaactgtatcttatacactttttaaaagcaaatctcccttccttgtccagtatgttgtgagcacagcgtagaacatttgataaagacttagtgacttgaattaaattacttgcagttaagtaaaacatcccaaatcatgaaccctcaattatcttgtctgtgtttaccatgtcctaaggcctttcaaatagaagtgacaatttaaaagttctaaaataattacagcaccatattgctcactataaagtacaactgtcaattacaaattcaattatcagtggccacttgtgaatctagagaacttcacaaatgttctgtcttgtagctgaactggaaatgtttttagggttgccgtttgttttatagttttaaatatttataacctgattaattattttcctaaaatattttcgttctagctaaaaaatgtgctaggaacaaacacaatacctgctgaaagtgacttttgtccctttcggtgtagggataaatgttatcccacctaaataatatgactcttgtttttaattaggtttaaagtaccctttgcagtttgacctttccctggaatgatccattttctatgctacattttatcatgctgccagtaatgtcatcaaaaacttttaaagaacatattaaattggctttaaatttatattgagctttaaaatgaaacagcattaggacattgtgcttctttgttttacacctgcatactcttaacattccggtgttggagactggaattcttttcactccaagtactttaagttaggaaggaaagaaggaaggaaggaaggaaggaaggaaggaaggaaggaaggaaggaaggaaggaaggaaagaaagaaagaaggaaagaaggaaagaaggaaggaaggagggaaagaaggaaggagggaaagaaggaaggagggaaagaaggaaggaaggaaggaaggaaggaaagaaggaaggaaggaaagaaggaaggaaagaaggaaggaaaggaagaaagagagaaaggaagaaagagagaaagaaagagagaaagaaagaaagaaagaatgaaagaaagaaagaaaactaagaagttatttatgctttgtacaacagaatgggcacacaaggattctaacaaggatttcaattctaatatcagcacttagcccctcaatgtctttgagcatgttaagttgcaaagcccaaacggccttatctgataaggtgtcattatcccttctttgcaatgttcttgttagagttagaaataatagatgtagtgcaattgtcaccataggccctcaataaaagatggttgttgttgcagctgttgcaatatgatcgaggtctttactgacccagtgaaaaccttctactgcttgctctaagaaaccatttccttcttcctaattagtcctcagtaaagtgaataagttattagagaacatggtctaaaaacaatcatttatattaggacttcatcgtgtagttgaaacgtcatgccatggcttggaaatatcatggaaatgtggcatgaactcttcccggggtggtaggagatcaatgaggagcattgggagccaagaaaagaagccaaaaaaaaaaatcattagaggaaactttccttctctcacccatgtgcattttgaattcaacatatcgttggcaggttttctttaggtcaaggacagctttaaagaaaactgttttagatcctccaactctccttcataaacctatcccactacatagctttacaaattgcctcttttggagattttcccagaactatcctcttcactctgcacacagcaagaaattagccttccgctcttttactattccgttcctttacaattcatgctacttcagtatacttaacccagaatttattcaagttttatgtgttaatttaacaaatatttatttagtgactacctttattgtaccagttaaacatataacaggaaacaaaactcaaaaacagttctgtcctcactgagcttatattttggtggaaagatacagacaattaattgaaccaaataaattatagtgtatattagaaaaggataagggctgtgaaaacaaataaagtaaggaaggggagtgaaatatactgggaagtagagtttcaattttttagaaacagcttccctgagaagatggcaatttagtaacataaccaaggttgcaagtcaggaggttattcatggtgaaagcaatgtaggaaggaagaactgcaagtgcaaaggccaggaggcaggaagatgccctgcatggtccaagaagataaaggaagcccttctggttagatcagagaagatgaagttgaatagggctggtgtggagggacctggagaatatctagactcttgtaagctactgaaaaaaaaaaatgttggcctttagtctgagtaggatgggaaacatttgaatatttgaatgaagaagtgaaatgatctgacttgtgtttttttaaaagctcattctaactgccacgttgaaaatggatgataggaaagcaagttgaaaaaggctgaccagttagaaaatattacaaatatccaggtcgttttattggtagggctagaaggaagtggttggactctgaatacgacgtgttaacagatggacgaaagggaacagtgacagtgagggtcatggaggacatagaggtttttggtttttgccctggagtattagaaagttcaaagttgtcataaattgagatggcaaaggttacatacagcctgcttttgggttcagtatcaggactgcaaatttaggcatgttgactttgggctctctactcatgattccagggaagatgtggaataggcacttgaatatagaaatctggaattcaggggagacatgatctgggggtgtacaacttgaagaattcccaatatagagatgatatttgaagttgtgagactgaaggagaatgctaagggagtgagtgtagaaagaaaaggtggaaagtctgaggctgatcttcatttgcactctaatattaatcggttggtgagagaggaagaagcagagagtagaagcagatgatggaggaatggctaaggattggtgtaaaggcctgcaaataaaatcgtgtcaaggaacagtagatgaacaagtaggtcaaatgctgctgaatagtcattaagatgaggactgaaaataatgatgagcctaagaaatgagttggtgtgcctgtatggagtagtttcaagaaagaatgaaagtaaaaagctattgaaaccagagaatacagattcttacttttgaaagtgagttttgctacaaaggggatcagaaaaattgggtaataggtacagaggaaaacatggttatgattatttttaatgaaagaaacgtgtttgtatgataatggaaatgaatcagtggaggctaaaacagtcagtaatgtaggagaaagggggaattgctggagaaatttccctgagcaggaaggggaaaggggctataagatctggtgcacaagagaaggatccagctttaggagcaaggacaattaatcttgttaaaagagggaagactgagcagatgactcactggttagatgtaaacagcctctcagcctttcttggagcattctcatttagatataagatactatttaagtaacgaaatatctaatcatatcatttcagtaaatttaaatgaagaatttccattaggatatggaactcacttttttatttttttattatactttaagttctgggatacatgtgcagaacatgcaggtttgttacgtaggtatacacgtgccatggtggtttgctgcacccatcaacccgtcatctacattaggtatttctcctaatgttatccctcccctagtcccccaccccccaacaggccctggagtgtgatggtcccctccctgtgtccatgtgttctcattgttcaactcccacttatgagtgaaaacatgcagtgtttgggtttctgttcttgtgttattttgctgagaatgatggtttccagcttcattcatgtccctgtaagagacatgaactcatccttttgtatggctgcatagtattccatggtgtatatgtgccacattttctttatatatatatatatagagagagagactagatagaaactcttaaatcctaatatgcaaatctaacctgggaaaaccattacactggttaaaagtagcccatttgggatgcacaaaattcatttttttccttatgcctgacaggacatccagcaactccagtttgtaaatgagcttattcatttgaactgggatccatagctttactcaagaatgaacagcttggttcatctctccttgaaaattgctgttagaattaaactccttagtcaatcttttaactcaactgtttcaaaactcctttggttttgaatcaataaaagcattgaggatgtggcagttgagcagatgggtggtccacttggtaaagctttgttatctccatgtaagccacaataaaactctgacctgacaaaaagaaagtgtttacacaaatcaaaacagaaacctctatactataagttacacagtgtttccagttggtatctacaagtattaatgcagacacagtgacaggtttcaaataaacttgatagaaaaggccattcatattttatcatgttgggttgatggacttacaattgagaacaatgttttactcaagcttagtgaaaactcctaggtagtaatcaatattctcagtcaccattgcattgaaaatatgttcttgtctatgtcgacaaaggcatcaaattaaacttgcaaaggtagattattttttatcttttctcctgatgtaacaaatacatattataactgaaattgcaatataataaattaaaaaataaatgctattcagatttgaaagaaaataacgggacatctaatccatggctctattaatgctttatattttgtggcttaaaaccatctttctaaatattaaatataaattctgctaaaatagtgagggggacatagttgaaacttactatacatcaaactacgagtttccaatctttaagcaaaaatatagttactaaaatgttgtttacaaattatttttaaaattttaatactgacatgcaattaaatgatccaaaggcttcatacatttaccacatgttaaatgaagaacacgcttttgaagaaatctgaggtttcataaactgttatttactgagtttgttttgcatccaagatctcaggaggatttaatctttcatctgtttttcaaagcctcagttacattttattttttattttttgaatttatttatttatttatttattttttgagacagagtctctctctgtcaccaggctggagtagagtggtgcgatctcagctcactgcaacctccgcctcctgggttcaagcaattctcctgcctcagcctcctgagtagctggaactacaggcatgcaccaccatgctgggctaatttgtgtatttttagtagagacggggttttgccatgttggccaggatggatttgatctcttgacctcgtccatgtcagcctctgaaagagctgggattgcaggcatgaaccatggtggatggcctgaaatatttaattgacataacgattatacatatttaaggggtaaaagaagatttgatatacatatataattatcacaatcaaagtaattaatgcatctatcctgcattaattaatccaggctgtacattagacctctagaacttgttcatcttataactgaaagtttgtacccttgaaccaacatctcctcatttactccacaccctatcccctgacaaccactattctcctctttgtttttgtgactgaacttttagattccacatatatgtgagattatacactatttgtccttctgtgtctggctcattttacttagcctaatgtattagtctattctcacactgctataaagatactacctgagactgggtaatttataaagggaagagctttaattggctcacagatctgtgtggctggggagacctcaggaaacttacaatcatggtagaaggcagaagacaaaaaggaatcaaagcacgtattacatggcagcagacaaaagagaagagtgaagcaagcgggaactgccaaacacttttaaaacatcagctctcctgagaacgcactcactacaatgagaaaagcatgggggataccgtcttcacgatccaactacaattcaagatgaaatttgggtggggacacagagccaaaccatatcacctaatgtcctccagtttcatccatgttgtcacatatggcagtgtttccttcttttttaaggctgaataatattctattcaatacagcacattttctttgtccattcatctgtgactgacacttaggttgtttctattacatatcttggctcttgtgaataatgtggcaatagacatgggagagtagatatctctttgacatactattttatttccttttgatatatacccagaagtgggattgccagatcacgtgatagttctattttaaggtttttgaggaagctccatgatattttccatagtggctgtacaaatttacattcccactaacagtgtacaagagttcacttttctttacacccttgccaacatttattatcacgtgtctttttgataaccatcccagcaagtatgaggtgatacctcattatggttttaatttgtatttttctgatgattagtgatgctgagcatctcttcatatacctgttggccatttatatgtctttgctggaaaatgtctcttcaggtccttggcccatttttgaatcaggttatttttaaacattgagttgtgtgagatctttatatgatttggacattaactcctcatcagatataaggtttgcaaatattttcttccatatcatagattgcctttttattttgttaattgatttttgtttttgtttgtgatttttgctgtgtggatactttttagttttatatagtcctgcttgtttatttgcgcttttgttgcaagacacaaaatcaacatacaaatcagttgcatttttatacactgaaaacaaaccaactgaaacagaaaataagaaaatgatcccatttataatagatagcattaaaagaacaagagacttaggaatacatttatccaagaaggtgaagatctgtacactgaaaactatcagacatttatgaaagaaattgaagaaggcacagataaatgaaaagatagcccatatacatggattggaagaatcaatattatttaaatgtacatataaaccacagcgatctacaaattcaaactagtcatcaaaattccaatggcgtttttcacggaaatgccgtttcacagaaatgccacagaaaagacaatcctaaagttttaatgaaaccacaagactgcaaacagccaaaacgctcctgggaaataacaaagctggaggcatcacagtccttgctttcaaattatgttacaagactatggtagtaaaacagtatggtctggcataagcacagacacagaaatacaacaaaagagagagcctagaaataaatttacacacacattatcaactaatctttgacatggcaccaaaaatacacaatggggaaaggatagtttcatcaataaatgatgtttgggaaaactggatattcatatgtaaaagaataaaattagactcctgtattatccaatgtaaaaaattaactgaaatggattcaagacttaaatgaaatatctgaaaccataatattcctagaaaaaaacgtagggggaaactttctgacattgatcttggtaatgacttttttaaaagcgtttatcttttctttttctgaagaacaattattgaaaccaccatttcagggtgatctgtaactggtaagcaaaataaaccatgtaaaagaggagaagccttgagtgtagatgaatgtggtttctctagttcaatcataacattaaaatttcataattaaagaaaattagttctattatttctgtatttatgaacaaattggacaaactattatcttccaatctgtaactgtacatgggcttttcagattgattctacctaaagaaaatcaaaacgaaggtttatatattccttcagtaaaatcactcatagtttcccttatttagttagcatggtgtctttataaacagatgacttaaaagtgaacagaaaatggagaacaaaataactcaggatcccaccttagagataaagctctcatgactgttttagcagggttaacaaacgttccctatttcttccataagttaggctgcctgggtccatgacacggcttgatggacagggtgatccctagtcacctgtgcgcagctgctgcttctgccagctgaactgttgactcacagagtctgcaatatttcttttcttacattaaatttaagccatctttacttgctattttaattccacaatttaacaaattataacataaccctaataaaatgtgatatgtagagaaaacaaactttgtcatgaacacctactttaatgatttgtaaagactccaaagtgttatttaagtattatattaaagtattgtggtgtgagaaccataaaattttgaccaaaaaagcaaaaaaaaaaaaatgcaacaaaaattaatagagacagttgactactggtcacactctaaagaaattgttaatattatacacacacatacacatacacatgtaatttattttttaaatactatgctgcagtgatccaattataccttatttgaaaaaaggaaaaaagtcttatataaaaacattgatgaattaatgaaaatgtatatgtctaaaacaaagatatataatttaaaataattttcatcttttatcaaatattttgatttactatcagtcttgatcatattatttccatgacagtaattatttgctatattcactctaaattcactgtctttattacatctctttgtaattattaatgaaaatattccacttttaaatacctatgtttcccaggggttgctttgtgtaaaaaatattagcatgctacaaactatgagctatccacagtaaaaaaaaaaaaaaaaaactcaaaagaaaatctaattgctattttattcatttgattttataacctcaaactcacagaatactgaagaataaacttttctcctgattcatttgcaagtaagtgggcaagtttccatccatcatctccaaatacttttgtgtctgttttctacaagcaagaacattattctacatatccagattacatccatcaaaatcaggaaattaacattatttcactagttctttctaatcctcagattccatttgagtttcaccagttgtcccaagagtattctttttttttttttttttttttgagaagaagtcttgctctgtcactcaggctggagtgcagtggcgcgatctcggctcactgcaagctccgcctcccaggttcacaccattctcctgcctcagcctccagagtagctgggactacaggcgcctgacaccatgcccagctaattgtttttgtatgtttagtagagacagggtttcaccgtgttagccaggatggtctcgatctcctgacctcttgatgtgcccgcctcagcctcccaaagtgctgggattacaggcatgagccaccgcgcccggcccagagtattctttatagcaaaacgatgcagttcagagtcacatgttgcagcgagtttcattgatccttaatttccctcagcctgggagattgctgtctttccttgacactcaagactgaaattttatcgatgaggccgtttgttttgcagacttggtcttcatttgggtttctctcatggttagtttcaagttttgcatctttggcaggaatatcacaggagtgatcctgtttcatactcatcatgccaagggctgcacagtttcaagccatcccattattgtgattatttgatgcagacgctttgatggttaatgttatgtgaactgagctaggacacagggtgcccagacatttagccagacattatattctgggtgcttttgtgagggtgtttcctgatgaattggcagactgagtaaagcagaaggggctccccattgtggaagagcctcatccaatcagttgaaggcctgattagaacaaaaagactgactcttccccgagtgagagagaattcttgcttgctggccttgacttagacattgtttttttttcctgtctttggactcaaactagtattaaactataggctttcctgggtctccagctttccagctcacctggaagatccttagacttgcgaggttctgtgattacctgagacaattccttacaatgaacctttttatagagatggagtttttggtgtgtgtgtgtgtgtgtgtgtgtgtgtgtgtgtgtatttacatatacacatacacgtgtatcctatttgttctatttctctgaagaaccctgactaatacaggtgttgtgtaccagacttccccactatgagaatgccttttcccttggcaattagtatttttgtggaggtactttgaaatataaatgccttctcctaatcagatctcacatttatttctttatgtacttatatcggtatggattaaaagtgtcctattttatttaaggtgtaataatccattctcgcttctattttttcacactgaagcccacattgttccagatttaacccatgggagccccttccagcaggtgtctgtgtcctttcattatggtgctatcatttcgtgagtgtcttcctgctttctggcagtaaatgttgttccaaaatcatcttgtattttcccaacttggaatataataagcccattcttcaaggtcctcccagtagatgcccgagggactacatgcacatctgtgtgtagatgaataacatacttattcacaacaatacttaatttgctacttttaaatatgaaagaccgtgaattcacacaagtacttccaatgccaacccaatgtcatagggttcattccagtcttcctctttgacataatttgactctcttttccaactggaaaaatcctggctcccattgtctttgatatacttatttatatacttaacccccagttataagcaatttcttgtcactactgctgccatctctccatgtctggataccctccaaacctaactcaggcactgacctccccactgcaggaaactccccctactgcagggacgctgtcttcactaacacttcatatcaagccattctcacttgagaaagcctcttcacctgctcagactctgatacgctgtgtgggctgcccccattccttggttgccctaaaccccactggctctctgattttccatgcctggctaattctctatataactgtgcctattctgctgtgtgtcacctactgagttttcatttcaacaattacattttattttaagcttgtttttttttttttaacagtctatcctcctttaaacatttcatgtacttaatagtctgtatctgatcattccaatttcactggagtctgtaaattttgtttattgtttgtactcactctcacttgtcgtattccttcaatttttttttctttttggttggttttttttttcttttttaaatcttaacctgtaaaaatcccaattgtctaaattgagagtgctttctctagaaagaaatttctattttattctgctcggagctgggggcactgccaacaatctagtcaactcctgtatgacttattttgatttgatagcagaaacctgggactcaccttagagttctcctatccccttatctcccacatccaattactcaattcatccaactccacttcctaaaatcctcccatccagtaacctaaagcaaccctctattgctcaccttccacaatgctaaagactgatgtaaaaataaaccttaccctgtgattgccatgcccaaaattcttaaaaggctttaggtaaaatttataccctttggattgtcaaaaacatgatgacttaatcttttcttgtctgcgtatctagccacctatcatgccacttcctttagccttcacctcctcttttttttttttttttttttttttttttttttttttgacagtgtcttgctctgttgcccaggctggagcacagtggtgcaatctcagctcaccgcaacctcagactcccaggttcaagcaattctcgtgcctcagcctcccaagtagctgggactacaggcacatgccaccacaccaggctatttattatttattttattttaagtagagatgaggttttgccatgttaggcagtctggtctggaactcctgacctcaggtaattcacctgccttggcctcccaaagtgttgggattacaggtgtgagccactgtgcctagcctagccttcacctcttgaattgtactctggcaataacagactctgttgttttccaaatgtgccaccatatttctgcacatgcccagggtaacctgtcttctctaactagttcaagtgctggctccactttgaagagtgtatcttatctacaactccatgcagctcatttcactttgcgttatgaatgcttatttgaatgcctgtgtttataatgaagtgcaatttctttaaggtcaggggtcatgtctattcacttgtgcatttccagtttctattaaagattaacatggaataaattctcaagaataatggctgaatccacttccagcatgcaataagcaattactgctggcatttgtacaagtacacagtggtggaaattcagtcatatgtacatttctatcaactattactaaagcagaagtattatgaaacagttaaaaaatatacatgggttatgattatccctgttcattgaaacagtcctggaaaaacattttttatcaggttgtaaacactcactttaaaaattaataaaaagttaatataaagtctagaaatttaaattccatgggatagtgctaatgacaaaatagtagtagaccctaaattgtgaatttcaattttgaatttcaaattttgttttgtgttttatttttttgagacggagtctcgctctgtcgcccaggctggagtgcagtggcgcgatctcggctcactacaagctccgcctcccgggttcacgccattctcctgcctcggcctcccgagtagctgggactacaggcgcccgccaccacgcccggctaattttttgtagtttttagtagggatggggtttcaccgtgttggccaggatggtctccatctcctgacctcgtgatccgcccacctcggcctcccaaagtgctgagattacaggcgtgagccaccgtgcccggcctcaaattttgaatttcaaaatttagggtctactactatgattgtcacgagatatagtccaaatttcattcctacaaatatgtgtgcagacacacacacacacacacacacacagattttatctggatatcctctagttgctttaattctttctaaatagtcatctaaatcctgatgaagcaggagataggtttagtgatggtttcaatggaatgctatcgaaaattttcattttgtttttttttcacatcagaatcaataaatgttagccaactctcctgcttaatcgtcccattgagaatatattttatttcttagtgtctgtgcctaatatagcctgtttatatgaccacactagaagcttgagatctagtcctacttattatttcttcatttagatgtatttccagtaaacgtaattaaattcaagctctcagatatttctttcattaaccatttattctccctttctgttatcagatacagattcagcaattaatttcctgattaataacaattgctatgaaagcatcattcagtccactaagttgctgtgtttctagaagatttgattcaaaggtttgttcttatttctggcttcaatatccattgttaagtcttgccctagggtagaccacaagagatttagagcaactaaactatactaaattggttataattcaatgtagtttaatatacaaggaaatggataatctatttaccatccaactcaaaagaagaaagaaaaagagagtgagagtgcaggtcattttataggaaaggaatgtttttaagaacctatcaaagattctctcagtcagtagatagatggtatgcaaaactctgcttgataaaaacattgcaaaagtgtttttgtactttttttgagtttacatctcaaaacctgctcactttcgggtgtggtggcttacgcctataatctcagcactttgggaggctgaggtgggtggatcacaaggtcaggagttcgagaccagcctgaccaacatggtgaaatcccgtctctactaaaaaaaaaatacaaaattagctgggtgtgttgccggtcacctgcaataccagctactcaggaggctgaggcaggagaatcacttgaacccaggagacgggggttgcagtgagctgagattgcgccactgcactccagcctgggcaatagagcgagactccgtttccaaaaaaaaaaaaaaaaaggacactttattggtacgcattcatgactgtgcatacatacttaaagttaataaccactctaatgggcatagaaactttctgaaaataatgactatattatgaaggacaaatacagtacagtttaaggaatcttgcttaataaatatttaagggtttcattgccatttctagaagttaaacagaacaaaacacattgtaaattctaaactattcctgcaacatgattttccatgaatctacaacataccgtattcattttatagatatcatcatcctcttttcagtaattgaaagtattttccacaatactgagtcaagtggcgatatgaatatgacaggtgtgagctccaagtcgtaatgcatctttttcatatataatattttttatttcaaagtttttggggtacaagtggcttttggtaacatggatgaattatacagcagtgaattatgagattttggtgtatccatcctgcaagtagtgtacattatttcatctttgccacttcctagccaagtgattttggaaaagctgataaactttttatgcctcatttttttaatccatagaacgaggacaaccatagtatttagcctggcaacatagcaagatgccgtctctacaaaaaaaacatgaaaaacaaatcagctgagtgtcatggcatgcgcctctcgttcctgctactcaggggcctgaggcaggaggatagcttgaaccctggagagttcaaggctgcagtgagctatgattgtgccaccgcactccagcttgggtgatagatggagaccctgtctctaataaaaagaaaatgcatagtatttattttataatgtcgtggcaatgagcaaatacaggtaaaccagtcacagtaaaatctcaataaacaaggtgattagctcactacacatctacataaaacataataaaacaaaacaactttatttcctattttccttcccaagctccaggcgtttcacttccaattttggagtgaacaattaagttaattacttactgtgatttcacattacctacgtttgactcagctgtctatctccatagcctctgtggtgttcgagttccctcagtgtgtcacctttctcattgtcttaggagttttcactgcaggagactctgcagttacggagcccacagcactgagtaggtctcagccaatgtttggtttggccagcagcagagtactgacatcatgtttattatcccaacctcactttgtttaattacatatttgtaaaagaaaacaaatactgaagatatatataaaaattctgtgtcgaagggcattatttctacattatgactcctttcatttaaacatacagacatttggtaccaaaaagaaaatatatttgagccttttggattcatttatttgggggtgaggtgggacacttttatttcagtgtcatctgttttctcgattttgtaaaactaaatggttccatgtttatttgtatggttgaataaacatcataatgcaggtgcaatgcccagtttcaggcagtagagcatctgtacttaaaagaccatcagatttgtattaagctgttgaaatttgactgcatagttaggatcagacgttgcttcaaggtacaagaatgaagcaagtcaatctttaacaacgtttctctctgtcatggaggcagctactgtctttaagagcaaggacaaacacaattttcactttgttagaattctgggtcattctccctgagctctttatatcaaagcaatggcatctctggtcctagatacaagctctaattgtttctccttttagaaaatcatttttctctgccgggcgcggtgcctcttgcctgtaatgccagcactttgggaggctgaggcaggtggatcagttgaggtcaggagttccagaccagcctggccaagatggtgaaacctcatctctactaaaaatacaaaaattacctgggcgtggttgcatgcgcctgtaatcccagctactcaggaggctaaggcaggagaatctcttgaacccaggaggtggagcttgaagtgagccgagatcgtgccattgcactccagcctgggtgacagagcaagactccgtctcaaaaaaaggaaaaaaaaaaaaaaaaaaaagaaattgttttgctcttttcttccctattcttaggcttctgaactttttttgttgttgttgctctctatccttgcaactcctcatttcaatgttgaaacaactgagaggtgaagtcttcgtaaatataatctagaattgctagataaaataagaggcccagttaaatttgagtttcagataacaaatgatgttttagtgtaagtatggcccatgcaattcaaatttgacttggtgtactgtgtttttatttgctaaatctggcaagcctaatctcatatctagttattgaaacacgtttataaagcagaatgatgtataaaaaaatctgagttcaaatatgttcacttttatttcttcgcaccatgcaaaactgccgactgtcctcttggatttgaatttccttcttttcctgattttttcatcgctttgtaaatgtttttctttgactttctctcctccttacaatgcaatcgactttatcattgtttcttcagtgtcctgattcttttattctacctcaacatctttatttccccattcattcttctttgtgaaaaaagaattccaaaatgcttattacctcagtattttctctgacacaagtttgttaagaaatactcaaatttttaatacaggtctttgttctactgaaaaacatttcctttgccaagtttagactacattaaggacaaatatcattgctgtagtccatgcacccagaactctgtaataaatagtagtacccgcttcttctttacatgtgtccagttctgtaacttctatttgggaatttttgtttaattataatccatgtgtatattccttgaaatctgtggtagtatgacagaaaacgagtcttcatttggctggtagattctctagcctttcccttttcagattattttgcatcttattgccagctttttaaaaactggtaccccgatcgttttgctgcctgtacctcaaagttttccttatcgctcttttgatcaaatataaactttaaattcttccatttattatttcttctttgactcgcaatataccccattctaatttggaactatttaaaaataaggctgctaactagaagtctctgcacatttctctacccatcccaaaagtttggtccactctaccttcctcctaagtaaaaagttaacaattctcctttccttaccattaactttttaaaatcacttatgagacactgactttgatcaacccattgatcttttttcaggctaccattcttatgtactttaacatgttttgatgaatttgtggtcattataagtattgaatgttgtattccacactatgctttgcatttttttttttttttttttttttttttttgagagggagtcttgttctgtcgccaggctggagtgcagtggtgcgatcctagctcactgcaacctccgtctcctggtttcaagtgattcccgtgcctcagcctcccaagagctgggactacaggggcccaccaccacgcccggctaatttttttgtattttggtagagatggggtttcaccatgttggccaggctggtctcgatctcctgacctcatgatccacctgccctggactcccaaagtgttgggattacaggtgtgagccaccgcacccggcctgctttgcttttttaaatgttgcaaattagaattcttttggttatcttatctaattttctatttttatgttatgtgtcagatagtctggacttacaggaagacctgtcctcttccagcacgcacccttcctcctcccccatcattcccaattcacatgactttctaactttctaattgggtgctttttaatattcatgagcacaggttttaggtcacacagctttttataattatgggaaaagtaaaggtaaatagtgggtgggtactcaaggagctcacctacaaatcaacttgattcaatctatttaatctattgcttatgttctgatttttcatcagtgtcctggtcattgcttaacaatgcaaaatttgtggataaaaatattcatgttaggtgaagctcactgactagcctacaaatcagtgtcaccaattttgatacattttatccacatctccattatctggttaacatatcattttgcaaaatattaaaagatcttcaggtcacaaagggctgtcatgaacaaagtttcttctttttttaaataaactgaacagtgttactatctagttggcaccaaggacacactaaaattgtaatttataattatggggtttttcctcacagaaataaaaataaataggtcttattgaagacatagacagttttgcttctgtgaagatttctcctttacacataatcagtctgacttttctcactcgtttctgcctgaggtggaggtggggactccattcttgacttaataaatctaaattcttcaactgtcattctctcccaagacacttcaccctttggggactatgctgcattttcccattcttgctctttgtacatttcatcctgggtctggcaagacctatttcaaatatacaaagttatctgatacacacaggaacccaacctactctccacagagtgtggaagggttaaagaaaagccacttctgaacatctccgctttatcagctcccgttgggagatcaggggccagcagccttcattagccaataaaaagaaaatgacgtttctttgcaaggagtagactttactaagcaccctatatgttaaaaaaatatatattaaatgttagtttttgtctccaaaatagatatataattctcagatttccttgtaattttctcttaatggctgattaaatcttgacaatataaagcagtccagtcatccacccattcactggacaaatatttcttccatgtaaatgccaggcaccagtttaggtcctgatgatacaccaatgaacaagaaagatgaagtgatgatccaccaggaacttacattttagtgggagagatacacataacaaataggtagatgatatgataagcagggtaagtagatggagagcagatttttaagacttctgtgagctaagacctgattgaagagaggttgtaattttgtggtgtcagcatgatcaggccaagtaatcacttcctattgcccatatattttttaatcatttgtttaaaaatataatgcaaagagatagttctcagactgttttctcatatagaagatacttatttcttagattcttagtactactcattttaataagctatatgagtccacaacattaaaaaatttactctagaaagtaaagctgggtaaagtgacctcagtgtagaaaacttttattatatggccacaaaaggcactgaaaacgaaatttctagagggccttaggggattaaaagggaaatgtttagaagacattaaacctctggaggtttaattttgcaacttccccaaatacttagacgacttcaaaaataattttgcttttgtctaaactcagaaattatattgttcttttttgcccttgctggccctcagaagagtattaattctcattttgggaaggaattattttaatcatgccattaaatgagaggaaaatatcccttttctaaaaaaataaaaaattaaaaataaaaacctcggtgtaaagtggaattctctagagaatgcattgtgcacaaaatgaccttcctcagtgtattactgggatggagggagtcgtctctctgtggggtagcaaataagccctgtggccccctcaatccacctcagcctccacagagcatcagttgctgtttcatcccgggttggtccagacagccactgccagtccactagagggagcacttgagaggaaacccatttgctttcattgatctagatctcaaataaaatttcatcttagaggctgggcgcggtggctcatgcctgtaatcttagcacgtcgggaggccaaggtgggtggagcacgaggtcaggagttcaagaccagcctggccaacctggttgaaacccccatctctactaaaaatacaaaagttagcgtggcatgttggcagtaagctgagatcatgccactgcactccagcctaggcaaaagagtaagactctgtctcaaaaaaaaaaaaaaaaaaaaaaaatttcattgtagaataaaatccaattcctttcagcttttatcttcaaattttggtcattgtttgcattagtcattgttcttcaggaaaacagaaccaataggatatatgtatctgtgtgtgtgtatacacatatatatgcacacatgtatatatttatatatacaaatatatgcatgcatatatatttacatatacacatatttacaattctgtaaaatcttatatataaataagactcacacatacacatataacgtgcatatatatatacacatatatatggcatatatatatatacatatatatggcatatatatatatacacacatatatatggcatatatatgagatttattttaaagaagtgactcatgtaattatggcagatagcatatccaaaatttgcaggtgggccagcacgttggaggcccagggaagaaagactactgcaaatcaaatctgaaggcttgtctgctcactaaatatcctcttgcctggggaggtcaacctttggttctgttcaggccttcagctgattggatgaactctcctccctctaccctcacctcaataagaaggatgtcttagtttctccaggcttctataacaaaatagcatgcaacagaaatgtatttctcacagttctagaggctgggcagtccaagctgctggcagattcagtgtctggtgaggtcccatttcttggttagtagagagttgtctttttgctgtgtcctcatacgatggaagaggcaagccaattctctgggcctctaagggcattaattacactcatgagggttctgttctcataatctaatcgcctcccaagagtcctgcctcctaatatcacattagtgactaggcttccacatatgaattttagaggtacgcaaacattcagatcatagcagaaggtgatttgctttactaaaaatcagcaacttaaatgtaaatctcatcctaaaataacctcacagaaatatccagagtgatgtctgaccaccatggcctaaccaagttacaagataaaatcaaacatcatgctgtttctgtatagtgacactaaaaatagttgctaaaaacttgtatgacaaaatagaaaaatgaaagaaaggcaaattattttggaaagttacagtaaagaacataatctaaacccaacaaaaaagtttctgagactcaatcactgaacagagttggaagaagcttttattcacttcattccactgtatttaacaagtctctacttcagtccctgtggggtttctaatattataaaaagtaatatcataggttataaagatttagaaagagtgcttctatttttgaaatcaataatccagctaggacatattttctagatattattataacatttttacattaaagataatttcttgttatttgaattttatttcccctctcctcggggttcttagtaatacaaatgagtaaaattgctttcagtaggatgctagacacattgtactgtttgcaggtctgctaaacaacagaatcaagtcacctccttggcaggtgaccagcattaactataatgcccatcaaaacagtcaataagaatcacagatctgtggcaccatagaataatggcctaattaatctctgttcaatttccatttttatacctgctcccagattcccattatttcttatctatgagttcttttctcatttgaaaacatcttctatggattttccttcattcaatcagttgtttttacattcattcatgtttgcattcaaagatatttactaagaacttagtataggttatacatttatgaatattattcaaacactgaagataaagattgactgattaccacagtggacagagatacattgctgttaaaaaaatctgagtcctttaaaagttttttgtttatcatttgcaagagtatatggaatactgaagtttcttctaataatatcaaaggaatagttaaaatgccatagggactaaatgttacatatgtaaagtaacatagccatctggtctgtttcattcttatttccttaggagaagagtgttaagcatgctctaaaacatttattgagggcacgttttatgcttacgtttaggttcagttttaggtatatagaaattttaaaaggaaaaggaaaaaaatttttaaaaaaaggtataaggggatgataaagaggaggccagaaagaaaagaaaatacagtttctctcctttcaattccttaccattactttaccattcttgtgtggaagtgggagggcgtatccacagaggggtagaaataggcaaataccacataaaagggataattgcaggttggataaccgcacacattggaaccaaaactgcttccgaaaaggttataggatttagatagtgccaaagactaagtctgaaacacatttaaaatagttgtttatttacaaaatttggcacaggtccccgtctattgctacttttctgtcaacagaggtttaaagtttttagcagtgaaagttttatatagttaaaagagactgagacaatctctggaaagcattttattaccatgggattcccttttttgtgtgtggaagtgggagacctcctaattggtgttcaggtacacttcgcagtcttggttgagtgcaaggaggcaagtgagcagcatggagacattcaaagacaggaggattgtcctgggttagggtcagtggtattttctccatccagctattttctgtaacaaaagggtttgatgagttacttttcttgtgaccaaactctcttaatagtcccttatggggccggtggctgtcatggcagtttgtcattagtaaagaagttgagactactctagtttggcaaacaatatgaataaagtgacaaggtgatgatgagcatgcccatagtcttgctatttaaacaatgattattaggccactccagtgaaagataatgagaaatagaacttctgcttacagaagatgaattttgaatgcctaaggtttaaatttagatttgatgggatagaactttgcatattatttacatggttttgaaaacaggcatgaagagagaacaaggttgtaaggagcttaggacagaagagaccaagctgtcttataattgagtcaggacgaagcacaggaatgttactttgaatcaatgctggccttaatggtccactgatctatgggagaagaaaaaaaacttgatatttaagcattggtggaaaacacacacacacatacaaaatttctgaataccagagactgagggaaatttgtacccaacctaattagttgaaaatacaaagcaagtttcatcaatatagcttgtatagggttaagaaaaatacttaagcattacatgattgctgtaggagcccattttttggaaaatttccagggactctttgagtcaacttgttaaaaacagaagaaaggctaggaaagaaatagcttgttttatgcctgtgattataggatttcatcattatgtgggccactgagtgttattttctcaagttcatgcatatgcagagatttaaactaaatttgtgttctactcaccacgttaagaggcacaagttatcaaagttactaccaatacattctattcccccgaaagacattcaaaccataattctctcaagttaaaaaaattaatattttgtaaagtaaccattgtccctcttctcaatataatccaagtgctaacacctttgaacacaccaacaatggtctcttgattaaaaagaaaccacattaggaaagtcctttgaataacataaattgtctcctataataaaggaagacattggaggtaaaaaaaaaaaaaaaaaaaaaggtttcagcaccaatcttcaatctctctctcacaccacagaagattcagagctggagttgggaaatgcagtggacttgggtaaactgaggttttcagtcttcatactagtcagaggtcataattgattgagtccagttgtgatataactttgggcagtaattttagtcaattgcttcctaccaaagttccgtgctctttgctggaggctccgtttctgaaaagctctccctctgcccttctttctttttctctgcacacacaaccctcacgcagctttcatgctgcctaaatcagcctgtggattaggtattttctcattatccagattaaaagacagctcagtctcacagagatgtaactgactatttgattgaaactgacttttttccccattggaggcacatcagaatcacctggaaactttaaaaattctaataccagaccatagccttccaattctgattgcgtggatctgaatggggtagttccctggtcttactcttcacaagctccccatgtgatgttaacatcagccagcagaggctgcgaacacccataaaaacaaatccagatatgttaatagatgttagggaaagtgggagaagagggggtggtggatttgcaaatgttaaacttgttacccaaataacctctccaagtaaaacttttggaaggatagttttgatcaagagaacctgcccctttttggatctctttcacctgcaaggagaaaaaaagtgagaaaaggaatcagctttttataataaaaaaaatgcagatggagattccgaagtggctcttcagcgtgaggatcgaatttttacagggaaattccctctgaaatccttctagaaattcctgctatatcatctcccacttacataatcattgccccttatccactaagcaccccccacccccccatctgacagtcttgtcaacctcatgtgtctggattctcagtcttagtacagtccctctttcgggggagggagagctttggagtttggaggagaaggaggaaaagtgtgtgtctggcctgaaggtgatgatctaaaagaagtttccactgaagaaacacatctgggtgtttcacaatgtggctccttgtatcatctacatcacttggaaacttgttagtaatgcagattctcagacctcaccctggacttacaaaatcagcaatgaggggctccggctgagcagtctgtccgagcaagtcctccaggtgattctggtgaattccagtgcaggctaaagtttgagaactactggctatctcatgttttctcttgagcttctcttaccaaccttgggttgctttgttcctgtttgttttatagagcttttctttatagagcacccttggcataagtagctccatcttagaaaaagactccatcttacattttaaaagccatcatgccaacagggaccaggtgttcggctaaccaatagagactgcacccaaccagataaggacataatcattcacaccctttcactattagtcctcgctagaggactctgtggccataaaaaagagcaggatttcaccaattggaaactgctgtcttagcagacaccatctttctgtcccttgtgataagtacccagcatcccctgccgaagactctgcccacattaaaatctcttccttgcaagaccctgatggaccacctggatcaggacgaggcattgtttggtccacattgctctctctgaactggtttgttaacccttttttcctatctcctttatcttgatgttaaatgttactttgttgtggaatgtttagtcaaaacagataggtaggtaggtaggtaggtaggtaggttatgtgtggtttgcaatattgtctgacctgtggagtgacttgagcttgtgtgcctatggctctgccaagtgaatgggtagcactaaagagaattacctcctctggagcttcaggtagctcatggctttgatgattgaaatagcattggtgaaagtctgacattatggaaagacacaaatatttgtggacttggtcatgtctgactgtgcactgctcatgataccttcctattacttcgcctagagcctgaatgggaaagggagaggcaagcaactgaccaactagcaaacaaataaaatgaacctactgtgaacagaaaaactatttctgcccatagtagtggcttattgcagatacttatcttcagtttaaagttatctttgagtctctatgtttgtagctggaaagatgcagatgttttaaatcaagaaagttggacaagtttgttcctaatattccttccaagtttaattcaatggatatatgagtttggggattaataaaaaaaaacagcaaggagtaagaatctttgggaatataggaaaaagtgctgtattcaactgggaaatatctacatatttaaagacaacttctcagagaagatgattataagcccacattatgttttatttcaaacgtgctgttggatgaaaagttgctgaataagctgaattcaagattctcccctaggtagaaacatttgggtgaggggtggtggggagaggtcatacaatgaagaattgtctggttaaagattaggctacttgtaagatggattaaagatgtaggcaagtttcaaaactgatagtcagctgagtggatcttcccagaaaggatctttaagtatcatgagagtttatcagaaaattgctcaagtgttttattaggaattctaattattttcaggaagggctgtgaattacatcttgcaaaaaagctctgtctcccaacaggtttggtgacatttattttttctcagtttctagtctcatctcttctcacattttatcttttgttcacttttagtaagtaattttaacttcctggatttcaattgcttcctctataaagcagggataataatttcataccataatgaaataataaggctagaaaaataatttttcttttagactgttccaagttttgtaactgactaatctaaattatgcattggggggaaggtgatatgagatgtgcttttcagtccttggattcgatactaattataataccaaactcatggtagattgatttattctgtcacatatctatcaaacatttgcagtttctgctgttatgtatgctttatgcattttacaaaaaatcatcccaattacacaattactctatgatgtaggtacaagaattatccccattttatagatgataaacctgagacactgaaagtttaaatagctagcttacactcaacagtgtggtatgtggtttgtggcagaggctggatctgaactcaggaagcctgcctcttgtgttcaacaaacaattcactagttgatatcctgtcattccacttgattctccaaaaataaggttgggccttgtcaaggatcaaatgaagactggtaatcctaaagaagttgaacttcagagagcctcagtgggagagaataacatgcctagtccaggtcgttaaaacttagattattttcttacatagtattggctactgcccgttctgatgcttgtacatttctgttacggtcctcggtctctggattgaaccttatccactagattggagcataggcactgtgattcaccatgttattctggaatctaatatagaaaatgacccagaagcaccatttttaacaaacctgggttccctagccacgtagaagcatcagccagatccagctggagccaatcctgctgattagcttaacaggttctctgttttttttttttttttttttagaaaaagataaaatgttacaagatagaacatcgtcttattgcttcttttgttttattgcccctgccattttcttagagcattaaaaagaaatcactttctcagatggtatgaggatgaaaggatccacattgggaacaggaaaccaaagatctctgaagattttgaaagcagagaaagaataaccaggtgtacataatgataactaggaaatacaaaaccgctgtgagcaaaactgtttcttccagtttgggaggctccaaagtgaatcccgtgatcttagacacagagatcaggttaaaagagcctttcttccaggcagcctgctgctgcatgatgctcatcattccacatcctgaacaatcctcaggcttcaggctggacgagtggtctctaggtaccactgtgtacttaagagtgccattttctgagtgcatcttctgtgccaagcactgtgctgacatagtatcttattggcaactcttaatcttctatggcatcagtcttattcctattttagtgacaagggccctcttttgtaagtaacttcctccagccccacagtaagtgcgaaaaatgggattcattcctctgactctttgaatccaacccagtgcttgggtgtcttcaagtatctctgaattcctgacctctgggattcagtgatttttatggcattcatgtgatttctgtggtgagttccctccacccccaactccacagggcctgtctgtgaaaatgaaagataccagtcagggtgcaagacacagtctgttctcatggagtcagtgaaaacttcattgtatttgaaagaccctctgatcaccagaaggtcattcttgctcgccttttccttgactataaggttctataagttttttcgtaatgccacttacaataatacagtatttacaattacatcagaatgacaaaaacacagtttacaggagttagcacctccaaagcatgacaataataggaaaaatgtatcaccaagtactagtataaaaataaaattctctataaccaataatgttgaatcagagagccattttgaactaaagaagtttttgattcccttgtgttaactttaaacaaacttttttggttgattttttttttctattcattccttctgtataagaaataatggagaaatgtgttaaacttttagttaaatgtgtgtcaaagtttaatataaccatatggtttttcctagttttggttatatatgggaaataacatttgattcactcgaataactttacagttgaccgggcttgcttatgttggtgaatgtatttaagctcattcaaaacatacagcttgacatcttagaatctgaggaatgactttaggcaacagttaagccaatttttaaaattctcattgggggcactgaattgaaacgctgtaatcttctctagaactatcttctatttcgtgtttcagcaaagacttaattgttctttgaagaatttcttactctaaaaatcgtagcaatttatattccaaagaaatacaattatcttgctcagaaaagagaagaaatgtagaattgcctttatttctaagttataattgcaatcatgtattggcagcacatgtgaacaacttagatataaaattatgatggggaaaaaacctgcagcaagaagcaaagtgtgcatagataatgatcctctgccaagtaaaatgagttctatttatgtatttgtttaggcatattaagtgtctagagcagcagtaatgtgaactttacctttttggttgtttacctttttcaacacctatcaatgctgtattggtaaatattacatacacacacacacacaaacacacacagtcttgctctatccccaaggctgaagtgcagtagtggaatctcaactcactgcaacctccacctccagggttcaagcaaacttcccacctcagcctcccaattagatgggactacaggtgcatgccactacggctgactaatttctgtatttttggtagagacagggtttcaccatgttgaccaggctggtctcgaactcctgacctcgagtgatctgcccgccttggcctcccaaagtgctgggattacaggtgtgagccaccatgcccggccaaatattatatgttgtacgcattgggtactatgtattttaaagtcaattatgtttaactttgctcttattctataattttgcacctctggaggtaaagttaccatgccatataaaaaaaatggagataaaagtaatacattttacgataaaaccactcttccttttgtttttatataaataataggtagaggtctctgtacatattttatttctatgtttgtttgtttatttgtttatttattgagccttcgtcacccaggctggagtacagtagtgcaatctccagctcactgcaacctctgctttctgggttcaagggattctcattcctcagccaccagaatagctaagattacaggtgcacaccaccctgcccagctaactttttttgtatttttagtagagacaggatttcactacattggccaggctggtctcgaactcctcacctcaaggaatccccctgccttggcctcctgaagtgctgggattacaggtgtaagccaccacagctagcccatattttagtaaggaaaatgatgggtggcatgggactttgaaaactaagacgatatacttagtgttttaaaataagattttgttactgatataaaccacattgaagtgaggaagactgggtcatagtccagcaaagattgcaccttattttcttaacacgctaaagtgacaggccctatggttggtggggaagaaaggccttgtgacctagagggagaaaatgagatctttcgattcccagagtgagagagaaagatggacactgtctttagattataaaattcaaaaagcctaccgaaggggtgttgagagctacacttgaagggggctctgtattcatttagggacatttaacattacagctttctgtcatgttagcataggtcactaggtgtaaaaatggcatgataagcaatatgcgggtgttaaatgtaggagcagtatgcaagagtatacaggatagaaaaagccccttgagtccagaaagcaggcttgagtcaagagtgatagcctggactaagtggtattaaagagaataaagaggtagaacaatagaaaatagctcccaaagaaaaactaggcatacttcataaaattacagaagcagggaacaggatgacaaatgtgatctacatttgaaacctgaggactaacatgtgaagttgcctctgaagagatggtaagggaacctgtctgtgtgaggggagtggtggggaacaggacagttaatggacgcattgaacttggtgtcatctgcgtaattcaaagaaaacatgtagtggtgggtggaggaagatttggatataataagttgagtcacaggactgacgttgagtgaaggctccaggaaaaaaaaaatactaggactgacattttactgataatttacaattcttaagggggaaaaagagaaaaaaaatcaagcatagaaacaaaggaataataataggtattaggagaaaaaagaaacacgtggactaagtgagagaattttatgaaagaagggatgctgataggtttttgacaaaacgcttgggcatcaagagaatgaaaaggctttggtttgggggaaaaagtctcattggtggcttttgagaattcagttttagtagagagatggagttgttttaagaggaagtaaatggctaattgtagaagtgagctagggcaatgcccatcaggcagtctcttgaggtccagtgaaacattgaggtttagaaggcaattattgatcacattcagaatcagcttacacagaagtctgttgaacaggaagcaagtctgccaagcagggcaacatcgagtaattcctttcaaagggaatccttgcagcggcccactcagcaatctaatcagataacctaggagcactcctttggggctccaggtaacagctcaggtgcaaggagacgaaatgcacagtgggtgtgtgcaggaccttctgccataatagcctccttctaacaaggggtattcctctcataaacattccttaggcacaaaacacaccaagttacaatacttaccacatgtatggaactccaaaactacggtaccgccatcaggcattcataatttactggtatttctccaattcaagtacaatttattttttaaaatgacgctaggaaattgggagtccacagatcagcatgagcatgaataagggaccctctgtgtgaaggaagttaaggatcttttcacatggagggtgataatgaaaactttaagtgagatgactcactatagaatccaggcttcatgaaaaatatggaacttgggaaaatgtaataggttgagtgactagatcgatagtggaggttcagaggcagatggagagaggcaacagaacagattgcatcgtttcagtattgaacaaagtcttaagtacataatgagtgcaaatatttgtttgattaaaatgagtgcaaatgggagcaccaagttcaacatcttagtgtttagatgggtgacatacaaggatgatgatggtttgctaaagaagtaaataagtacaaataaaaacaatatagagacagagacgttcaaagtaatagatggcaagaaaccacaggaaatgcaaccctgttggtgaaatcactcaatcatcatggaacagtcttgagtaaaaatgaaattggttattaagtgaatttgtttttttattttatttttaaattattttttaattgatgcatagtggtacatattcatagagtacatggtgatatttcaacacatataatgtttggtgatcagatcagagtaattagcatatccagcatctgaaacatttattatttctttgcattaggagcattcaatatcttccttctagcaacttgaaactatataacaataaatatatattaactggactatctccattaatgctctatgtagccatatcagaagtccttagattttttccttcacatttttttttgcttatttacagcacaagcacgtatgattgcagcaccccctaactgttctcccgtacttgaagaaatgtccagtcccctgaatgaactcacctataactgtatgataccctctaaatccagctataaactataataatcagcttataggtgaaaaagagtcgaagatcaggggtgcaaatgaacatcgagatgatccaatgtaaactctgttttgttgatgcggaaactgaggcctggagagttaagtgacctcctaaacttgcagttcttggtaacagttgtgaacatgaattccacgtctagtgctctagactaacccatgctgtcttcaataattccagtgaaaaagcatagcagtttagtcctcccaacaccaatgcatgttcccacattcccttttctcaatctggattgttttttcctggatgagtcatatgtttctttatcaaattctaaagcttcagagtgaaagcagaggcacagccatcctatatgaataaagcagatggaagtatgggatggtttcatatggaagtctacaggtacaagtcacataactatattttaagtcagcatcttgtaatagcttccttccagtgtgcgttatgggttgtagcatgttgtggtcagaagacatgtatttaagtctgttctctctagtttatcaggtacctggctgtaggcatattcacttaacttctctgggtatcagttgaaagatcattatatctaactgtcagaatagttttgaggatgacataaggttaaaatgtataaaatcatgagacattttcctcagtacatttgttttctctttttacttttcctccaattctgctatcaaagctctggaatgtattaccaatacatctgtcatctgttaatattaatgggtcttctgtttccttaaaatacctcgataatgtataaataggaaaaatattactttatatgacaatgacatcaagaaaaagggagaaaaataagatctgagttttctaaaagaaaaatattaaataaacaatatttttaagatatatgaattcttcagagaagacaatgtttacacagggtgaaattcaaacgtaattttctgctgaacaactgtatatggaggacatttatggcaaatacaaagcagtgtttatatcatttgcatgtgtgtgtttctttgttcttaaaaaggtttcagtgaaagacaagagcatcgtcttaaaagtgaatctcaaaggttgaggctgttttgttcaaaggagtagacttcctgaggtttatgacaaatcaatgcgagggtcaaatttaaaacacctagagaagtagagaatgctgtattctttatattatccaaactattcaattaggtttttggaaaaagattgataacataaattctaggttatataggttatctccctaaatctgaataaaattctgagagtgtttagtgcttatagctgtaactgagtacattttccactatccctccctccccacaaaaggatagattggtcattgggtcagtcttgttggagacgactggcaagtcaaatggttttggaaagtaaagtggatttccgaacagaaaatgtttttccgcggaaactatggaagagatcaaggacgaaggcaaactaaaccttgaagatgaggaacggtagtgagccatatctaacaaaagctttactattcatggcttcctagtttgcaacttaacgtgaagtttgttcacatagatctgagaaaataatacctaattattgtgaaagaggacttaagagggattctttagcatggttcaggtggggctttaataagtaaaggcaaaaatatttttgtttcaggtctctaagatacatttcatgtaaaagtccataatataaaatgcaagcctatacctctgagtcaaagattcaaaagcacttttaatattatggggaaaaatttttttaaaaagccttgtagattatcttcaagggtttgaaattaattccaagcattcattagaggacaggaaaagtctgaaaatattatagtatgcatgagatgacaaatggaaattaaatgtgtactatccacactataatatttcagagaatatgaaaattaatagtgataccacagaacctgtataatttttttcctccgtgattttgtagggaatatggaattctgtgagaagaccttgtagttctcatattgtacaatgttctttgaaagcaggtgcgtatgccttgagttgtggtctcctaattatttagttgagaggtgtaaccaatggactcacctgtgtgaaaggatattggctctttatggacgcggaaattcaatgatagtgattctcaaaatgtggttcctggaccagctgcatcagtattactttacaacttgccaaaaggtaaatacttggcactcactccagaacaactgaattagaagctccaacaatcagcgttataatatgttttccagagaattccattgcagctaagttttaaaaactgtagtctctggcaaaatccgaggcacaaccagacacatctctgtccacattttacagtctctggcaattcatactgaaccacttgtaataaacatgttattcggggttcatcctaatattatgcttctagcttttgaatgatttattaaaaatatagctagtaatgcccttctaatttatcagcaatgtatccttttggtcacccattaaatcacatgagaaatgtttaaattcctgttactctggcagtggattgaaatccaggcaccgccaggttaaaggttccttgggtgattccaatgtgcagctacattttgggactacttccttactaagcaaatttctcagcttgattatgcataaaaattaccagttcaccttctgaaaacacaccctctacccccagagattctgatcagaaggtctaagatagttctaggttgttgcatttctaaatagctccacatacaattctatgttgttcagccagtgctggtaccaatatttggaagctctagagagaaaacctctcggtacttgttcttgtcaagtggtaagggatactttaaaaaaaaaaaaacctaccatgaagaacaactcacctattgcaagtttttgatctgtaggtcagagaagtgaccttttaacacaaatattatttgaatggcgttgtcaggttactttcactggggaaaaaaataaaaaatccatgaatattcagtgatacaaatggttagcagaagacaatgctaaaaatgaagggtattatgacagccaactgttttaaaacttcaagtttggagatctttgttacttagaattttgtaatctgaacaattattctgaaagattttgatggatcattagataggcaagcatctgttcaagtaaaactggttatttgctgacaaagcagaagataattaagaatcataattaactataagctagacataagtcaggattataacacttattataaccatgtataatgataaaatttctcattatattcatctaaagatttttgggtgcttaccgtgagccaggcactgtgttaggaggcaagcaaaagttacaaagaatggatgataatcttttgttataaaatgtagactgttgttcttaggaccacaattcaaagaggaagtgtaagacaaaagttcaagaagggcagtggaagtgaatgtggaacatactgaaggattttacaacacactttgaaacgtttaaaaaacctgcaatgattttacttgaatgcggaaagacagaatgctaaagctcaagcattgaaagagaactaaatacatagggtgtgttacgggctgaactgtgttcccccacaaatcatatgttgaagtcttaacccctggtaccctagaatgtgactgtatttggagacagaggctttaaataagtatctaaaacagggttgttacggtgttctctagttcggtctcactggcatccttaagaggagattaggacacagacacacacagagggaggggtatgaaaggacgcagggaggccgggcctggcgcggtggctcacgcctgtaatctcagcactttgggaggccgaggtgggcggatcacgggttcaggagatcgagaccatcctggctaacacggtgaaaccccgtctccactaaaaatacaaaaaaaattagctgggcgtggtggcgagcgcctgtagtcccagctactcaggaggctgaggcaggagaatggcatgaacccgggaggcggagcttgcagtgagccgagatcgcgccactgcactccagcctgggcgacagacagagcgagactccgtctcaaaaaaagacacagggagaaggtacccaagtacaaggaaagacgactcagaagaacccaaatgtactgacaacttggtcttggacttccagcctccagagttatggggaaataaatatctattgcttaagcacccagtctgtgtattttgctatgacagccccagaaaactaatacagatagtaacttgctgtagacactgtctacagagtaacaaacataggcaattaactgaacatgggaacaagacttagttggccaaaggtggtggtgcttgcctccaatcccagcactttgggaaactgaggcaggtggattgctttggcccaggagtttaagaccagcctgggcaatatggcaaaacctcatctctacaaaaagtgcaaaaggttagccaggcatggtagtgtggtgatacatgcctgtggtcccagctactctaccctgaaggctgaagtgggaggatagcttcagcccgggaagcagaggttgcagtgagctgtgatcatgccgctgtcctccagcctgggtgacagagggagaccctgcctgggagaaaaataaaaattaaaaaaaaaaagtcacttctgactatagggattatctgggagtctgcaaggtcttctaaaaggtgatattttaaatttaaaaagttacctatttttaactcctggtagaagtaaacattgttcttccttgaaaacataaacaaaacaacacgaacatctcagtattgatttgtcatctccttttggaccagatcaaagatctgcctgagataatttgacttatacataatattaaatggtattagagtgaggttacagtatatgatttcagtgtcttttatctcttacatactgtgttctctacccggaaggagtgaagcagactgaggggtcacgtggtcctatagtatagaaatcatatgtagaaattgattcagctctgatgcatacatatggatggataccttgatatttaaatgggacctctgtctcatttctccatctccctaaataattaaaaatcagttcactcttccgggaatcattttgaatgaattgaagagtaatttgcaaagcaagacgtataggggaaagagcatgcatgtgtgtttgagtctatggggacatcgcatttggcatgaggtgctcaggattcagaggactgtcttgcattttcctagcagtcagtggaggccttagcattccaacctaggaagctctatagatgtaagcaatgtgtttgctttatttgactgctatttatatgacagtgacaaacagatatggggtaaacttactgttttgaaaaggtcagacaaaggcaaggaaaatagaagcaaatgaagtgaacgcatgaaaaatgattactcaaagaaagatacaattatgcagagcctgaaatcaactcttggtttaatgttgtgatatgagtctctcaagagaggacagcaatccaaaaccatttccccagagaagcatggaattttacagttagatatttatttattgtgggaagtatttttaaacatctttcaaaatgcaaatacttagtgtcaatgtgtttttagaccctcctctgtgaaagagatacgtagaatggtagaacaaggtaagagtctaaggggaagtgggataaaatttcaggaagtgaggggttgtgaatagtctgaaatggagtatctgagctgcaggaggagcagcagccacttactggtccctgcgggcctgtgcccactagggcatatcaaaccctctgatggagctgctccaggctagcctcgtcaagccatctcccagcctcaggccgaggagatgcctgacggggccagcctggagcagctgcatcagaaccctacagctgttaagaacctttataccagcagccacaataacaccaaggtcacacaagatttcaagcaatggaggatgcagcaagacaggtgatagcatcagtgaaaactttaaatgagctacaaatgttaacagtgttcccctgcttaatttactgttttcctaaacagctatgaactatttgaggtgaagctcaaaaggacatactgaggtccaggaaattgaggtcaagctgcattttccagacagaggtttcaaatcctacatgaggaggaaggttatttacatattaagccttctgcgaagttcaataggtagactcttgagaaggcaagtcttgatttgtagaaagggctccatctcttaggcacctgagacccaggtcacccttagcgttgctcaggttgtacttcagaaggactcccaggtaagggaggagtgagagttaaattctagctcctgacaagcagggctgtgggtacccagaagatggatcactacttctttatatgcacaaagattttttttaattttattgtattttaagttctcggatacatgtgcaggacgtgcaggtttgttacacagataaacgtgtgccatggggcagcagccatcactgtagctccaggccaccattttttcctctgctggtgctggggagactggatggcttggtcccaagaggtagttcctacatttcagcacaccagctgtggaagatcgtggcccaactgcctctttaggacagactctgacccatccctcctcactgagtgggccctccctgcaggaactccagcaactccagccaggggcttagggaccaaactctgatcttcctgggcctgagcccctagtgggaggggcagctgtgatctccgtggatcagtagatttagtctcttctcctgctagctctgaggaatccggacagctcagacgagtgggtttcccccgagcacagcacactccctccaccaaaggacagtcaaagtgctttgttaaatgggtcctggatcccgtgccgccctgactgggtgagacttcccaacagaggtcaccagacaccttatccaggagcattcctactggcatccggtcggtgccccttgaggacagagatcccagaggaaggagcaggaagccatctttgcctccttaggtgacatctccaagtgtgggagggacccaggtgaatagtctgaagtgaacccccagcaaaccacagcacccctacagaggagggacctgactattgaaagaaaaacaaaacaacagcatcaacaaaaaagtccccacaaaaacctcatccaaaggtcagcaacctcaaagatctgaaccagacaaactcatgaagatgagaaagaatcaaccaaaaaaatgctgaacactcaaaaggccagagtgcctcttctccaaacaatcacaatacctctccagcaaggacacagaactgggtggatgatgagatggatgaattaacagatgtaggcttcagaaggtgagtaataactgttgagctaaagaagcatgttctaacccaataccaaaaagctaaggaccacgataaaaggctacaggagctgctaactagaataaccagttgagagagaaacataaaagaccggatggagctgaaaaacatagcacaaagatattttaaatgtaccaagtcatacagccattgagaccacatctttttaagtttttaatttgcaaaaagttgtagaggcagcccctatctccctttgtggtgtatcagcctcagggatcttggcaggtggaccagcattgggatctttcacagcataatttatctccatgcttctggtgctctgagtatctggatggtctgagactattactatgaagaacaaagtcatgataaggtatttctgcagcctaagaaaactgcagcattctgttcactgagaaatttgtgcttccataaaaaatgattttaaaaccctatctattattgcagtgaataaaatgagattttgagcctattgttggatttaatcattatttttatggcagaactggggttgtgggagtagttataaccagttgtgttcttttaatctcttttattaagtcatttatcataagtaaaattcagtttctgaccttggtgctttatttaagtttccaacttatctgtttcttagcatgttttgtgttcccattttaagtctgtaagggttatagaatacttatttcattttctctataagaaactgtttagcaatctaggatagtgttatgattaaatggcaaaaagaagagataatgtcaaaattaaagctacttaacagtaaggggcatggaaggctacatatcaaacccatctacactcaagcttcattttcaataggggattttctatggcctcttggctttcttgcttagcttaatccaagatttctgattatcaggacaagagaagagacaaagggtgaacacaaaaagtcatttagaataaatgtatgtcatatgatagtccaaattaaatgcttttggtattgctgtatccatattcctttaggttacatccattgattctttttacatctatctgcattgcatagccctgtaatacttaaaaaatttcaaacagagtaatgaaaagcatggaaattcaaaagacaacagtgaaagtaatggaaaacagtattaataatgtccagtggttgaatggcaatgagtgatactcaacgattgaggagtgaataagattaattaatttaactttgatggtgatgtcctctcctagaatcttgtttcctttcatgtttttggtacgcatccttcctctctctgatgttctgtttcaaaatttaccctcactattaagcttttcctattatgccaaccaaggttaacacatttttttttttctgaattcctataatagtgctgctatccacgcaactatggacttggtgagggcaggaataagatcagtttgcatcccatcagacccctagcactgttagcatagaattgggattcacttgtttgttgaataaataaatgtctggataaataattgccataaaatttgtacttaattttcatagtactctcataaaactgatatgtgttgagtgtgttttcgattataaaaatcttgaagagaggatcagtgactttcagctcttcattttcctaccctgacaatcctcagttctaactattgagattaacctcatgaagtagagtacaaggtacccaagggaagtctggagtagtccctgtgacatttctggtcttcacagaatggtgtttgtggttgtggtgagaagcagtggaaggttcctcccacacacatggtctttcacttttccctgaaatctggcacccttgacctgcttgtaacctactttgtgctgacccattcaccttaataagaaaggtaaatatataagcattacagtccaaatattttttgaatttttataaatggtgtttaatgctatgagattagaatgaatctaccatttgtagacatttattaaatgtctactatctaaaaatttaaatgtatgtacatcctcttttttgacactcattcgacactcattcacttcaatgtttttaaatatacatacagataatgaccaaatttatatcttgctgcactgacttctaaactctatgcagccatgaaaaaggatgagttcatgtcctttgcaggaacatggatgaagctggaaaccatcattttcagcaaactaacacaggaaggaaacaccacgtgttctcacgcataagtgggagttgaataatgagaacacatggacacagggaggggaacatcatacaccggggcctgttgcagggtgtggggtaggggagggatcgcgtaaggagaaatacctaatgtagatgacagattgatggctgcagcaaaccaccatggcacatgtatacctatgtaacaaagctgcatgttctgcacatgtatcctagaactgacagcattataatgataataaaaaaaataatggagatagcattagggatgtcagaaggagagcaagtttgatttcagatacactgagtttttaatgtcataagagatttaaactatacagtccaaatttttggagaaggattgagattttgttttcctattacacagaagaatcgaaaatgaaagattttattttctcagcatggatgcatccaggttttgtgtagctgaaagctttatacaaattggaggtaggggacctcttgatacaaaactacaaataaagtactaaatggagtctttatttaatgaaaaaacccataacaaatatttggagccttggatgctcgagtctctaattttttaagatgtcaagtgctttactagaaatacttacaatgttatgatgaaatgcttcctgagtgtaacctggcttcccttccttagacgagaactcctagaactcacgggtcctgaatctaaagcttaattcaccttgcagtaaattctcctctgtttggtccttgaggattgataaagacttattttgtgtgtgtatatgaccataagatatttcaaaatgcacttttatttcttctttttatgtatctagggtaacttttaggttaagaaaatgttttatttaggcttttctaattgcaaaaaacaaagattctctcaagctatttcagcagagggaaggctcagttcaggagctgagaaagtgttcacccactcaacataaccatgttggatatataatgcaatccagaccctgtaacatacagacacagcaccttctatcaaggagaaggagtgacttagaatcatcatcacataaatacatgtgcaaccgactgcaatagtgctatgagagacacaatatgccgagcacatatgacaaggaaacaaaccaggtcccctgggttttgtttacatgtttgctatattcctcttgtttttgatgatattgctggaggagacagaagggccaggacaatcaagattttcccgagcaaggattatttgagctgagatttatgtatggataggtatttgctaggcaaaagtagtagagatgagggatatgaggtttcaggccatggagttaagagacaagactagcttgttacaatggctcatacctgtaatcctagctacttggaggctgaggcaggaggattccaggaggccatgagttccagaccagcctggatattatggtaagaccactgtctctaaaaaatatttttaaattaaaaaatgagttgggtttcgtggcgtgctcctatagtcccagctattcaggaggctgagatggaagaatagcttgagcctaggattctgaggctgcagtgagctatgattgtgccactgcactccagcctgggcaacagagtgataccttatcacttaaaaaaaaattaaaaagaagaatgaaaacacaatacgcaacataacatggtgactcaaacctaaggttgatttagaattcgcaatagtttcaatgaaagcaaaaagtcatgagtcatgtctcttctttctatatctattctgtctagttcatgagtactggccacaggtgcctatgaacccttgaaacacagcattccagattgagatgagcttccattgtgaaatactcagtatgtatttgtatgtacatagtttgtaaaaggctttgtatgacaaaaaaggatgcaggatatctcattacaaactttcatattgcttgcatgttacaataataatactttggatattgggtaaaatagatacgaaaattaagtcgctggttactttatccttttattaaatgtggctactagaaaatttaaaattacacatgtggcttacctctgtggctcccattatatttctattggacattgctatttgagcaatgactcttagccctggctgtatgtacatcgccacccaccaggccacacaatagacctagggtagtagaatctcttagggcatctgcattttagacaaatgacctcatttgttactaatgattgtcacacaggtgttccacaggctgttcctgtaaatgccatggctcagatgtgtgtattatacattgtttctgcttctttcagcccttaagcctctggtaagctgtctctttgaatctagtcagagtccaggaatcttttcctgctagcatagcctcatgtgcgaaataagttgtgttgattcatttgccattaggacgactgtggtggcagcctccactctggatttactctgtagggattcgtaagtcatttttagtccatgactcttctcttccccctaggaagcccccaccagagacaaaactagagccgctttttatacctgatttttcggaagtcagcttcagaatggatttgtagaaaatcttgtatctctaccagctcattacactttgggtaacgttattgaacgtagaatttaagtttttaaaacagaaatgtaagtagtttcacgaaagaacaacttgtatagatcatgataacacctcgttaaattgaatagatccttgtcttagctgctaagtaagttgatattcctttaaaataccattcatttgagaagcagcaggaataagtgtagttttttcctctctccattgaactccagcttcatgagattatttattttattaaataaattcaagcaacctctaaaatgttctcaatttttgcagcatgatgtctaatgtctttatatggagtgtaaaaactctcacagtctggtccaagtccagtcttgttccccagttctccctctgctccagacaccctgaatgccagccaaactgcactacacattatccctaatgcatgctctgtgtattagtctgttttcacactgctggtaaaaacgtacctgagactgggtaatttataaagaaaaagaggcttaatggacttatagttctatgtggctggggaggcctcacaatcctgatggaaggcgaaaagcatgtctgacatggtggcagggaaagagggaatgagagctaagtgaaaagagaaaccccttataaaaccatcagatctcatgagacttattcacttccacaagaacagtataggggaaccacccccatgattcagcgatctcctaccgggtgcctcctataacacttggaattttgggagctacagttcaaaatgacatttgggtggggacatagccaaatgatatcactctgcttcttcaaatctctagtaatttgaaattattatcattattactacttttgagatggagtttcactcttgttgcccaggctggagtgctatggcgcagtcttggctcactgcaacctccacctcctgggttcaagcaattctcatgcctcagcctcccaagtagctaggattactggtgcccaccaccaaacccagttaatttttatatttttagtagagatggggtctcaccatgttggccaggctgctctcgaactcctgacttcaggtaatctgcctgccttggcctcccaaagtgctagaattacaggcatagccactgcacctggccttgtaatatgaaattagattgctcatcctagaatcttgtaacccttctccataacaaacttctactcatcctctcttctgacaccttccttcccgactcccttacataatgttagtttgccaaactctacttcagtactaaactctaaaggaatttatttgcatgtatacgtatttttcacaagtaagcactagagcacaaggttgaagttcattacatacctgtctttgatgggtagaaagagcagattatttgaagacgttactgtatctctaccttcagcctatgcttttctcttgccatgtattccagtttctattttttcgagacagagtccggctctgtcgcccaggctggagtgcagtggcgccatctcggctcactgcaagctccgcctcccgggttcacgccattctcctgcctcagcctctcgagtagctgggactacaggcgccgccaccacgcccggctaattttttttttttttttgtatttgtagtggagatggggtttcaccgtgttagccaggatgctctcgatctcctgacatcatgatccacccgccttggcctcctaaagtgctgggattacaggcgtgagccactgcgcctggccatgtattccagtttctttaagcttcctatatacagtgtgatttaaatctacttatcatctggatgatttgtcttttaatatacttccatttgcttatgttgagtgaagttatctgaggttagaataacgtacataaaatgatatgtgaattgtaggccttggagagaagtcttaaggacactcctgtttttagctattcttcttttccatttgctgctgtggactgtggtttattttagactaaggaagggcatggtgcggggtttccactgctgcttaaactggagttgaaatcctatgttctgcttcctggcccactcccagcctgcagaagcccccagcactgaggacaatctaaacgggcgggattgaattcaccttatcaccacttcgcgccgaaatttacagtctacgttgaggggttctgggttttgtttgtgttgtttaaattgttgtggtattgatattactgttttaaaattaataattatggtagcatgctttggttttgaagcttcaggttgtatatactgaagagcaacatctttaatttttattatttttattttagattcagagggtacatgtgcaggcttgttacctggatatatttatgtaatggtgaaatttgggctactagggcacccatcacccgaatagtgatcattgtatccaacagtaatttttcaaccttcacccgctctgacccaccccactttggagtccccggtatctataatttccatctatatgttcatgtgtgtctattgttgaactctcacttataagtaagaacatgaagtatttgattttctatttctgagttatttgtcttaggataatggcctccagctcaatccatgttgcaaaatacattatttaatccttttttatggctacatagtatttcatcattttatatatgtaatatatattttatatatgtaatatatattttatacatatatatttatatctattttatatatatttttatatctatacatatatattttatgtataaaaatgtaatatttaaacatatataaatatatatgtaatatatgtatattatatatttatatgtgtaattatatattacgtattttatatatttcatatatatgtaatatctattttatgtaatatattacataacatatattacatgtatgttatgtagtatatattacatattacatatatacacacatatatataatatatacacacacagacacacacacaaacacagagacacaaacatcttcttttcctagtcatctgttgatacacacttaggttgactccatgactttgctattgcaaatagtgctgtgatcaacatatgagtgttgggtagatacacagtagtgggatggctggatcgaatggtagttttacatctttgagaggtctccgtattgttttccatagaagttgtactaatttaatttcccaccaatgttatataagcattcccttttctccgcatccttaccaatatctgatgtttttgactttttagtaatagccattctgacttgtataagatgatcatcattgattttgatcatctcattgaggcttcaatttgcatttctctgatgaatactgatgttgagcacatttttatatgtttattggccacttgtatgacttttgataaatgtctgttcatgtcctttgcccactttttaatttttttgttgttgttgttgtttaatgaagttgttctttgagttctttgtagattctggacgttagtcctttgtcagatgcataatttgcaaatattttcttccattctgtaggttgtctgtttattctgttgtttatttcttttggtgtgcagaaactttttagtttaattgcatgttatttgtctatttttgggtttgttgcattttctttgaggttttcatcataaattctttccctagaccaatgttcagaagaatttttcctaggatatttcatgtttttttaatagtttcaggtcttacattcaagtttttaatctatcttgtgataatttttgtatatagtgagaggtatgagtccagtttttttaggcatatggctctccaattttctcaacaccatttattgaataggatgtccttttcccattgtttatttatgttgattttgtcacagatctcttggttgtgtgtggctttatttctgaatcctgttctattgatctgtgtgtctatttttataccaataccatgctgttttggttattatagccttacagtataatttgaaatcagataatgtgatgctccttgcttcgttccttgtgcttaggattactttggctcttcgagctcttttttggttccatatgaaatttagaatttttttttcttattgtgtgaaaaatgacattagcaatttgataggaattgcattaaatctgtagattgctttggggcagtatagtcattttaacaatattgattcttccaatccatgagcatgggatgtttttttcttttgtttgtcttctatggtttctttcagcagtgctttgtagttcttgtaaagatctttcacctccttggctaaacatattcctagatagtgtgcttgtgtatgtttgtgtgtgtgtgtgtgtgtgtggctattgtaagtgaaattgagttcttgatttggttctcagctcgaatgctattggtgtatagaaatgatactgatttttatacattgattttgtatcctgaaaccttactgaagtcatttaccaaggctagggatcttttgaagggacctttaagatcatgtcatcagtgaacagagataatttaacaattccttttcctgtttggatgccttttacttatttctcttgcctaagtgccctggcaaggacttctagtactatcttggaaagtcgtattgagggtgggcatccttgtcttgctctagtttcttaggggaaatgctttcaacttttcctcattcagtgtgatgttggctgtgagtttgtcatttatcactcttactattttgaggtatgttccttcaatccgtagtttgttgagagttgttatcataaaggcatgttggattttgagtgctttttctgcacctattgagttgatcatatgggtttttttttaattgtttatgtggtgaatcacatttactggtttgcataggttgaaccatcctttgattactggaataaaacccccttgattgtgatggatcatctttgtatatgctcttggatttggcttgctagtcttttgttgaggatttttgcatgtgtgtttttgcatgcaatatcccagcatcagggatgttgacttgtatttttctttttttgttgtgcccttgcctggttttggtatcagagtgatactagtttcatagaattagttaggaaagaatgcctcctccttaattttttttttttggaatagtttcaataggatcgataccagctcatcttcattcatctggtaaaattcagctgtgagtccatctggtcctgggctttttgttgttcttggaagattttttgttactgatttaatttcaagcaaaatcttttaagaaagaattgtaaaatatacatatctaagcccaattaagaccaataaaatgtttgtaagttgaattaaatagtttctctttattcctggtacagtttaaattgccacttgtcttgaagtaaccattgtctcagctatgttacagataccatagcttgtaaaaataaacaaatgaatttgatgccaaacttgaagctcatattggaatgtaatggttttaatgcagacacaatttctttctgtatcctgattagattgaagcattgttttctactgtaacagcataatatttcatcaaaacatacctgtgtttgagagctcataaggtcttcttgtatattgggaacagatatggcaatattaatgactatgttaggttttttatactagcacactttcatatatgtatttgtatttataagaaatttttctttcaaatgctgcgttcaattgacaaaaaaaaaactgcaaatgaagcacagatgctgtgaattggaatacaatgtgcaatgcaatttagccctgtaggctttctggaaagaacccacttcccctatgatgagtagagttgtcagtagtgacaataatgctgttagacgtgaaaaccaagtgtgctcacctatgattgactgacaaagccacggtgcctccatgaataaaatccaagtgctgcgttacaattcatctcatgatttttgtggttcagtaatttatctttataaaacaccaatgacagctagtattccgttgttcctgtgagtgaaatatgatatgcttgcaatatggtttgaggattcactaactatggctatgtacacataatttgtaatcaagttcatgcatgagtagctgaaatataaataggaacatttaagactgtctcaaaactagattgaattctccatttacgtagtcatagcaggatggttcaggtacatgtcataatgagcctttgatgaatgtttgagacattcagaaaaggagtagaagccaaatgagaaccaaaaagaaaagaaaaacagaagaaccatagcattacaaagctaaagactagataaacttaatttttcagaagcaaatcacataatgaaacaccaaaatgagaattaaaaagtcagaatttactactatttgaactcctgagtttagccattttttctctgattttccaatgttgaatggagataattcaggttgctaagtataatattgaatatatatttaccttagaaatttgcacatatacattataagcatatttgtggggatgctgtacactagaaagtaccatgatttactcgtattatagtctatagctgctatattcatcctcccaagaaatctgttattatgccatttcttccgtctataaagttcttactagattaagttcaaacttctttttttttttacttttcataaactttattgatagtggccacaataatttttccttttctttctttttaagtaaacaacatttaaaagataatagtaaatgaattcaaacttcttaatttgaaattcgaagtccttcatcatctggtttcaactggtacctctggtcttatcactcattccataccatgaaatgcatgcaaattgctcttgctgaattatacataatccacttgctcattcagcaaacatatattgagtatgaacaactctgtgggtttaaagatagaaatatgctgctaatggatattcatttatatattctaggagctcaggaaggggtggaaaccatgcaaaaaaaaaaaaaaaaatagcctcctacacttccatcccttaattcttgacaatctcttcatttcaggtagcttttccatcaatttccataaatagaaacttttccatgaagtcttccctatatcctcaaaagaaagtaatccatccattccatagttcatagtgatttcttttaatattaagcaatgttcactgacttttatagttacttctctacatatgtcttccataaatcagtaagtacctcagaagttgaggaccatgtttcaaatattttctctatcatccacagtcttcagaatttgtaactacagaacaatctgttgaatgagtaaaatcatggaagtatagttggggacaaaattattcttatttctttcttaatttacctccttaaagatgtaaaagaaaaaagtctaatttctctcatctatgactgcagtgggtgtaaaatcaaaccatttaattattaaaatgaaaaatagcacatttttaaaagattcacagtacattttgtgaagttttatactgaataaagttttttataaggaaaaataaagcataattattggaaataaataaaagcgtgataattgtctccattatatagctataaaattttatgtctatcattaatcccttataattatttaaaattatttcagtcttttcgtataatgttaagtaataaaacttgcataattatttttaaaagtctaaaaattataaataacatttataattctgcatctgtgataggattttataactgtacttgtaacaaaatggagcttacatttttaaatgtaaaattgaatgaatacaaattactttctatcctgaatacagagcattatacatagcttgctagacatagccaaaaatacatacttgaaatcattataatgaagatgattaaataactataatcattctgaaccctatctttatgatattatgccaaatgtgttagtaatacttacctacattttgacatgttataatctacataaatttactagtgatagatatacttggatttcagataatgcactaaaattttctgcatataataaatatttttataaatgtattatttcttccagttaaaaataatcatctctaaagaaaaagtaaaatataatgctataatttcttgatcaggctaatggtgagacgattattcattcttaaagctttgactcagagataataaatcttgctgagaaagacgtttgaattcattatttctcataataaatgctcagtaaatatttgatgaacttaggcgatgggtccccatagttttattgtcagtactcttcatgtttatgccaataggacctaataatcatataaactacattttcatctagcatctgatttccataaaatgataactttgtcttcttcagtatcatctcattgtcttgacatagtaagagctaaattataatattgattattattaagtgcctagttaaagaaggaaggaaatcatcctagtcagtttccttatgttgcttcataaacctatccctagatgatccaccagcttactatacaccaggcattgttagaattctcgtcagctctcaatggctcccttttgtcacaaagtcaacattgacttgaaccaatgtaaacgctaaatactttaagaatgaaataactatatgattcctgtcttgaggtaacttcatcgatcacagtagaaaatggtaagtttacaagatgctaagtagggatttattaggatgtttacacggtggtagacagagatctgtcagataggtggacggcctaaataaaagcatgagatttgttcttaaattctgtctgcagagcacagtgaacaattcaagtctacatgtaaagtgatcttacagtgacttacaatggactctttctgccttttgtatagtacaaatgatgtttgttttccaaatgtatacagctaattgtaaactctttcttgtgtaaccataacttttgtttgagccaagacattaccagagtgggaaagccgctgtttaaacaaagaagaaaatcaacagtgaaaagaggtgtctagtgaccaatttctgtttgcttgagttccctttgagaacgggctgggaataaataaattaaacaactgaggcttttacaggaaaacaataacaaaagcccttttctgtctttgcacagttcagagacaaaaacagaggtcacacatcctccagcaagtctgcttcatattcaggcgtctcttacagggacgaaaaaatctctcgtagaagtcatgctcaataaaatgcaaactcgtttacgaaaatgccaacattttcattttcttttgatgactttctcagagaataatgatgttcagcttagggttttttattttatttttatttgtagtgccctttgggaaagaacattttctcttttaaaagccacacaaagtttaactcaagcagtctcattgttctttctcccacaaagctagcaagaaagactaatgtattacttaatgaagctattcattgcttaataaaaataagaattagtaacaataactgttatattcacattaaccttacttttatgctttaacatagaaattgttctgatgtactatatttctaccataatttgctttaaaaaataaagcgagtgggaagtataaatcccatgatatgaaaagtaagatatccttttcattgttattgtagaaatctgagttaataacctgtgctaaacccagctaacaaaatctcaagttttggaaagtgcagagttgtaatactgatgataagtggcagctctgaaaagtgaaaaaaaatctttgacttgaatttcacaaacttgggtcttactaccaggttttcaacttactagtttatatgggcaagtctcttaaattttttgaatctcgatttaatcatctgttcattttcaaaatgggaagtaactctggctgttacacagaatggtcacttattaaatttttgatgttcacatataacttaaaagaaagttcatatgtaactttaaagaaggctatatgtgaacattacaaataatgataaggaccaatataataaacctctggtgcaagatttttataacgaatcatcagcattcaatataggaaggctgcaacattgctcatagatatctcccttgaaataggtaaattcaccagatttacaaaatggattagccaaaagcttatattaaatattatttttaaaagacaatatgtatattaagaattgatgctctgtgaggtcagtaactttatttttgatgtagtcatattgtctagggtattgtctgacatagtattgaataattgaatgaaagaattccctgaatatactttcctttagtatattcacaggctgatttagttcataactacaatcctcatgaatatgttcttcatgaatatatttattaaaagactaaacctatgacccttagcttttgataaattaaataatccctacaatactactaatatattcacatttattggatatatttaagagaaatatattcatgaatatattcataagatgaatacattcatattcatagaatatattcaagaagaatatttcttaacacaattacctaataaattggtaaaattgatgaatttggtgagttagtcatcacctgattctttagataattgtttttggccaatccactcttagagaattggttttcactgaattgatctagagacccttcccttgactatgacctgtgtgatcatcagcaggtagctactagctactggagtttaccaccctctacacctgtgagctgagatcaccttctgtgaaactgctgttgggggatagacaggacctccatcttccaaaaggagggaggttagaagccaatgtcttcttcagaccaagagtgacttaattcgctcatccggcttactgtttcaaattcttctccctaaattctgtgccttcttagtcctccttgttcttcagaggctacggctttaccttggggagatttgatagtgggcatgaaaccttagtacaacttgttaaaggctgagctagacacaaaggggacactctaatttagctattagtctaagtgtgtaatccatataaatcaggtgtgaccagccacatgaaactcctttctcaaataatgtatatttagtttttcaaacttgacttatatccccagctaccaaagaacttagcttctccaggaaagtcactgtcattgtgagccatggtttggatgacatcatcatctctcaaatatgtgagagcagagtgaagattgagaatcttcaagctaatttaagccatgacagtggtgagatttcaagagttaaacattaggctatttgaaccatctggttatactttttagtctaaggcatacagagatggtgaatttaagaagaatgaagatgaggaaagcctgagaaaatttaaatacagggaagatgatggactctctacagtttaaagggaaagcaaaacaaaatggtgcttaattttatattatgtatctgtgtgtcataaaagagccttaatcatggttgataattaatcaaaggaaagccctttatttttattattaatttattactattactattatttatatgtagagaaagatgggggtctcactctgttgtccaagctggtcttgaactcctagtctcaagcaactttcctgctttggcctcccaaaatgctgggattacagatatgaaccacttcacccagccaccattaagtttacaaatgaaattagacataatttgaaagtgatatcaacttgaaaacccttaaaagtgtcctgaagtcaccttcaaaaattttatgaagacattgtctactatgccatagtccaccaataatttcttcttatacactgcagttcacatgacattaatggcattgatagctatcagttttgctaaattataatatattaatatcctacaactatatgcatatttcatgagttttttgacacatctatacccccatctaatgagttttaaagataacagtgactccaatattttccacattttaaggtatttttatgttgtacattaaatatattcttgccctgatttattattttattttgttgacatatacatatggaaaaagtccatattatgattgtatagttcaaaggcttttttttaaaaaaaactgaacatacctatgtaactagtgtctatatcaagaaatagaatgttaccaaccctccagattgcttttagtttcaataattcattttaactagagggatgctcatctagcaaccaactttaagcaatacgcagcaagtagctaccaaaaacaatataattgtgctatataataaaaaaagattatctgtggatctagctaatgttgtctttagataggacatgttctataaataagaaaatgataattactcatttgtatcatagaagtttaacattatatgtcatctaacctaccagaaattctctcacataattgcctttgtggggtattgctggatgacatcttcatcctaatattagtattccagagaatttctgaaatagagaacaaatgcttttcccaaaaatcttacttctatcttcaatttcccagtactttctgggactctacaacttggcgttaaatcacagaagtggctatgaattccctttcagattttacctggtaaaagatcttagttctttctatggtcctggtttcatcttccatattggtatgtcatttatttattcccaagattctatgacgttaccaggacttcccatcttccctttactaagatacaatattcaagtgacgagtcctacattttccacatgtaattttcttttttcatctcggtgaaatctctttcatctctgtaggtgttccatggccattgtgtttaatgtttagagtcatccagaacggcaagtacaaatgtgaagccaaaagttttcaacttcaattatataagtatttattttaatgtgccctaaataacgtgtttttttccccccaaatcaatacatcatcattggtctttctattcctctctatggcacatgaatgtattctagtcttttttttaagtagttagcatgaaaaggaatcttgtaattcagctggaatgaagcgttcattttagtgataaaaatttggaggacagagagagaaagcaacttcttcacataatattacagtacatgctgcccaaattctaacccaactctattttagtatatcacacggctctcctgtcttacgtagcatgtaatgaatatcacatatgtgtgcatacacatatacaagcacacatacctgacttatgcacatgatgccaacccatgaaaccatattaataacaaatcaatatttttaaaatttatgctaggataaaaatattacattttaaaatatttttatttttaaccattaatcaaatgcctatcacatttagtttataatccacaaaaagacttggtaacatacatttatatcctaatatgtgttacttcactcacataaatactgttttaacgtactcacctatggcatttttccacacaagttttgccactaggagtaagaaaaactaccaaaagggcagttgacactcaaaaaagattattgttgaattgaagatttctgaagagacatagttaatgaataccttgagaggtacctttcaaggttcagtcctcattaatggtttaattggaggaaatgacattgagctgaaacatacagaagctgctaggagtcatgtagaagaataagtagtagagaggttggcaggaaaaacctacctgtaaaaggtaagcactgagtttttgcctatatctgcagcctgggtgcatcctttgaataaaagttaaagattatctggtggcatgtataaaaacagagttttataaaaaaaggattaatgcagaattatctgaaataagaaactctattcttattatgcaatttataaagcaatttaagaataattgtttctattcaaatcataaaggattgtacctggatgtaatattttaagatgtcttttccttgtcaggattctgatcatgatgatttcctgaacttgggaatttctgagcccctgagtgactggataacctctctaacttaaaaacaattatctcactcgtgttacccagtaaacacaggtataaaaaggctctattttaatgaaagccactaaaattcaagttctttatgattattatggaaccaaaattttgaaatatttcaaagaatagaattaatcatacatactattttaaaggaagccattaaattacatttctgacaatttttcattttaagcttttgttataaacatttagaaaaaatgagaaaattgattcaagaattaaccttgtctaaattgtcattattttcatttttgatattcctattattcctttttaaaaatactttttgcattgcatctataatactaatatgacagaatttaaaaagtcattgaccaatagcattacataatttcttccttaatacataagaggacaggaactatgtgcctttgggacatggagaagaggcaaggtgctctgtaatcattctagtgttcatttctctaacaggataacaccagccttgaagacgggaccaatagagttttaatggcatattacaattaggatatggaaaacaagagaatgcctatatttgggatgacttcttgtcagattcccagttggataccaaactaatctcagctacactctgtcttccccatttatttttatttattcttccaaagctatgtaactctgatttgtaaaatatagagaagcgttttctagaaattataaatatgtacataaagctatttacatatcattagaccatacagttgggcaaactccataaagtctggaatcatcagatttatttttatattgtctacaatgtgtcaaatagatatatcctcagaaaaagtcagaggaattgatttgaatgtccttgccgtttacatagtgtcaattttctataaaccaaggatgattttgtgcctttatagaaaactaagatattacatttatctgaaacatatatgggacaaaaataaaggtctaaaaataacttagtcaatttagatttaagaaattgtaataataataatgaaaacttatattcctaaaatgatacaataacaatcttatcactacaaatctctgcttagaacagaacaaaacagtgactgtaaacaaatactaatatttaatttaaaaaattaacttggatatttattttaaaaagctaaggaacaggaaatataacctataaatgtttaaatagaaaaaacggaacgtaagaaaaataatctgaaaagcataaatgaaatgataatatatgcattacccaataaagtcaaatggtgcaattaaagaatgatgaattatataaaccagggttctgaacctgagagaagacctaaaccactgaaagtgcatacaaatttggggtatatatgaatgagtttttcttggatcaggattcatagttttcattagcttctcaatatacaccactattcaaagttcttctcctttatagctaaactactcgagggtcatatcttccctttccattcacctaccatattctcccctttccactccaatcaacattctccttcacattctcaaatctaatgttcacttctcctccttgttttacttgatgtctcagatgcacttataagagttgactagtccctgcttcttcaaatagtttccttcttcacatcacattctcctattcttttactggccactctctcagtaatctttctttgttaaagaaaaaaaaatattcagtgacacttgttacggcatggtgagaaatattttattcagtgccatctcaatgggtatggggaccacagcaatgggattttgcagtggcggagactacgctcaacttcaaatatagcacgggcaagtgggaatttatatagccaaagaatagagtggggtcagtggatgcaacattactaagaagaaacatcaggtgcaaacaggattctggttaaactgtcctaacaggattctcactgaaaacaagctggggtgatccaccatcccccgggagatggcgaaggatgaggaacctgatcagatatcatcggggtaattagatatggaaaatcagagcagggggagtaggaatgggggtgtgtcttgctaaactgacttagcagggttctttgctaagctgaattgtataaggaattgcacagatgggccttggagaaacttcaggagcttaactaaagtttagtcaagcaaagaatctctgctacctggcctctcatccatttcctcaactttgaaaatttagagtactccaaggttcagcctaaactctcttttctgtgtcaagtctctccccaggtaacttcatcttgccccgtgacttacactcatgacatacgatttgtatctccagactacatttttttcttgagctccagacccaaatatataactgcctacctgatatctctacttggtgatctaacagattcgcccaacctcgactccctcccccagtctctcattacagttaaatggcatcaatttccactcagttgcttaagttacagatctatttctcaaactttcgacagccagtcaatgacccaccagttgtgcttccaaaacgtgaaaaatctggccacatttctccagtgctaacctccgtccaaacttccatcgtctcttgccctaatgacggtaagagcatcctaatagatgtccttaccttcactcttgccttctacttatcaggcctttacctatatattttctcttatttcctcagtccttcccccttaccttttgcactctggtccctttggtctggcactccaatacaccaagcatattttctctcagggcctttgcatcaaatcatcatgtggctgacctcttgttgtccttcaggcttcagatttactgtcacctcctcagagcattacccttttgtcaatcattcttatctctctattacaatctctgttttagttattttatagcagttatcactgtctgaaattgtacctgtaaacccattgtctgtctttgcacacaagaatataagctccctgagggcaggggccttgtgtgtcttctttactcttatacccctggcacctcaaactatgccagttgcattgtaagagatgaattaatgagtgaataaatgagtgaaagaatgagcttgactctttgaaggagaactgtaaaagggcttaagctggtgggagcaaatttacacgttcctctctttagagaacagctgaaaagttaagatgaaaagcaaagactgtcaaatcaccccagtcataagaaatcagagaaagcagacgatgatcatcacgtgcttcttcctgttttttaacctttcttcagttatcaaagtaacgagagtagtttgcagttactcatggccaaagccagatgaaatacaacagatattaagtgtgacatctcttcatgatatgaatattttctctgttatacttttttgggttttccaagttttttccaataaatgtcactttatggatgaagaattgtattctttaaaagtctgtatttaaaacctgaaacccatctcaaatgccactctataatgtctttgtcttgtgacctcacacactacatacaaaatgtgatgtgttccttttctaaaacctccaaagtgccttccctttatacatacatgtactttgtctttatacatacatgacaaaataataatgataaaagctgctactgtctctcaatagtatcaggtacctcatatacattatgactcatgaatcatgatttcctctataaggaaaccaagttacaaagaaatgtaaaaacttattcaaattaaaatagctaaatatttctagaccagaaaccagttatgacttactgtatctctagtgctaaaatagtacttaggaaatagtaggtattcaatacatatttacaaataaacagaggattgatattgtcatttgaaaccctggtataaatgacatcctggtatgatacccagacttaacggctttaccacaccccatcttagatcttacctacattttttcattaatcaatagtcagatgaattagaaccctccttgaagccaacaatagcttcctattcatgacaacttgtattgtgttttatattcaacagagaatcaaatactaaaaaaaaaacaggagagacaattggggagagtgagaaataaagaggaaagaaagataaaggaaaggagggaaggaaggaagaaagaaaggaaagaaggaaggaaggcaggcatctgccaaaagtgataagattaatgaaaatggctccttgtataaacatattcctactaaagttacctggtctgtaagattatgtcaagaaaagaaattaatcattggcagaataataaagtttcaaataagagtttttgaagtatagtgatgtttgtcttttggctaggaatcagtaatggttgaaaaagctaccaaaatttttttcatgaacatttagtcttggggtagttatttaatttttaatatgctaaaatattgatctctgtaagttcaacattttaagagtctaattgttttctcctgtttaagagcaaataatttcatatatattgggtttcccattgtttgatgacgtagaaaacacagcataaagtagacattgaatgaaatttagttgaattttaaaatgaatagcaccactattactccatttgaaaacatttacatattattgaggtaaaaattacatacagtagattctcatcgttctcattagtcaatatatagttatgttctgtatagtcactgtgaaaattgaattggcaactattgaaccatttttcctacgggaaatacagggttaggttcctgccagcctctgatcacaatatttgcaccaactaatcaatacataaccttgttttgtgtgtgtttctgtttaaagttactgtatttaatatttatcattgattaaaactgaactcatgttcaacagcattataacttatgcctgaatcaaatttaacaaacacatattttttatgtaaggcacataacagctttaacttaggaacactaaagagcacttcagtactatgtcaggggaccgcttttaacagcaaagtcaacaaaagcaccaaagtataaaaaatatgacactggcagggtgcagtggctcactcctgtaatccagcactttgggaggccgaggcgggtggattgcctgagctcaggagttcaagaccagcctgggcaacccgctgaaaccctgtctctactaaaattacaaaaaaattagccgagcgtggtggcttgtgcctgtaatcccagctactcgggaggttgaggcaggagaattgcttgaacccgggaggtggaggttgcagtgggctgagattgcaccactgcactccagcctcagtgacagagtgagactccatctccaaaaaaaaaaaaaaaaaaaaaaggcactggatatacagtgaaaagaggcactggatatacagtgaaaagaatacctgtttgcaggttgagaccttaaacaagaaggcaaagcgttagctcagttggaaacttgtgccttaggaccactctgtacatgcatgagtctttaaatgaccatgggtattgattttgggtttataactaaattttagcaagtaggcaaattcacaaatgttgaatctgcaaataataaggaccaactgttcatgacatgcgcagatcttaaaagtacaattcaatggatttggatgagtatatacacttagacagcaaacatggaatcagcatatagaactttttctctccctcagaaagttcctcgtgccaccctacagtccattcccacttgtgcccaccttcccatagacagctgctgttctgatttctatcagcttgatttttttattctttttttaaattttattttacttgaagttctgggatacatgtgccgaacgtacaggtttgttatatagctatacatgtgccatggtggtttgccgcacctatcaacccatcatctaggttttaagccccacatgcatgaggtatttgtcctaatgctctccctcccctttcccctcactccacaacaggccccggtgtgtgatgttcccctccctgtatctattttataaactagttctatgaacatattcataaaatatgttatttttatgtccaggtttttcttacaaaacacaatattttaaaaattcattgatgctgttgcttgtatcactagttcattcctttttcttttttattatttagcaatatttccttgtttgaatatatactgtatgtacatgtgtttatttccaatttgcaactgtcatgaataaggctgtcaagcattcctgtatgagtatttttgcaacatacattctgatattggtagatatatacttaggagggggattgttgggtcataggattaatatatgtttaactttattaaaaattgtccagagttttccaaaaagattgtacaattttatactccaaccagcaatgcatgagggttcaaattgctctagatgctagttagcccttttaatttttggccaccgaaatgggtataaaattatatatcatggttttggtttccctgatgactaataatataaagcactttttaatgtgcttatgaataattaatagatctttatttgggatgtgacttctgcccattttttccagtgattattgatttacaggagctcttagtatattttagtatattctgttttaagatacatgcactgaaaataatttttcctagtctctttcttgccgtggattttattaaccatgtctgttgatgagaaaaagtttttaaatttgatggatctcaaattatcaagtgattttgatgtcctctaggaaacctctgttagcccccaggtcctgaaaatattctgttttcttaggtctcaaatcctttcagaactatttttttgtttgattgtataaagtagaagtcaaaaatacatcttctctgtatttatccagttgttctggcatcattttttgtaaaagacacttttcattcaccattaaattgtcttggtgcctttgttaaaaaacaattgactacctacatgtgagtctatttatgatctttctctgatgatatacatgtataatcttgaaatcaaatgataagttctctaacttggtttttcttttttgcttattttgaatatttaaggattttttttgcattttcttaaacatttttgaatcatctcatgcatttctacaaaaactatattgttgggtttcggttagaatcgcatggtatgtatctccatttgtttagtgccttaatttctctcactgatgatttggaggaatcagggtggaactttaaaagctcccccaaatgactctcatgtgcagacaagataaggaccactacctagatccttttttcttagaagaatttgggtgcctgtaagaaaagaattcatcccatccatccctaagattctacgtattaaataaatgaagtggtcatttctgtttgtttgtttatttgagacagggttttgctcttattgaccaggctggagtgcaataccacaatcttggttcactgcaacctctgcctccctagttcaggtgattctcctgcctcagcctctggagtagctgggattacaggcatgcaccaccatgctggctaattttgtatttttagtagagacggggtttcaccatgttggtcaggctggtctcaaactccagaccttgggtgatatgcccgcttctgccttccaaagtgctgggattgcaggcataagccaccacacccagctatgaagtgatcatttctaataacacatccaaaaaatgtcatgacatacgatctccccaatgtatttgttttacttaaagtttctattcaagtgatttttccaaaataaccacacattccaaagtgactctttgtaactttacaataaggcatttggcagtttctttatcataaaaaacaaaagtaccttgtacctgcccaagcacctttttacatgttttatctgacaacaattgatcatatttataatgtggtttagattggcatgtgaaaatgagaaaggtcaaaatggatccattttcttatgatatggaatttttatagataagaaatagtgcatggcatatttatatgaaaatttatatacctttttaaagttttattgcataaaaggataattgattattaataagatatattagtaacacatcatagaaccctgtaactgcctaaagatgaattcatattctaggaaattttgctctcaagattgaatattgatcacaagactgaaaactccagtcactgtaattttacttgaagcattttctaacagatgttacatcttggtttgccattatattttaaatacgttctttttcttttttcaacattcattaaaccagtcttttcttcttgtctctaataagagcaacatctgtttcttcttgttcaatcaaagcaacttcctcaagagtcttactttaaaaatgataacattagaaagcacggatagaaaacttttcattaatattttacatttgcatacaaaacaagtgtttctaacaattataagttagggaggtgttagagaaaatattataaaacaatttagttataaaaatataaaatgagaaggtgctgtaatatggtttcaaagatgttcgttttaggttaaattttctttatatgaatatcagtttccttttagaaggtacagttgaaacacttttatcattacgaattataacaatggtacataccacactgtatgtggtacagaattataacagtggtacataccacaccgggttccaattcaatctcagcctcttatggggcaagctccacgtgtgcctgaatatattatgaccccaaatataaggcaattctccattttccctggattattttatatttttactaacttgcacataaactgtcaaggcctaagtgaagatgtcaataatatttatgtgtttttcagattacatacataaatcatttagaaagttcattttttcattctcactttttagaaataattttgttctaatgtctgcacaggcaactttaatgtcagtgtctttgccctaactttgtgaatcatctacacatttctgtagaacaaatcatcttcacctttgtcttagttgtttaagatataggataagtttcccatatcactgtatatgttttcccaagcctcaaattcccattaacaaaggactggctaagatgcattttttagttgtcctgtaggtgaaatttatgatctccacattgtaaagacttactgcattgctttcttgtttagaaagcttatcactacattaatatttgtaattatgagatagtaaactccaaagacaatttttttttttgttttgagatgaagttttgctcttgttgcccattctggagtgcagtgacacgatctcagcttgctgcaacctccacatcccgggttcaagcaattctcctgcctcagcctcccaagtagctgggattacaagtgcccaccaccacacccggctaattttttgtatttttagtagagactgggtttcatcatgttggccaggctggtctcaaactcctgacctcaggtaatccacccgcctcggcctcccatagtgctgggattgcaggtgtgagccacagcaccctgatgaaagacaaattattaaatgtgtctcagcttacttttctatgaaataaaatgaattaaagtgtccatgtttttgtcttaataatatagatacactgtctcctatctggcagccaccattctaatgctgtacaaatactaatagtaactagtatacaaatacttaatccacctactcaaagcctcattttatttccagacctgatgctgtatgagatatggctatccccagaaactgagcacttctccagatgtggtagcaaatggaagtgtgtgtgcgcatgcgtgtgtacccatgtgtgtgtgtgcatgcgtgtgtgtgtgtgtgcacgtgttgtgtgtgtgtgtttgcatagtataagaaaactctgatcatggatgcacagggtctatataaataatgtattttgttgtggttcttgtttatttgttcaagctctagaaccaactatgtctgagttcaaattctaacctttacctgttaccatctataggatgcttacagattggtagactcagtccttccctatatactggagataattgtttaaaaaaattttgtgaggtattacgaatcaaatgcaagcaaagtatcaccatggctagcacatagagcttagaactttatactatatatgctgacatataaaaagatcatgaaattctattcttctctggagacagccttcaggatactatttcttacaagatgtagacaaaatatgaaagaagcagcacatttttctataagaaattgggtcttccttgccacatttaagaataaacttcattacatttggggacccatttttatcatagattactgaggtattacctcttgataattaacattaaaatttcaaaataataattggaaatgaaatgaataggaatcaaagcttaagctttgatacagtagtggctgctatcagcaaggatcctttaatctgggttctaatttctctagtaattaagttcctggaagaaaataaaataaccttttaattttaatctgattagaataatagaccttttgccatgaaaaattaaaaggaagatgttccatttctaaattaattttgtgatggagaaattgtcgtggaattctctgaaaggctttcttgttcttccacttagagtaaccgaagatattttataagggtctatctctggacatgtgattatttaggattggatttggggactgaacaaatatcacgttgatatctttgagatccatgtcctaaaactgtatttcatagcagggtttgtcaaattataaagacaaaaatcaaaaaaccatgcagtcctatagttaatcaacaataaatcctactttgtactttaaagggaaatgctatggtgaagatagggtcttcagtgcatcaattccttgggaatacccaaagggacccacttgagatggaactatttcagtaaacactgctgcttgactgacagttaacttcaagaataagcctttacatgcatagagtaattttatagtacaagagattgtatctgtgttgttcttcagaatatttgaaagataagaaataacatttattgttttcccaatttttgtatggacaggaaaaataaaactctgggattaaatgacttaagatattcttgtcagaaacagaacttggacttaaatcatgcctttttctttttccagtgaggaactatcttacaaagtaacctatgagtaccaaaaagtagaccctgatatatgaatatgggtgcatattgtttatttgacattggtccaataaatgcaatctgggagaggggaggtgagacaagttggggtggaaagccacaaaaaggttctttaataaggagattgttactatgggcacctgagttctagcccactggagtctctctgagaggctgtagtaactacagtcccttgcacacctagtttctggactgttcctctttctacatcattggaagccattgaaatgtatgggagttttctgcaggtgacagccagagtgggatgaagagatatacttcatttaataacttgataacagagaaaggtcaattacaaatggacttaggatgatggggatttccaggaacatctattgacattaaattaaacttaacaaaaaaaattatatccacttaatccttacccttagaatgagtcatattgcacattaccgtgtagagctgagaagccatagtcagcaactccaatgctatttttattgcttttttatgtttcatcatttacttggccatctatgaaacctagagtgccagattcctggtcatgatcactccctcagattcattcagttattcattcacacccactatgtaccagacatggttttaactttagggtttttttagtagagaagaaaacagacaaaagagagcttataatcaagtgatagaagacagaaaattagtaagtatgctagtaaatgaacatataataaatttagtaatgagaaactataaggaaaaataaagctcagaaaagaaggaatgttgggagagagaggaaaatgatatgttatttagaatagctaggaaagaccacctctctcttaagatgacatttgcacagagatctgatgtgagggagcaaaaccatgcagataattcacacgaggcattccagatggttcacatgacacatcttagttcaccaaaaggactttagtcagtacttttcgtgagttcaaaaagaacagaaagctgttatagggaatagtgtgatctcagttatacatttataaagataataccactttgtggggagattagactgttagtgcaaagagtgaaatcagaggaacaattggggggtaatgaaatactctgtattcatctgttgatggacactttggttgcttccaaatcttagctatcgtaaacagtgctgcaacaaacataggagtgcagatatctcttccgtgtacgtattttcttccttttgggtatatacgtagtagttggattgctggatcatatggtagaccagagatgatagtgggctcacatagctgtttgccttattacattatttatattatgcatactatttatacatatattcacttgtatgctaaattttataatttggaaagtcttttgcattaattcctttagagcagggattttatactgttttcttgattgaaacaaaatgtgctcagtggccaggcgcagtggctcaggcctgtaatcccagcactttgggaggccaaggtgggtggatcacttgaggtcaggagttcaggaccagcctgacatggtgaaaccatgtctctactaaaaatacaaaattagccagctgtggtgatgcacgcctataatccccgctacttgggaggctgaggtgggagaatcacttgaacccaggaggcggaggttgcagtgagccgagatcccgtcattgcactccagcctaggaaacaagagtgaaactccatcacaaaaaaaaaagaggggctcagtaagtattactaaattaaaatttgaaaatcctaaaaaaaacccacaaaaccctgaggggtgattatgtgtaataatacttactatgagtaactactacaaacatgtgactatcttctaagctccaacagcccttaagttctttaaaatagtttttctatttcttagtataaaccaactagtaatgtatgattttcctataaaggagcacatgtagtaaatagcctaggctttatgaactacatagtttccagtgcagctgactcttgatgtagggcatgtggtatgtaaataaatgtacttggctacattccaataacatttatatggacactaacatttgaattgtatataattttcacatgtcactaaacattattcttcttttgatttctttccaaccatttagaaaagtaaaaaccattcttagctcacaggttatagaaaagcaggtggcagcaagccagatttcagccacaaactgtggtttttcagattcctggtataaattatcaggagcttggagccttgatctgtgtgtcattgatttgctctcattctatttttggacacctttattcgttagagttctctttcttttgtgaaactgaagcacgtcctcatgtaacttctacctgtggattctacattgtgccgtctgaagaagaatagcacaaaataccccccacccaccaccttgtcatagcacaggccttcacagggtcgaagaaagcccctctggccctcttggttttctctgctacccagtgttaaactttgtccagatgcttatgtttcctggctgctctcctatttttgctttttaattttctgactattcttcataaaatgaacacaaactaaacaaaagctttaagctactgtccagctaatggacaattcaatctaatttttgtttccaaagatcgttgtatcaagcaacaatgaagtgccattgttggggatatgcattcttgatttattttgctgttttttttttttaataccatgtactccattataaagataacttatttgtaaatgttcagataatcctatcattattttccatgactattagtggtcagttcgtacttataactacacatgcacagttattatttagtacttaatttctataaactatacttaccaaatgtgtttattgagagaaaacaagctatacagaaaaataaagattttaaaaacaaagacagactttagataaaagccataaattcattttcttgtctgagaataagatctagcaaagctaaccagaaaataaattactaagttaaagtagttcataattcactaagttaaaatagcacataatcataaaatgtgctcagtggctggatgcagtggctcacgcctgtaatcccagcactttgggaggccgaggtcatctaaatgactttttttcaatccatttctttccctaagtacacagcggtattaatactgcttctctacttgattgggttatattatgccttattcagttaggtggagtatagaaccacttatgatgatgttaaagagacatgagacgtcagtttgaattgtaagcagcactgtattttccaagagaaaaatacttttatttgtaaaatcgtgatttgttgattttggaaattgtgttcagctgggtaattttaagataaaaatgacttttatcttgtacttaccaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggtaagaatgccattcctttttggttactaatccattgcaaaaaatgaggtttcaaaatgaagtttgattatgaagtatttatatttgactcaactgactcagtagatctcatgacaaaacaaactgtaattccactgagcaaaacaaaaaaagaaaaggaaaaattttatttctttctgatgaagatattaagatgatgtcaccatattcttctggcctaatttaaatcattgaagtataaaaaaggagattctaaattcatcctcataatcctcaaaagtcaggtccttggaatatttgctgttcacctagtgctttgtaactaattattcaaaccttagtgtcttcaaacaaacatttattatctcgcagtttctctggatcaggaattcagtagtaatttgctgagcgagtctttcatgaggttgacgtcaaactgttacttgtggctgcatcattggaagcctcgtctgcttccggtaggtctcacttacctggctgacagttggtgctggctgggatgcctcagttctctgtggcctctgattctgtaatacctttcttcttcaagtagcctctcccgggggtcactgggcagagaaatagagagggaaaaggaaagaaagagaggaggggaggggaaagccagtaagtcaggaagttctccagataaaaactatgagtattttttaaaatataatccaatttagcagtgatatcccatcactactattattttcaacctgtgggaagtgagtcactaaatcccgtccacagttaaaggaaggggatttcacaagggcatgattataaagagccattgattcctgggtgccattttaaaggtgcctaccacagtctaccttacagaagaagacatgttgtcacaaacatcttggttcttaagtaacgaaaagattagtaagaagaagattatcttaatgataaactctatgtgtgaaaaagtgttgtagcaaagacctgtcacattttctaattgaaaaaatgtgtcctgtcagaaaatgatctttttcataactaatacattatgaggacatattttattaaagtgctgggtactttgtttagatcaatacatcttttattagattattgtgtttcctgtcctaaatcacgcaatgtgagatgtaaaaaataaatcacatgcttagaaaaggcttttatttaagctttaaaatctgtatgttacatgtttgcctctgaaaatgtttctatttgtatttacatatctactttgtttaattaaatatatagttatatagctctctctctctctctctctgtgtgtgtgtgtgtgtgtgtgtgtgtgtgtgtgtgtgtgtgtgtgtgtgtgttctagtttttagagtaaggtgacatgagagcagccaccttgtttatctcataccctgctatattcctcaaggtcctagaaaaaatcctggaatgttgtagatgaacaataaatatttatgaaagacttagtaaattctacaaattaagcaagacgtcactttattatgaattgtctagagaggaaacagaggaggccctaggcaatttactgacttgccactgagtttgcagctagcaccttaagttttctgagtcctataccagggcatttctccccatctaattagtgacaagttagagacaaaaatcatgaactagggctctgcttctttaatcttccataatatttgttggaagttaagactacatgatttttaaaagactctcaataaatatttgatgagtagacgaaagtcaaacaagctgtcttatgagtgaatgaactggacatactgatgtgagaaaaaacaactcaatagccaaactggttaccgtccaaaaaaatattcaatatgattggcttatggccaacagttttcattgctatgatcacaaatagatcacagttgtcagtgggaaagctactgataatctctgctgatcccttgactggaatatttttggccatacatgagctccctgaatgcctaaggccagtttttatcgatttcaatctagaggggcgagcacatagctgtaaccacacattcatggcatagagtttataggatatgaggtctttatggtgtgctatttacatcagtttacagattctggtttttgagcccaggagtcaggagaatattgatttcctcttgggtctatggtctgcctttaggatatactgtcagctaatgatcacgatgcttgttttgttatatcgtcattagctgaatcctaagtgtgtaagaatcatgagaagaactcattgccattctggctctcaggccccacctctggaactttgaaattcaagagaatgagaaattgaatacttaaaaacttcaagtgattctgataaacacagtctgagaaacagaattatagattgaccttagccaatttgcacacatgccttttagattctttttgtaaaacatcgtcagtcactgaaaagtttgggatgcatgagaattagctactctcctatagctttgcccccagagggcaaaagaagggaagtcacaggacaagttatgatgcccataaacatatttattaaatgaacaattattaccaagaaagcacagcactgttcataaacattcttctgcaagctcagtgaggtcccagctctctaacttgctgcaccttgaatcaaatgttctcccgaagcagcgacgctgaatggtgggattcagctacacccagagctggtgccaggtgacagaaagcctcctcagcgaatgactggcacaggatcactaagtgatgctaactccagaagcatttctaagaactcaggttacaggcctcgccagaatcttttaccatcttcacacaaggctgggtgtgtctctaaaaggtgttgtggcaaaccacagacccttaatgcctttaagttcactactgatatctcctttctaacatttctttaacatttatgctatctaacagaccactgatttcaccaaagaaaacccagtttggcattcagttcattagaggacttgttgattcagtgaattaagttgatatgggaataaatagtaaaaatctaagagtcaccccctctggtgtgggtgtaccgtttctgcactaaaactcttgacacctcttacttgtggattcctgatcagaagaggaactgcctctggatcgcaactttaactaaaacacaaatgcacacaactctataccatctgtgctgaaaattttaaagtaggattcaaatgttaaaataaacacatcttaagaaatactagtatagtggaaaggagaattgactttgttctaaaacacgagctttggaatcctgcatacctgattttgaatatggctttatcacttaattagtggatcctttaatactgtatcttactttcttcatctattaaatggcaatagaatctgttttctgaacactgtgtggcataaacttaaacctgggatctgaccctaggaaatgctaaatgctgactgactttccaatgcatcttgagcctttcttttaactctgtaagagacagcctcacaaggaacactggagacttcagaccattatttatttaatggcctctcatcaacttctgcaccactcaaagtatttcttccccacactcactgaagaaaagtatttttcctgctcactgaaagcctcaagtaaaggctttcctgccgtcctacactctgttttgtttccaaacccttaaatacgtccacattttgtttcttttgaagttaagtcccggttgtgtagctttctttgcagcccaggctgggccgtttcactccagtgtgcaattttatctctctgtgcttgctccctgctaatgccggcaaagtcttagtcctcctttgtaacatccatgatcagatgatgtttaatcaccaagaattcttttaattttttttttcttggggataagcagacaaagagatccgttatttggcatgtttcttcagtaaagtgtgttttagctgctttaacatgttttattttcctccaactagaatttttttagataacactccattaatgttaataatcaaaagaatgttaaacacaataattaaatttacctattgactgtttacgtggtaataagctttctgatacaggccggaatccatggctatgagacagcagtatgatttttaaatttctaaattttctttgttgtggtcatttttatttcctcttttgttatcattaaaagaaaaaggagctgtgggctgaagaggagagataagaagcttctagagccagtcttactggaagaggagttctaaagaactcaatggggaagcaggcaggtcttaggaaggtaccaaagcaagtggtgaaggcaagagaaaaagaaagcagtggagctggcctgagtttgataggataggatttgtgttaatgaagtttaataagagggcacatctctttccagctcaccagtacataactgtgttggtcagttttggctgctataagagaatactataggttgagtggtctaaacaacataaatatgtttttcatggttcttgaggttgggaagtctaagaccaaggtatcaaaatgcgggcagattccacgtctgctgagggcacataatgagaagctgcagacaaccattttgttattgtatgttctcatcgaagaaaaatagagacagagagagaaagacagagagcacacactcttaagtctcttcttatgagtgcaccagtcccatcataggggctccaccctcatgacctaattagcccccaaaggccccactcctaataccacccacaggggctcggggtttcaatatgtgaattttgagggacacaaacatatagtctataataatggcctctcaatcctcattgaaatagaccatggattttaaatattaggttgtgcaaaaccagttggggtttttgctattgaaagtaaaggcaaaaacgagctaaccagataggtatgtaaatatagatttttatcaagtagttatgttttaaaataattaggggatgtggttatcaggctccttagctatttattataggaaaataccaacactccttcaagcatttggctgcctgaaaatttcttagtgatggaatacactccatgaaaagcctcccagatagtttcccagaaatccttggtttggctcatccatcaaagaatacgaacttgcagcatcccattcagaatccacttgtcagcactgtgaagtatcagctgccttgcttttgtaccaacaggaaatctattgtttagaagtttgttttctagctctttttcattgttctcccaaaaagaaaaataatggaatgagacacattttatcaaatgatataagttagacaatgtgtcatttcaggagtgtgcaaattgaatcctaaacaaactttttgaaggtacgtattgattttctagggatgccgtatcaaagtaccacaaacacggtggcttaaaacaacatagttctattctgtcaatgttctggaggctggaagtctaaaatggaggttcaacaggatcctgaggtgtctgaaggccccaggggaggatccttcaactcctctggcttctggtggttaccagtaatcctcgttattctctggcttatagatacctccctccagtctctgcctccatcttcacatagtctcctcccctttgtgtttccgcatctgaatttccttcctctgataaggacaccactcatgggattaggtatcatcctaatcattatcacctcatcttaacctgattgtatctgtaagaaccctatttcccaataaggccacattcataggtttcacagttaggacttcagtgtatctttttggaggatacaatttagcacatagtaaggtataaatgctttattttacaaccccctctaatgaaaaattagcagacttcctaaaggagattcatacttctaattttatattatctattctcaaagatggctcttatgaagttaaaagtcaaacacatactttgagaaatgtggataactaaaagttagaggcattcaaacaaacaaaaacaaaaagtatcgtgcatagtggataaaaatgtgctggtcataagaatttgatggtcaaatttctgaatgtgattttgtaacctctgcgtaggaccacgtatagaattgcaaggaaaccaattttaaaattctccaagggaatttcatgtccatatgcataagagagagaacttatctctgataaatattggaaagctttgtgtaaaaaaacaaagtgtaaatgataagaaaatgtatcattggtttgaaagcacattctacgtggaactaaccgaatgttgtatcgttacatttgggtccttacacatgtaatgtagagagaagagaacacccagctaagacttggggttagcaaccctcggagcaggattatacttagggacaaggggaaagaatctggcttcattgctttggttgacccgaaaaattttcaggaacaaaggaatttgtaacttgaccttgatatgcagcaccatgggaacctcccactaccaaataaatgaaatcattaaagactttacttgtagatagtaataatactggaaataaaacaaccacacacacacaaagagtgcaattaaaagaagaaaaaaatcttaaatttgctttcatttttccttagaatgtagttccctttccaaaattacatgtatttaagaataaattaagtcatctttttgtcatactgtacttgtcttggaattttgtacgatgggcatctactaaacagtgaagcataagcttaaaaccatagaaatattacaaagtgttcccagagagttgtttacgctaaaacaacatgaaaagttgaagagaacaccactggcaccccatcgatatacattaaatcccttagcagcagtaagaaatgtcctcacatttaacatataaatgctgggcaagtcagctgtcttatatctaaaatcttctcataagaaatgccttcaggccaggcatggtggctcaagcctgtaatcccagcactttgggaggccgaggcgggcagatcacctgaggtcaggccccagcctggccaatatgatgaaaccctatctctactaaaaaaaaccacaaaaattagccaggcatggtggcacacgtgcctgtagtcccagctacttgggaggctgaggcatgagaattgcttgaacccaggaggcagaggttgcagtgagacaggatcacaccactgcactccagcctgggtgacagagcaaaactccataccccacctgcccccccaaaaaaggaaatgccatcaattaaatatggttatttccttcaaaatataagtccttaaactcaaactgtaattagattaatgtttgatttttctctacactggctgaaatagtaaatctttttatcttttttctaggcctgcttttgcaaatgtttttgaattcgctttgatgttttcattcatactgtctgttatagaactaaggcctacattcattcatttatatccaaagagattatgggcaactaacaagtagtagagcttggattaataaatattttctgaaaacctggcattattgttcatgttgaggtagtgaacaaatcaggggaaaaagtgcttgctcttggaagattacattctaggccagatagtaaaccaataacattggttaaatgagtgtatttgggggaaaattaatcagggaggggacaggaagttcttgggaggggattgaggattatctttaaatggccagagaaacctttgattaagaagatagcatttgagcaaacccctcaaaggagtgagaacacacacaccatgagaagatgggagagaagaacactcttggtagaggggaaagcaagtggaacccgatatccagctggtgtgtgcagggagcgattaggaaagggagtcagtgtggctgagaaaaggtgaggttggattgtgaagggtctttaacaatgactgagaaggttggaccgagtgaatctagtttattttaaaacagtctctcaggctgctgttttggtaaaaggctgtagttggatgagggagaacagtggcaactattgcagtaatccagatgaaagaaaatcgactagattgtagcagtggagccagtaggtaatgatcaattctgcatacacatttggaggtccagccagcaggacttgcagacaggtgagatatggggtgtgaaagccaaagggtcaaggatgacaccggtcttcctgacgaaaaggctcatacctcccctttccactgttttacactttctccttcccctttcacaatttgaggtccacttcactgtgtttccctgaaaatgacttttgacctatacatcctaaaactaaggaatttgttctgtatgtggtcatagttccaccaaaattaacggaaccatggacagctccctcccaaacaaaattcccagcgtcctgtctcttctagtttcttttgatgggttctcagtcagttccgaaattcctcagatcaagtcttggctgaatgctctttctgctgcatctagggtcaagaatctactcatctaaaacctgctatggtaaattaaaattccaatcagtctctaatttggggaccttgccatttagaaataagcaaatggagaaccctgacttaaagctaagaagctgttatactaaaaatagcctttaaaaatattgattcacaaataacctcctcaagcatatacttccaccttgaaaataccacctaactgtaatcttttccttttggcctttgttccatcagtgttccaacaatactactggggttggaggggggtagaaagtaaactatttatcgcctcttaaaatctaaactggaaattagctctcatccacatttacatagtgctgaatatccttcattaatgctaaagtacttggttaccctatctcacttttgtgtaatatgcctctctttgaaatgctaatttagtattaaaagcaaaagccaactttttctaaccaaatgactaacaatttattaaattttagagtgagatgaggaaatcacaacttagaaccttagcaatttctgtaagttgttaatggttaatttaatttggcttggctaatattatataattggaaattatttttatttactgcttccaaaccttttagttaacattttgttttatatttttcttagtatttttaatattttccctctggtccattattattatgtgattattttttccacttttttcgtagaggagtttgtcctcccctaattgtagtgagtcacctagaaactctgtgtcaattaacattttaagcagtacctgattatgcaaaaacaactccttgtccttgaaaatattcaaatcaatatttgctattttatgcaatgttcctcattttaaaaaacactttttttaacttttatttttggttcaggggtacatgtatagggttttctatataggtaaattatgtctcatgggggtttgatgtacagattatttcatcacccaggtgtaataagcatagtaccatataagtagtagcttttaatacaaaaaaatttttaagccatcactttctattatgagaatatcaatgagaaaaaaattttcaatctaattcccaaagaactttcaggctttttttatttgtttaccaattatatgcataaaagaaaagagcacaaaaaaaggaattacacattgaaattgaacatattaacctcatcagaaactgtttttccacttggagattggaaagtatttattatgtagcccaagattcccaagacttttttttatagctcccacaagtaaaatttgattagagctatgttttaaactaattatcattacaattattgtgatattctacatgcctttgcctttttctggctcttacaactggcttgcattggaaatactcagatttaaggaatgattacaagaagttttcaaagaaaaatatcataaaatttcaaaaactctttgactttcaagaattggcttaaccctgcggccatttaccattgacatgttctgctttcttttttcttgatactgattttgctcttttaaaatgattagcctaaaagaacatcaagatctgactgtgaaaataatacggataacactaaagataagtaaattaaatattattttgtatgtgaattttttagcaaatatcttctatatctaaaatgctcttaagtagagaaactactggccaaatttttaaaactgtaatgccttgtatatctggtgcaaatatgtgataggtgtcaagtgattacttgggaagcataaataagtctacagtttatcctatgaagttgattttattgtgctttaacaaaaagaaaaagaaatctttaatgtatccttcatgtttcatgaataatcagtgttaaaaaaaattcaaagagacatgttaaaagcatagtaaggaaggctttattcagaaccattgcaatagatacagggaccactgcaatataattttgcagcgaggaagagagattgggctcaactccaagtataggaaggacaagcgggaatttatagcaaaaagcagggttgggtcagtggatagaaaattactacaaagaaacaatccaggagtataggggtttctaaccaaagccacctaaccagaattcttgccaaaaacaggctagagtgatcagacatcatctgtggggtggtgcaggaggaacgtggtcaggtatcaaggatgatgagatactgagaacgatcagctctcaagggcggggagttctggctaaactgacttcgcagggttcttttgctaaaactggattttacaagagagtaaacagatgggcctaggagaaagttcagagcctgattaaaatttggtaaagaaaagaatcttcatcatgggttagttcaggtactctaagaagcagaggttaagacagaatcagacaatcaaaagatttattgggcaagtacttctaaaggaaaaagaggttaaagaggagctctgacattcaagaatggtgaaagggaaggatgagtgagtgggtagggccccagatggttgcacagctgaggcagtattggccagtctctagcaaaaattgtctgttagaatcctgtgtcagaaagaaatggcctggctctcttactcctgctgtgttcagactgagggcagtccaggcagcgtggcctcagctggtaagcatctgtggaccctatttagagcagccaactctgacctcaggtaggaagggaaatgtcaccagggcccttccttagtagccacaagtcatttggtaatgacacaaaaatgcaatacataaaggtagttacaggaagttattttaaagcacttcttgacaaaccagaaagaagtttgtgtttttttttccccaacaaagttgatatttttgtttgcatatctaatactctatgacagaacaagtaggtagaggagatgaatttagcatacttacttttttgaactgctggaaattcaagtaatattcttatatgtacagaaacaaacagaatgggatcccgtgcctataactgtgatggtctgttattgcttattttgtctgcttgcctgttttgtttctcctttaggcaatcaattatttgtatgtaaatttaattattaaatttattattatttacatgtctctcttttaactaaaaagttaagttctttctggttctgtggcttgttttccattgttgagtttttaaaaagatcagattttaaaataagttagtttttctagtttggtttactcacgtagtaattaaatagagcttttgctgaactcacccctccttttatttttaatttctctttctactttgggttccctttgtccatcccagcaaccagatgtttctcaagtaatgaaaaatattttctactcctcctgggaattttattttattttattttttattattattatacttcaagttttagggtacatgtgcacaatgtgcacgttagttacatatgtatacatgtgccatgctggtgtgctgcacccattaactcgtcatttagcattaggtatatctcctaatgctaaccgtcccccctcccccgaccccacaacagtccccagagtgtgatattccccttcctgtgtccatgtgttctcattgttcaattcccacctatgagtgagaacgtgtggtgttcagttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtatttgtgtctttataacagcatgatttatagtcctttgggtatctacccagtaataggatggctgggtcaaattgtatttctagttctagatccctgaggaatcgccacactgacttccacaatggttgaactagtttacagtcccaccaacagtgtaaaagtgtttctatttctccacatcctctccagcacctgttgtttcctgagtttttaatgatcgccattctaactggtgtgagatggtatctcattgtggttttgatttgcatttctctgatagccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggattttagccctttgtcagatgagcaggttgcaaaacttttctcccactttgtaggttcccatcccactctgctggtagtttcttttgctgtgcagaagctctttagtttaattagatcccatttatcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtgtaaggtgtaaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccattaccatgctgttttggttactgtagccttgtagtatagcttgaagtcaggtagcgtgatgcctccagctttgttcttttggcttaggactgacttggcgatgcgggctcttttttggttccatatgaactttaaagtagttttttcccattctgtgaagaaagtcattggtagcttgatggggatggcattgaatctataaattaccttgggcagtatggccattttcacgatattgattcttcctacccatgagtatggaatgttcttccatttgtttgtatcctcttttatttcattgagcaggggtttgtagttctccttgaagaggtccttcacgtcccttgtaagttggattcctaagtattttattctgtttgaagcaattgtgaatgggagttcactcatgatttgactctctgtttgtctgttattggtgtataagaatgcatgtgatttttgtacattgattttgtatcctgaaactttgctgagataagaaattttgtaagactttttggctttcaagaccctaaaaatggttgaatatctaatgggaaaatttgaagtgtttttggggaaatttgaagtgtttttaggtataatgtgtgggattgagggtccgggaatttaggccaaagactttcctagtaacatataattcagcctacttcaaaagttagccttaaacttacattgtctttaatacttttccaatcaaaaaaatccccaagcctctctgacatctagatctttctatctcattcactgaagttaaatacaattagtgccaaagttactatggcatcattcctctgtagaacttaatctataataaccagtaagttcactacctcacaattgggaagagagaccttctctgtttttagacacccttattagatcagtatgcaaatataaaatttgagtaaagatattctctgccagcattggactatatggtattatttccaggagaagctacatgcttcaaaaagtcagcaataaaaaaaaaaatcctttaatatctttggaacttttcctattatctatgggctattgaacaaagagatggactcaaggattccatatgtatacatgattttaggtttaatatttaaaataaaagaatatttgaagggcagaaaatacatgtaaagggggaattgcccctagtaaatatatagtcaatgttatatgtagaaaaaaatgttggaagatcaaaagaaggaaaaaattcaattgggctttagggtggaaatgcaagctatcaggctgaatgaagcagacgggtaataaccactatgtaaaagcttagaagaaatagaaatagttctactatttgctagcctagtgcaaaagttgattcgaagagcagtgggcagagattttgtgtgtttgctaagataatacatgtttcataccaggctttcacactttaatgtccttaagaaccttctagggtactttacaaaaaaaaaaaaaaaaaagtctttggctgccttcttagtaaaattctgattcagtaggtatgaggttgggcccagaaatatgcattttaaacagattttctttttttcttatcattttattggccaagaaatcatatgctataaaattcaccatttaaagtgaataacttggtgtgatactccgaatattcacagagtcttgtaactatcaccacaatctaattttcggccattttcatgaccccaaatagaaccccaaaactattagaaatcactctgaattcttccacaaaaccccaaatcgtaggcaaccacggcaaccacgaatctactacttcctgtctctatggatttgtttattctggactttttttttttttttttttttgagacagagtcttgctctgtcccccaggctggagtgcagtggcatgatctcggctcactgcaagctccgcctcccgggttcacgccattctcctgcctcagcctcctgagtagctgggactacaggagcccgccacacgcccggctaattttttgtatttttagtagagatggcgtttaactgtgtcagccatgatggtctcgatctcctgacctctgatccacccgcctcagcctcccaaagtgctgggattacaggcgtgagccaccacacctggccttattctggacattttatataaattgaattgcttaaaaaattatcttttatgactggcttctttcatttagcatgttttcaacctttattcaactgtagtttattcaattcatgtaacagtactttatccctatttattgccaaatatttttacatatatgtatatacatatatgtgtgtatatatatgtgtgtatacatatatatgagacacttattcattcacaagtgatggagttttgggtctttccaccttttggctattatatataatgctgatatgaacattaatttacctatttttgattgcacatatgtttttctttctcttgggtatatacctaggagtggaattgctgtgtcatatgataagtctatgtttattgttttgaaaaattactaaattacttcctgggtgatctcaatgcttgtcattctctctccatactttgagaaacactaatgtaggcaaagatttggggataaaaatgtaggaaaaaaacaaatgtctgttattatcagacatttgttgcactctgataataaaaaccttagatttcatgaaatggagaggaggattagaagagaggcaaagaaagcatcagaaaaataagacactggataatgatgtgaggttagcatcatcaagggacaagttagaaatccacattttaaaaaattaaaacaaaattatagctaagtgattaagtagtataagaaagtttataatgtgtgtttattaaaaggagtgttaagattttatttatgtggagatgatacaataaggttagccctcaatcacttattaaaatcaatttattaagatttaaatacatatagtaaaatttagttacacgaattttgattcatatacttttgaaagaatataaataatggtaacggatcccattgtatgattacagaataaagtagttatatacaagaatgtttattgcaacaacatagtcatcaataactagaaaatgcctaaatgagcaacagcagaaagatgctaaaagatactgtggcaagtctataaaatggagtattatgcagccacccaaagtcgtgattttgaataatattaaatggtatacaaaaaggttaatgacatagtcttattgcaatggggataaaatattttaatacaatacaaatttataattgcattctcctagacctgtctaatattttccatatcagtgaatgtgccattgccctccatccaggataaagaatgactttagtcttagttttatcttaatgcaacaaatccagtccttcacccaatcctatttaagtatttatttattatccataactattcatctcataaatgattttataatccatctgcctctcagctgtttcactgccactgtgataaaccagactaccatattctctctgcaggactgcttaacagttccctgatttatccactgacggtttcagtccattctagttagtcctctttcaatctatcttccactgactttgtcttgccaatttcccctaccctttccaccctcactgacttcctgtttctcttgtgattgcaatacttatttatttgtttagcaatgcaaatttataacctgaattacaaggaccttgcatcgtatggttcctttctgtgttacacacatcattcatcctcacccagccttctgcttctgtgcaccagcatcatgttggccttccttgagctaatagagtgttatgctgcctttgtcacagggatcctacacattctactatttcctctgtctggaatgttcttcagcctaagatgactacttctttctcaaatctcactttaatcaacacttcttcagggaagccttccctttgtctcagcccctggctaaggtcaggttctttagttttgagtatatataatagattataaagatatatgaattagggagattatttgtttaatgtctgcctacctcactgtcgcttaaacttcaaaaaaaggatatatatatatatatgtgtgtgtgtgtgtgtgtgtgtatatgtatatatatgtgtgtgtgtgtgtgcgtgtatatatgtatctcttttttttccttggcttctcttttcctggttttcccttctcttaactttctgctttctacggtttgtctctttcttcttacctagttttgtacccacccattcctcactgtaaaagaaagtaaaacagaattttagcaatactatctctgattcgaagaatgaataattttaatgttctcctttcttttttcgttaaaattttctacagtagccatttgtaggtataaaaccaacatgacaagcacttttatagtactaaaaaataataagtgaaaactacttgaatatatttccatataaaaatgtaaagttcgctgggcgttgtggctcacacctataatcccagcactttgagaagctgaggtaggagaatcacttgagcccaggagttcatgaccagcctgagcaatgtggtgaaaccccatctttgcaaaaaatacaaaaattagctgggcatgggtacgcgcacctgaagtcccagctacttgggaggctgaggcaggagggtctcttgagccttggagtgcagtgatccaagatcgtgccactgcactccagcctggagaacagagcaaccctcttttgtttgtttgtttgtttttttaaagacaaaaattataagacaaaaatttaaagacactgttatactatgcagccataagaaagaatgagctcatgtcctttgcagggacacagatgaagctggaaaacacaggaacagaaaaccaacaccacatgttctcactcataagtgggagttgaacaataagaacacatggacacagggaggggaacatcacacactggggcctatcgggaggtggggggcaaggggagggagagcaataggacaaatacctaaagcatgtggggcttaaaacctagatggcgggttgattggtgcagcaaaccaccatggcacatgtacagctatgtaataaacctgcacgttctgcacatgtatcccagaacttaaagtaaaattaaaaatatatacgtatatatttaaattttcaaaacaggagaaaaatgtttactttagaaaagcatgtctttaattttttctaattttacatagacaagagtttcatgtggtaggaaacaaactagataagataaagggaggtgaaatttgtcaggattatttttaaaaatataagtggataaaagtaatcttctgacatagcacttgtgtttaaatgtacatttgttacttacagttactaataatttattcatgtaacaaaaattgttgaggtttcttcttttttgtcattggtgagtggattttactttccagtatagaatgtccataaacgcaatgtgtccagtaagtttaattttaaaaggctttatattgcatcaataatttcagaattctttaccatacttcttaattctttaaaaacattaagtatatatacatttttattagggaagttaatctcttgtgttatgtcaaagtatataatggtaaatatcaactaaatacattgtttcttttatttttcctttgcacttatatataagtaatgttattttgttttaagacaacagtctcactctgttgcccaggctggagtgcagtggcatgatctcagctcactgcaacctctgcctcccaggttcaagtgatcctcccacctcagcctccctagtagctgggactataggcgtgcaccaccatgcccagttaatttttgtaattttagtagagatgaggtttcaccatgtcggccaggcttgtttagaactcctgagcttaggtaatttgcccacctcggcctcccaaattgctgggattacaggcatgagccgtgacacccagaaatgagtaatgttaaatataggatttctatattgaaaatattatagatataataatattaacttttaagatagagggaaaaaatccaaattattaggatagtcttcagctatataattatagaaatccaacttagtaacgatttaaactggatgaaggggctggtatggcattttgtggtttcacgaagtatgaattctatttcaagcatcagcaaactcttttatatagggtcatatagtaaatattttaagctttttgggccatgtgttctttctcacaactactcaactttgctttgtagcagagaaacagccataggcaatacaaaaataaatgggtatgtttgtattccagtaaaacatttacaaaaacaagtggtggattgcatctagcatgcaacctctaatttaacaagttctaatctatctagattttccaccatctttagtacattgtttctcactcttggtcaagatgtcttccatccccattccatacagcaggaagaaagaagtgaaaagagtcatggagcccctttctttaaggacacttcctgaaagatgctgaagatatttctacacatatcctgtcagccagagcttagtcctgtggctacaactagttgcaaagcaagctgggaaataaaattcttccagacattcatgaatccagtgccccctcccctcaaataaaaggtgcagggagattttttactgaaaagatcatgaaaacagattgtagggaaaactgacagtatgtaccaatattagtacacagaaatacctatattaaccctttttccaatacataggacatttttatgttccttcaagtgagaccttcccaaaatctcataagttattgcatccatctcaaatccatctctgatgatgtacagaactctacgtcaggtcaaggtttcatttcttgtggtagagtagtatataaattaaaaacctgtttactgtgaaatacactcctcttatgaaaataaaagcatgagagacacatagccattgctggtccatagcaattttaaaatcttgctaggcaggaatagcaaagaggctatttttccagtgccttttgtgacccaaagtttcactctcgcagaggtccctatgagaagccatatcgtgatcctatctgagaagggcattctgctttttcctgtctagtgggctgcatgctttcataactgacctcctgctgatacaaattagtgattaaggactgctgaagtcattgaaagggcacaaaactttgcaggccatgcttatggtttccttggcaatgtaagtttctcaaaaatgttatagtcttctaatctattttctttcaggcagttctatgtgcaaataaccacacctaaacatctgttcttgacatagtttaaaacctgttgactattctttttcatacttacctctgtgttctgccaattcccagtggaggtgagccctctaatctgccttcaagagaacttgcacctccctccttttcttctctctgcctttcagctaatgtcaaactaccttgaggtcctgaaaaagaataaacctttagtggacgatgatatcctcaatctgatcactgcaacagtgctgtgccccagtgtctggtagataacccttacctgaaggttatgaaagacatcctggggccacaggcttacttccttctaaagctgcctcttggcagctgtggtttagacttacaccataatgcagtttaggatacagagttattttttatttttttcatttttatttttttaaccctttcaagcttctgaattagggattttccatcattttagactgtcaacataagaagaaagcaccttctacttcacagtagctttactctcatctcagcctttaggctggtgagttctagactaacttcatctctctcctggagactttgctaaacacagcaagaaggagccagtgccagtgcgcaagagcacttgagtctttccaagcatttctcttaacatggaaagtctcagttggcacctaatttgccttccaaagacagcagttgacaatataaccaaatatttagctacggtataacaaagatctcagctttccacagctagagtatcccagtcttcaaggcctggtgtccaccacaggcaattccatatgctttttaggctttgtcacacatagcaccctatttttatgtatagtacaaactatggtatgagtttggattaggttcagcttgagtaacagagactgaaattaacaagatgaagatttcttcctttgttatatgagagaatatagaattagactgttcaaggctaatgcagtgttccatggagtcaggaagctaggctttttccatatttctgctttatatttagtacaagcaaatatcccaaatggcaatttgagtgccagatattacatccaagttctagataggaggaaaaaagcatcaaaagatatggggtgattctcacccttcaaggccactcccctgaaatctcatacaatgtttacgcatgtatcacctcattggctggaacatattaatgtggccacatatagttgcaagggatattggataaccaaatatccaggtaaagatctaagtctatgcaaggggggaaagtaattattgaaggctaattagcatctttgtaatactcctatatttgatattaaacagtttatattatctgtgaatttgattatagtttgtgtgctcaattgtatttaataaagtggcattcaatatttattccctccgtgagcaaatcttgaaaatttgtatacggctgtttaacctaaggatatttttgcatcagtgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggattagtcttgggagggtgtatgtgtccaggaatgtatccatttcttctagattttctagtttatttgcgtagaggtgtttgtagtattctctgacggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctgtatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccgactatgtggtcaattttggaataggtgtggtgtggtgctgaaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgtgagtttggaaaattcatttaaaggagttcatttctttttcaagttttcaattatccatcatcctagcctgaagctttttataacaaattatttagagtagtaaaattagttttttaagcaatagaatattttttaattacgcatttatatctctgttattcccaatcatatttctgttctccacaaacagctttattcaataaatttcttgcctttaatttgagagaaaaatggaccatttcccaaaacattaggatctattaaaaataatgtggatggttatctaagagcttttttttctttagcttagaaagcaaaggattatacatttcttagtttccgtatggcagaactattaggaaaaaaaaaagaaataagatcatgaaggtatagtgtgtagaataggaaattaagaggccagagaaagtatctttggaattaggaagctgtctaagacattgatggcttgaaaagaagtaaggtgtattaggtgaacaactagatcacaaggttcaggagagcaggagctactcttgattttgtttatcccagtacactaaaatataacacagtgtctgatgcatgcaaagcactcattatacatcttttcaatgaattcataaggataattaaccatattttaaaaactattagaaatgtttatattattgtgtcctagaagacaacagtgtgcatgatttaagcatttttattttttgcaatcacgttattaaagaactctaagttgcatcatgccacatcagatatgtaatccattcagccttatgttttcatctctggctgtagcattaaagcttaatttatagaaaggtgtgttctttccctagatatcaacttaaaggttaaagacatactttagaacactttagtctttcctcaataaacatctccagtttttcctcataacaatttcatcaaatctttcttcaacttatttgtatattttaaatttatatggtcccttaaaaaatcacatgctgattttatttttactttttttttctagtttatcatttgtttttcaaagaaaaatatcttttaaactacttgtttaatgttaaacaatgagctgggggggcattttgtttttgtttttgttttaagtactctattaattttcattgccagtgaagacctaactggctaaacaaagatacacctcagcagtattcttgtttgaaacaacatatgtaccaactaggaaaaatgcattgttaaaattcactgcatgcctgtaggtaatggcagaagtgtggaaaggcagcctctgactttttaaaacatccatgtttcaaaataattttaggaaaataaatgtataggcctggcacagtggctcatgcctgtaatcccagcactttggaggctgagacaggtgaatcacttgaggtcaggagttcaagaccagcctggccaatatggtgaaactctgtactaaaaatacaaaaaattagctgggcatggtggcacacgcctgcaatcccagctactcaggaggctgaggcaggagaatcacttgaacccaggaggtggaggttgcagtgagccgagatcgcgccactacactccagtctgggatgggagacagggcaagactccatctcaacaacaacaacaacaacaaaaattagagtatttaaaactaactaaacacaacttatttatagtggtataatatatccatttaatgttttggaatgccatgtctgcctctgtgaaactagactgttgggtttaattatgcggttcttgcttttctgaagaggtgaaagaataaaatatcttggtgggaggaaagtcctagactgagggaaggcatggaaatagtttgctttatttacaaagaactgaaaatgaagcgtaactcctattattgctgtataattattgatttggcttttctttttagccagtcaaatgacagctaagattccctaaataatagtgggaaaaaatatgttagtcacagcttccatctatgtgttgaatacacagaatgtaatgttttcttattgtgattaaacacataaagcataaaagttaccattttaactatatttaagtgtacagtttggtgacattaggtacatttaccttgttatatgaccatcatcactattggtgtcttcaggacttttcgtcatcacaaatgaaaactgctcattaaaaactaactccctatttcttcctcctccagcctccagcctccactaaccagcattctattttcctttttttttgagacagagtcttgctctgtagccctggctggagtgcagtggcacaatctcggctcactgcaagctccacctcctgggttcatgccattctcctgcctcagcctccccagtagctgggacgacaagcgcacgccaccacacccggctaattgcttttgtatttttagtagagatggggtttcaccgtgttagccaggatggtctcgatctcctgacctggtgatccgcccgccttggcctcccaaagtgctgggattacaggcgttagccactgcgcctggacaccagcattctacttgctatctttatgaatttgaatattctaggtaccttatatgagtggaaacatataatgtttgttcttttgtgcctggcttatttcacatcacgtttctttaggatccatatatgttgcagcatatgtcagaattttgattcttttcatggttgaatcgtatttcattgtatgtgtctatcacatcttgtttattcattcatgcatcaatgaacatttgcggtgtttctgctgtttcactattgtgaatgtactaatgatatacaaatatttgtttgagcctctgcttccacttcttttagatatatacccaggagtggaattgctggattacatgttaattctattttaaattttagagggactgcttcactgtttccacagcaatgacacgattttacatcccactagcagtgtacaaaggttctgattgttccacatccttgccaacacttgttattttcaaggttttactttgttttgcttttgtggtaacagctcttctagtgggtgtgaaatggttttctttcacaaatgaggtgaaacgtatagaagtgaatgtttcctgtcctcacttacccttggcttttatacttagcccatttcacatttcacaatgagaccactagactataagttctttgagggtaggaagtatgtctgtcttatttaccagtgcttttcaacttctaatataatgggtacttaatacatgctgaatgggtacatgcataaatacaagaatgtatgacaaaagtaaatgaataaacaaacaaatgagtacatcttagaatccaatagaaagtattgctaatttttcttttgttggtcaggcaagctgaggaaatttctaagcatcataaaaccccaaagctgatatgaaggggcttgttaggtttttctacttaaaaagcatacatgcccacaacagaaatattcattggcttcttactagttctaggaactcttctgagcattttgctgaacttatctcactaatcctcatgatagccctagctgctggctctaccttatgatgtccattgaagagcctccagtgatgtgatttgctaagaatcctcagctcttaagagtccaagtggagattggaatctaggtgtgtctgactctagacactaatctcttttagccagcataatatattgttcaccagaatgcctgcatttcattggcattttcttaattactgaaaagtaattaagaaaaggttaaattgcaatcactgcttttgatattccacaaacatcttacgttaaaatttaatgaaatcaaatagatcagaataaaaaagcaaaatgtcagattagctacattttagaaacctctaaaatgtgggaaagctgttctgcattccttttgtagctgtctgaattttgcaattatgaatgtgcattattttttctcatgttgactttcctcatgttatttataagaacaagagacttacatatagttgagcactttaaaatatctgttctgagcttagtgggacttaagaaaagctctcttccttccacaagtttttccttattgtctccacaagaatacttgaaattctcatatcatgtggtcttttggggtaaggatttaaaagcaggagtgaaaatgcaaatgtcatcccaaagagttgatccattaagccgttatcagccaccaataccttagcaggaattagttgattagaaaccaaagaatctagagagaattaactgtgtaaaaaaaaaatcacatactctagtaggccagaataagctggcacttatacaaacaaaatctagagacaaatttttggaaaaaaaataaaaatagaggtaagttgggacaaaaataacgagcaagtgtcaggttggccgcgaatgacaggaaagaagcaaggtgggctacttcagtcatatttttcttccacatcttcccacaaagaaaatgagtttccaactggaaatgggagaacttggcaagtatcagaaaaaagaaactggaatccacgataaagagggagagagcctctaattgcctgtgaaaggagctctcagcaaaggatgtagatcagtgatacaaattttaacagttaaaaactaaatcatacattctgtgaattcaacaactaatatagctggaggttgtgaccagtacatttgtttgagtgtccaggtcatccagggtcaataaaagtacacagcttctccactactgtagtcacaatggacggttcctcagccacatgtgtgcaaggactgggacgactgaatcgactatttagagggccgaggccagaaactacaggcaagaataagccttccatctctggaaatattataaaattaattcttaaactgataatttatcagcacagtcattaatgaagcaaacgggttgcactaagaataattccagaactaatttcttttaatagaattggtagttggcaagatcaagaggctttcactgacaagtaaaaatcattggagaggaagcccccacccttatacatgcatataccatttgaaataactactataataaaccagcctgcaggcgggtgccatattactcagctctcttggtgcagcagtggttgggaactggagagacacagtaactttaccatgatttttcagcaaggtctttggcaaaatctgtagttgaaccttaaaactctagttaagttaactagcttttccttcagtatgcatttgtaacctcaaattaaatagacacagaccaagaggaaaggtgaaggaatctgctgcttttacaaagcgaaggcacctctcctcatctgtctctaccttgaaactgcaatgaaaaataagacagaaatgggatgagaaaacatgataggatttccagtgactgttgtctggtgattaagggattgagcacccccccacacacacacacacccacgcatatacacacacaggtatgtataccacattctctactaccaccatggataatagagtgaatctgagttcattgaggtgaaggtgggtgaaccatcttttataattcttacacattataaaaatgtataacattcttataagttatacattcttataatttatatatacagtattaaaattgatatacacagtattataatttataattatacattcttgtaatttatatatacattcttataatttataagaatgataaaagatccagttttttatagaataatggtagaagttgtctccaaggctgctttattttaagaagacttactgaatgttgtaagcagctagttggtgtatttgtaacataagatacgattgccagaatcctggcctcatggtgcaggtgtaagcatgtaagtgtgtaagcatctctgcccagggaggaaagtatggaggagggcagagggcatggctctccttcccactcatgaggccttctgacatatcttctccaaactctggaccctagtcttgatatatggttcttacttagtatatctcaattttttttttctttaggcactagttcagatcgccatttatagttcttaatttatgctttacatcttcctctactcttttgttaggtcctttgtcacggtgcacttatgacatagaaatggtcaaccaagaaaagtcttcaagaggcaaccctaagccattactatgattcccttcttatgtaatgtttttaatcagtgattcttctggcataataaatatatttggcctttggctctgactcctggcacagagcccctaagacccttggagcttcctgagtggcaggaatgtcttttattggtcacaaagagtttcttttgatcacatccaacttagggcgaaacccctagaaagcctcaaaatgaggctggtcaccagaaagaccaaatgatgagagggttggaatcttttaccccacctaccaacctcctagaagggaagcagggctggagattaggctctatgaaaattcctgaatgacaagagttgataagcttctgagttgatgaacacacagaggtgctaggttagtggcatccccagagaaggtatagaaactgtgtgcaactactcccccggtgcctcccatcatgccttttcctatgcatttcctccttttacctgttcctgaatgtgtccgttgtgataaaccactagatacaaataaagtaccatcttgagttccctgagatactctagcaaattattgaaccctaggagaggtttgtgagaacccaagatttaaagctggttggtctgaagcattgatgggttggacttatgattggcatctgaattatgattttggaactgagtccttcacctgaagggttttcactaactctgggtagttagtatccaaattgtattgaattgttggataaccagttggtgtgtagaaagttgtagagttgctttactcccaaacttataacatccttctttttgccatcctaattggtatgaacagttttactagttgtacaagtcagtgatcctgttcatcatccttggcttcaccctgaactcctcatcaggtaaaaacctgaacatttggtgtcagaaatgctgtgattagagggatcgttattttccctactctgattataacatcaaactacgcttatcaaatttacagatgacacaaacttggaaggaatatctaaggacattatggaaaggttaaaaaggatttgaagagaaatgaaactatctgtattcaagcttcctttctaccactaactagtgggactcagttttcttataaaagagtaatgtttggccctgggagttgagtaaactgctcatacaactagggactagtgagtgactgaagcataatcagagcctaggtatatttgccttagcttttaaccagaatatcagagtggtccaagcaggaaattatgcacctgaaataaggcaatggcagtgatcatggaaagggatgacacagaaaaagactcaaaggactttgaggtacaatgttccctggtaaaagctaaagagaagggcctgaagaattcaggttgaagccaaggatgataaccaggatcgctggcttggacgactagtagaacggttctatcacttagaatggcaaaaagaaggatgcaaacatttggaagtaaagataaattctattataaatgtcaaaaaggagatttcaacattccttatgtaaacaccttgtatataattgggtaaataggtctaaacttcagaagagataatttgggagcaccaatacagcattagccgtggcaacaatagtcaaaactgtacatatgaatgagagtgcacagaatgaggaaccagcagtaccaaccaagcagtgagggacagcagcattaaggagtggacagaggagacagagacacaaatgagacttagaaaaagcaggtagagggatcggcagagaagcacagggcacggagtctatagaagccaccagaggagagagagagggtcaagcagttgcagaatttggcaaaggaggatataaagactcatcgagattactagaagtgttctccttttggccactggccagaccttgttcacttcttgccccttgttcatctcattgcccatggaactaaccaatgatcagttctcaagacttttccaccagtatcctcactcaggagtgatctcaccagctgcttcagtatctcagaaagttcccctatggtcagctggctttactgttcacaacatgtttcaaaacatgagattgacatgttttaaaaaagctgttctcagctgccctctccttattaaggtataccatgacatggctttggcaatagttaatgcagaaatactaataagaaatgagaacattgttatttgcttcaaggtaaataagagttggcagagtaataaagctgctcaaatacaatgttcggatgatcttacctcacattaatgaagaagggccaagaacacgggaaataatagccgtattttcttctacactggttcaactatatgtactatgatgcgctctattctgggtaccaaacttcaagaaaaataattcatttgaagatacagaaaagagggcaaaacggaaaacattctataagtgtttttgtgtatttgtttttaatgatgaagttatccattatagcaacaagttggacacattttcagaaaggaaggctcctttctgctttcttcatcatttctaaaaatgcggatatttttacttaccactcagaaaatgcctgattaacacctggagaggttcagtactggcaatccaaactgtttagcagggcctcctgggaagagcagagaaaatagctgaaaaaaaagagaaaataattctaatacagtaattatcaggtcgagcatggtggctcatgcctgtaatcccagcactttgggagaccaagacaggataatcacaaactctgaagttcgagaccagcctgaccaacatggtgaaaccccgtctctactaatagtacaagaattagccggctgtggtagtgcacacctgtaatcccagctactcgggaggctgaggcaggggaatcacttgaacctgggaggcagaagctgtagtgagccgaaatcatgccactgcgctccatcctggatgacagaatgagactccacctcaaaaaataataatcatcataattatcaatgtgggttggtttctatttatttatataggtggatttttcataaacagatttggaaaacactggcttaaaaacatgcaattttcatgaagcagggcctcctgcacagtctttaatatacaagggatacattaaatgtgaatgtgcaagggacacagtttctcaaatttatttgaccctttttggactgtcttgaggccatagtgctccccagaacacacattgggaaactgatctaggaagtgaaaagagaagaaggaagtggtagcacaagccaagacagatggaacttgttgactgactgccacataaagttcctgttccagagaaaacagaaggcatagtgatgactacagagagaatactgataaaaggcaaaacttgatggtgagaactctcggcgttctgattcttatctaacacattcacatttttatatttatttccattgatccatggtaaggctaaatgaaaggcactttaggcataataagtaagcattaaaatcataaaatagacaaaaataaaataaaaacttagtatattgtcattgaatgctaacagctacagaatctgaatttgcttgagagctgcatacagaaaatgaatccttttaaacaactttctataataaaagaaccaaaccactattgaagatagtagtaaattttacttaaatttttgaaatatcatacttgttcactttggagagatgactaagtaaatataattgacctagaaataagtacattgggaagttttcatatttttaataatcctatatattttttcaaaacaattggttaatagatttatcctagttcttctttattacctacttagagacctctgtacaaatatgtgcttgttaatcacataaataatgccataagtaatggaaaatgctggtgatttttagcaaatagaaaatagtaaaaatacaggcagtcatggactagagtataggcataactgttaggcacaggtaacaatatttaggacccaagtcatcggtccagggatgtgtggctaagatggaagaggtaaaacagggcccttcacatcaaagcagacttggatccatgatgagacacaattgttttctgtatgccaaagccatgaaaatctttcaagggctcatgtgcttgaattccttgaactcagtttcctgctagaatctctgcatttttcagtcctactcccatcttgactgccatcccaaaggaagatgtgtctaactctggtcctctcaaagctaatgtcttaatccaacacttctattctcccctttggtacatcaatccatcttttgtagttattctatctgcctcctccttcctcttcaacttttaatgggctctgatttccttaacttcacaaatatgcaaataccaaataaaaccccaatcatcccttgactttgccttttcttcacaggaattgcttgtctctttcttcacttagtgggtgaaattattggaaaaataaccaataactgttgactgtagttcttcccttgccatttatttcttagggaagcattctggctcttattatcatctctaataacaacaataatggagtaacaggcacttataaccataaatgcattccatagaagatagaaattgttatacagttggccttttcttctgaaaaatctcagtgggtttggttatgttcttttggagacaagactagaagtgaactgatctgcacaatttggagatcaagaaggtaattctagaggaaaggaatagcagagcacggaagctgagaaggagccagtgagattgagagtagataaccctctctgcagtgtgactcccttactgtcacccctagctgtctagcaaatctaactgaataacatgcataccatgaataagcatgttcgtgtgtgaaaacgagggaagggctagtttttctctcccaggttagtgttggtaaacaaagatacatatagggatattctcattacatatgtctacctcccttactgtgggtcttatttaataaaagaatgtttcttcagcgtttgttatccaaacactcattttattttcacaataatctcacagagtaccacatgctattatccctattctgcagatgaggaaattgaagctcagagagtttaagtggcttgccaaggcctacagaaccagtaagtggcaggaattcatattaccttgtacttagtaggtattcagtttatattaaatttacctagtttgagaggcagcatgcattttagtgaattggattgtgagtatattcatcaactcttgttctatggtaggatactgtcttaaatctaatatacaagcaaggactcatgctgagttaatgcttctaatagaataacctagaaatttattattttactgtggtgctgtcagcactagaaaaactttatttggtttctgtttttctcatttttgctgcaaataaagagaatagcctcaggaaggtgatttgcctgtcatttgatctttatgaagaaattacacataattaacttatttcatttttagtaagctactaattaggtgcttcgttgagattgcaaaggtttaattttctggcttccagcatggaagtaaaaaagaatccactatcatagagaaaacaaaatcatcaggagttcttgagcccccaaagaaaataaatgattgaacaaaagaatagcaatgggaggctttaatctgagcatttaaagagaaacagagacggaggaaatcttgcgatcaaagccaccaaatgaaaagagaaataaattatttatttagcagagggtaacatttttcttcgtgatacttatttttcttagaaatcaaacccatcctctctattgtgtcataatattttagatttcacagcatggattactgtactcttttatttttaaatttagccttattattcccaacaggcaacttaacatttaatatctgaaggtcattgctgtacaaatgtgatgtgaaaaaaaataaaatttagcagctgtatcatattatactaatcagaaaggaaggaaataaagaacaaacagcagtgtaagatggctgcagtgtggatgagtgagatggactaagcaattaagtattttgttgcagagagaatctgactgtgtattgtttttctcaaattttcagcttgtattaggtagagtcaaagagaatatagaagtgttgagaattaggacaaaattcagtttatcttatatgaccttcatttgtggagtaaaaagaacatatttcagaagacagatatgctagctcttgaatactaggtgattttaatagtattatgataattttattagagattatttacaatcaagaacctgagaggtttgctgttgttgttgccattgttgtttttaggaatgttcacagaggtcacattttccaaccttagagttttgctgcttgatttcttttgtatttgtagcttacgtggaagcagcaccatgctcagcacaagaaaagcctttcaacaggagtttaagcacagctatatgcaagtgaaattaaacagaaaacaatcccaatagtcctattcttcataagaccttaagacacttggggtttggtttaatttattgaagtctctcactcttttagcatatgggtgataatagtcaagagaaattatttaccatcatctactgatgaaaatcgtaggtggaagagatcttggaatccttctaggattggtaagaacatgaaggtttggggagatgaaatcttgctaaaattatagaactagttagtggcagagatatgattagagtccaggacattaaatatctagttcagtcctctttccactgttcacctctgagtctctgctccctcaatgctaggacccaactattgattatctcttgatttttaaagtgtaagaccatggtactgtttttcatagccacctacaattctctagaactctatggaaaatttcactggcattttatgataccaaccatggaaattccctctcaattccaaagggacattggcagaattttataattaagggccatgtctagtgttatcagccaagttatgtcccccaccagcttaaatttttttaaccaaaatgtcctctatatactgcaggagatagggaagattatcaattagggaaatggtaagaaaatattaaaacttttatttttataaaatttaccaatatcatgcacccacatcagtccacttgcataagtcaagagtgataaaatatttacacaacaatttcagtgaagcaattttattactcacagataggtagcaaaagacaagggaaggttaggatgtatggtgagccagcccccactaaggcacaggaaaactgccaagggcagatgaagtctcatctgtgcatattctgtgttgcactgcagctgagggccccccaaagcacatactgccctgggttttatacccaggggcaatggaattgctgagctaaagcatttcaggacaccctgttctgggaacaatgggaacagagttccagcctgttccttcatgtcttcaatgttgcatttccaatgtattctacagttactctgagaactacaagtgagaaaggggccatatggggacctgtcctgcagtgctgtgtgtcttctaagttagggtatgcaatataaaaaaaagtttgaacaacaatatcttaaaaccccttttagaaagtcagctgtagtcatgaaaaggagtgattctaaggtctctacaaattgttatcacaaaataccacatagtctccatcacaactccttaggtctctgtaagttgtcatcacaaaacaacaaaaacaaatcctatttgaaccctctgccatttctaggatgagcttgctcattatctctgaagatttacatggagtattcaaagcctgcagggtggctccaattagtatccattttgagcattggaatagaagaaaaataactctagtcatcagtaaaatgtccttaaatagttgacccctgaccttactgataaaatttttaaatctgcatgtcaagagaactgaccttgaccttgacatttgatggggcactgcatctgagtggttagaatttgatttgtggttttatatttagtctggaaaagatgaataggctactgtgttagttagttctcacattgttataaggaaatacctgagactgggtaatttataaagaaaagaggtttaattgactcacagttctgcatggctggggaggcctcaggaaacttacaatcatggtggaagggcaactcttcacagagtggaaggagagagagaatgaatgccagcaggggaaatgccaggtgcttataaccatcagatctcatgagaactcactatcacgagaacagcatgggataaaccacctctatgattcagctaccttgaaattttaaaaacttgaaatttttagcctaagtatttcttttcctcatgtaaaaaattcacagaatcaaataaaattacagtgattgtcttaatcacctttgaagagcaagggcagtctacactgatttttttaaaccaaatatagaacataagaagaaagagtgctctttattttattgtgaagtaaatgccctggtgattgttaataagtcaaagagaagtggttttgtcacagaactgttagaatttaagtagtatattattaaagcctattagatcaccatactccttttcaaatttttaatagtaaggtttcaagtctaatttaaactgaaaacgttacagagaataactaaaacattttaggagacttttttccatactaattagcattttaaatcagcctttcagagtacaggaaaaaaaactccataaaattttatttttattaagtgaaaactaaatattctgccaacacaaatatttgctaatatgtatacacatgtgtatgtagatatataaaaagtttggaaggacaggggccaaacagaaaatgggggtcttgaagagggctgggggtagggggagctcatatttatcatgcttctgtattatttgaatactttttcatgtaccatttacttaattaaaaattaataaaatcatcttaaggtacttgtatctgtattttaaatatatttattcaaatgtattttaaatgctgccttacaagaaatacaaacagcttcatataaacaattctatcatcattgaaatgtctactttgacaaattttgaattcacattcattgtttttaaataagttatattatttgttatttataaacaataactattgctattgctgtggtttggatgtgatttgcttccaaaaaaaatgatattaaaatttaatcccctatacatcagtgttgtgaggtggggcatagtggaagatttttggatccatgggggcagttttctcatgactaggtcaccctcctgtgggggtgtgtggattctgttttgcaggaatggattagttcccataacagtaggtcattataaagaatatgacttcttctttcattatgtgaactctttgtgtatgtcagctcctcttctgctttccaccatgagtggaagcagcacaaggccctcaccagacacagctgcccagtcttgaactttgcagccaccagactccatgagccaaataaacttttccctcataaattactcagcctcaggtattctgttattgcagcactaaacaaactaagacgagtactaaaaataaaatattcataggtgaatattgtaaaaattataaaagaaaaaattaaatattctgtgtatacagaaatctgagtttaatcaaagcaagaattttttttccttcagaatgtaataataatcatttaatgggcttatttccaagttttacttctctaaaatcaaacagtaggtccaatgaatgtaatgtgcttggcatatcctcaaaataaatttgcccatttgagaacatcatagagataatccagtaaattggccaaagaggtcatagtaagtgaaaaggcctaaatttgaactgagtcagcttagcttggaagctcttgctgtctctctcagataaaagctcctgcactgcagtaagcagctgcatctacataagtgccggacttttcatgtccagctaatctaccacattcactctgtcaccaatggcattggacacattctgattccaccctttctgtttcgctttggctaatagatccttttctagcctgcatttacataagagataaagatactatccagtagtaactttaacctgaaggtacagaaaacaattctgtgtgtccattatgtttgaatatcatgtataccctgtcaaagggcagcttcccttactcctaagtttaagggaatctgctcactggtcccctcacatgcaacaaggttgttctcttaatgtatgctagaaaggaaccatattttagcacaaatatgtgtcctttatgtaaaatgtcacacttttaaatcacaaaatacatacccccaagcaactccaatcataggaagctcttctatagatgattttctgtgctttttatttttatattctgtaggaatactctttaaccagataatctcattggttcagccagtacccaggcttctagatgctacatttgcacatactaagcaatttatcttggtcgtggacatgttcaactcatctcctcatagtatcttttgcacttggagaagtaggagctccttgtcaacctctagccattaaagagtcttctgaagtttatcttatatgtcctaaaaacacttatatgtcctaaaaacagtgacatattctgtcattgtaacaaataatggtaattattcattttctttcatatatttaaattgggataaagtttaaactaccatttcacactattttttcaacactctctccacattattgacagttcagctatgatacagtatacaatcactatctttttgactattgtctaaatactgcttgctctgtcagaaatgacctcctatctatctcctgaggttcagtttcaatgcctcacttcctatgaccttactctccccagctctcatcagctgccaccgctagatgctcctccctctaggattccataagaatttgttcatatttctattaacacatttattatactacttgagactagttatagacatgcctgcctcttccagcattgtgtgtttgtgtgtgtgtgtgtgtgtgtatatatatacatatatttatattataaatatagctctagtttctggggagaatatctgctccattgcagccatgtaaaaattgtatgtagacaagaacagaaaaccaaacactgcatgttctcactcataagtgagagtcgaacaatgagaacacatggacacagggaggagaacatcacataccggggcctgtcggtcggtggagggctgggggaggaatagcgttaggagaaatacctaatgtagatgatgggttgatggatgcagcaaaccaacatggcatgtgcatatctatgtaacaaacctgcatgttctacacatgtatcccagaaattaaagtataaaaaaaaaatttaaaaaataataaaaagggaaaaactgtatgtagagtgaataaatagattaaaaatggaattgtctgagaagttggttgaacttcttatgaacttttttcacaacttatttaggttgatacaacatggacttcaagagcctgaggttttagaatcagaaaatatctgatatgagctgagacttttattagcattgagaaattggctaagacttgttaggatgatcttgatcagtatcatctgatgattttttttttaatatacaactcctaccccaaacccaacaaggttctaatctaggctatcacacacacacatacacatacacacacacacacacacacacacacacacacaaatgctacaacacatctaaatataagaaaccatttattcatcttaaaagttgacttacattaatagtaatgcattaagtatatacattaagaactgtcttaatcagtttaggttgctatacattgccatagaccatgaggcttaaacatcaaacatttatttctcacagttgtggaggctataacttcaaaatcagagcaccagcatggtggagttcttgatgagggtactcttcccggtttacagatggccagcttctcactgtgttttcacatgactgagagagactggaagcttgctggcatctcttctactagggacactaaacctgccatgaaggctacactctcataacctaattatatcccaaaggtcccatctccaaatcccatcacatttgggatttcaacatatgaattcagttcatagcaggagcagaatgtaaataatgataatggaacatgcaatatttgctaacttataaggcttctaatgtatctaatttaaagacatatatttgagttttctttgatcaaagaaaaaatatgtctataaatgaatgtcagctataaaaacatttgcttatgatctgtcatttccacttaatgataataatgttacattgcatccatgctgctttttattttcaaggcaatttcacatacattatctgatttttcaactggtggccagtttaatgtcagaaatgtttccaagcttctatttatatttggttgtttaaagaagattctatacttatatgtggttacacatgaaacatacatttacttcagcacaccaaatcagtgaaacccgtagcaatttcagttgtgctcatccaaggacaaaattaggttttaggatttaacccaggtggcataataaaatttaaataacttgtttacctgagagcagcagcaacaaaaagagacaatcagaaatacaagccacaacagaacagtaatgaaatgtgatcctaaaaatattaataagtgttgaccctctgaaataaaataactaagaaaaggaaaaacaaaactaagggtgctcccaaagttgataaacaatgcatgaataaatgagcccctccactgtattccttcctttatatatataatacatatatgtaaaagtgatgtatatatcacttttttcacgggtcataaaatttgtatgttaataatttgcttgtttaccattctaatgtgttaaaaccttatacacctttgattttcccattgattactcttaagcagattaggcaatcaatacatgtttgttgaattgcactgaacttttaagcaagggtaaaatgatgccagctagaagcctatatattgtttcctgaatggtaagcagttcaaccaagaaaaaaaggtgaagcagatcgctttctttgctgctgttattcgtaacagtcgaatacaggttaccgtgtttttttcaatataaaatatggttgtcctagccataatcttggtctcgtgctaaatatattattcatgacatataatgagtagcttactttgtaaagaagatgtagtgatgttagcagtaagagtgaaattggccatttccccctcgtaaagctgtgtcttccccaagcaataaaatatggcttggttaagtggaacatgtggataaaaagatgaattgcccactatcttggagcctcattttaatatttaattttactttgggcacatcctgatacactagagaaagcctttatttacttttattttccagcattcattttgttgctctgaaatataccaagtactttactaagtgttaaattagttttaatattgtgaatataaagttttaattttatgaataagtttatagtactgaaatcactcagtgcggcaatgataatactgatcttggacctgattctcgattctcccttttttggcaaaatatggtgcatgggtgacatgacatttcattaatttccattcaccaggttaattctctattgcttatcttcatgtgagtgtgtgtctctgtgtcactaggaccacataaatgggggcatcaaaactacagaccacaatttcaaactgtccttctaaagtgaccagatttaaagatcaagaccagtcatttggagatgaaatgaagaatgctgataattatttattacctattacctgccaggcatcctatcaaacatatcacatgttctctcatttactcttcaaatcaacactggtgttcatattttgtagatgatttgctgaggctaagggaggttaagcgactctgaaaagataccatagctaaaaaatgtcagagatgagactgagtcccaagactttgtgattttaaagcccatgtcttttccactgactccaaagaatgagcagttgccagtagcgctgatttagaatcatcaagcagtcatgttgtctcaccattttctcccatcacccaaaattctacccacgcagctctgttattttagcaaaagactctaaatgctattaaaatgcagacaagatacagtgaatgataacatttaaagatatttagggtcagtccttttcttcttaggctgaccaaaagctaagaggataaattgaactggctgattaggcagaggtaacactaggaaaaaaaaatgtttagaaaactcgaaagacagattttaactgcttcataatttttctctgggctattgttattgctagtcttcagagaagcttgtgtggcacaaggaatactaagtgaactgaatgatctgaaaggtatatatcaaatgtgctgttaaagggtctttatacatagatggtaaaaccccatgataaaacttttgtagatacttcagcattatgcaaatgattgatcactttatgagacaattttgaataatatgtgtgaaattagttttctcctacttgtcttagttctttaaaggattaacagcatccattattctttgatgttattactgttaatatttttgaaaattagggactttttttaataaacgtacattaggatcaaaatatttcacatatcatctgattcttctgttgacctctaagtgatgatgatgtagttgacagatggtaaccctgcatatccaaatcaacatctctttgttttgtatgtgtcatgtagctttttattttgttactataattaaagtaacaaaattaaagatccaggttattatataaaattttcaggaaactatatgtctttttctagtttgacatgtttgtgtttttatccatttcttggtgtacacataaaatttaagtatgtgccatgggtttatgagccagtactcataatgcatcctgaaattttccagtggcagatataaatacagagctgtcatatttacgctgaattataaaacaactgaaaacaatgaaaactggtatattctgagtgggtggcatgttaaacccacacaattttgtcatgtttacttttatttgtactcgtttgacagcagggagaaagtactctgcttaaatctatttcgataagatagttttaaaactttataactttatgtaaaagcttacataaattccctttgctgttagttgattgaaaatggaattctttagtcacacataggtaattataaaatgaatgtccttccatcaacatatgcttccttgtttggatcaaatatatgtcttcgcatttgtagacattttcccttacttttttgttgaacttgtgaagtgaatgttaagtttatgtattcaattatgtggcgtgttacatacagaagttttctcccaactgcaagactttattttgctgggttaaaacacttggctaacatatggttgccaaagataaggtgcctatttaaaaactgatgttcaaaaaagctggtcagtgatagtttttttctgtttcattaaagacaatacatgctttctactgttttctttttttccttcagcagagttactatagaggaactatattcagattatttgtaatactttggaattacatttaaatttatcactgtatttccatgtttgaatgtcagtgagcatgtaggagcatcacatagttattttgtagcaaggaactagaatctaaccctcaaagagatggcaattttaagcatcctgtgtattcctatatgcttaagctcaagcttaattaattaataggccgcaaacagttaataggttaattttctacccattaattttacgaaatttgaaagaaatatttttgatagctgcaaaacgtattacatttctacaaaggaaaactaaatatgacattgtaaatagtgttccagacttatttttggctgtgtcccataatcgaagattttattttattttattttattttattttttttttttgagacagagtctcgctctgtcgtccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccataatcgaagattttaaagcattaaagtttattcatccctattgtcaatcctattctttctggctatattcatcagtcattgccttttcagtaaaacatattaaacatattaaagggatctgaaaacttacatgcaaatgagttgtgtgaatgtggtgaagagagagttgcaggatgttcagatacaattttttcatgttaattttatctcagaaacttcagggactaccacaatttacacagcaaattttaaaatttatagactgacattttgtttcttctttttatttatttatttaattttcaaccttcaaagagtggatctagactgacctttcaaactttgcgtagtctttttcaaatttatctttcaaactttattttccacttgctccactgctccattgctgtaccattgcttttatcacttttttctcaaacatgttactcttagtcctgtttttacttggttgtagtcactgttattctcctaaaaatcatgcattcattcattatcctattatgaacaaaaaatacacactagtcattgaggatataaaaatgaagaaaacatgaattcctacatggaggagcctattgtttagtggaagagatataattacagaggcaaggcactagggtaaaattatcttatctgttttcagattttgatgatcaacaaatcattggtccttccctataagaataaaggtagctattccacattaaaaaataaatatgagccatttgtggaagtcatcttcccttgatggtgagtgaatgaggagggtagttgtaggtcaatcttggtcagtggacttgtttgcaaccctaaaagagagcttgtgttaggacaaaacacactgaagataatgagtgaagagttgtgaagaatttgaattctatatgatgctgatgggcaccagagactaccttacctctgtatttcctcttatgtgaaaagattatatatatatatatatatgcatatatatatatatgcatatatatatatatatatgcatatatatatatatgcatatatatgtgtgtgtgtgtgtagcgtttattccaatttgtcaaagtattcttttgcttggatccaaaagtttcctaacttacctaagtaccattaaaataatcagatactaccagaagcaacctacagattcaatgcaatctctatcaaaataggaattacattcttcacagaaactgaaaaaaattctaaaatgtgtgtgggatcacaaaaatcccagagtagccaaagcaatcctgagcaaaaagaaaaatgccagaggctttgcgttacctgacctcaaaatataccacaaagctttagtaaccaaaccagcataatactggccttaaaacagatacatggactaataaaacagaatagaaaactcagaaattaatctacatgtctatacagccagctggtttatgacaaacatgccgagaacactcatggggaaagggtagtctcttcaataaatggtgttgggaaaactggatatccatatgcaaaagaatgaaactagacccccacctcacacataatcaactctaaatggatcaaaaacctaaatgtaagacctgaaataataaaactgctagaagaagacatagcggaaatgcttcaggatgtcaatctgggaaaagattttatgaataaggcctcaaacacacagataaataaggaaaatgagattatatcacagcacaaatcttctgcacaacaaaggacataatcaacagagtaaaagcctacagaatggaagaaatattttccatctactcattagaagattaatatccagaatatacaaggaactaaagcatctcaacaacaaaaatatattttaaaatgggcaaatgatctgaatagacatttctcaaaagaagacatacaaatagcaaaaaaaaaaatgaaaaaaaattctcaacattactaattatcaggcaaatacaaatcaaaaatcacaataagttatcgcaccgtcagtaggaggctattatcaaaaagatgaaaaataacaaatgctcacaagtatgaagagaaaagggaactcttatatgctattggtaggaatgtaagctagtacagccactccagaaaaaagtatggaggtcctcaaaaaactacaaatagcactaccatatgatccagcaatcctactaatgggcgtttatccaaaggaaaagaaatcattatagcaaagagatatctacacccccatgtttattgcagcactattcacagtaaccaagacatggaatcaacccaggtatccaacaacagatgaatgagctaaaaaatgcggtatatatacacaatggaatactattcacctattaaaaagaatgaaatcctatcatttgtggcaagatgtatggaactggaagacactgtgtaagtgtcaggaatagaaagttcaccaccacatgttctcactcataagtgcaagcttaaaaatgttgatctcatagaagtgaaaagtaaagcacaggatactagaggctgaaagagtaaaggcaagggaagatagagaaaaatttgctaaaggatacaaaactatagctaggtaggacgagtaaattctggtgttgtataccactgtaggataacaatatttaacaataatacatagtttcaaatagctaaaaagaggatattcaacatttcgacattctcaacacaaaagatgagtttgagaggatgaatacgctaattatcctaatctgaccgttatacattatatgtattgaaacatcactgtgcatttcatgaataggtacacttatttgtcaattaaaagtaaaattttaaaaaaatcagaaatattaaaacaaaagatactattagcagcttaaatatgaagggacctgaattctcaaaaagcaaaagtagataaaactgtgagaatttcaactctaaaaatatacttttcataagttaaacaatatttttccttgtgaatttttaagttcaaataatagtgacataggtgcctgctattttgtagggtgaatttcattaattttatgacacttggattccataataacctgtcaagatagatagaaaaaaatatataacattccaaattaaatgagaaaattgataatcctagaaatgtatgttatttgtaaaaatcaacattatagtgcagatatcccgcatttgattataagaactcttctcatttgtctatctgccatacttcttattggaactcagagctgatataataattctgatggttttaaaactatctgtgaacatatgtactaccctaccatttggtgagtttaaagtttggaaatcattaataaatgatattcccattaacaaaataaacatcactgaagatatatgttgagagatgggaaggagttggtgggtcaagagagacactcttttgtcctttgtccctgtctacaacaccattttgtggtctggctattatttcatagttaccactaccatctggaaagaaagattatcccacatgcctgggctcttaaattattgcaatattttttgcatgaataatgaacaaatttataaattataacatcattcctgttatgtttctaatatgaatgatattcacttgcaagtgtagggcctttgccctgattatagatgttagaaaagaatatgtgagaggtgttatagaaataactgaagtaagaatttacacgtttgttatttagtaaaagtcaatatatttctaaagacttgaataaaacaaatgcaattttgtacagaattcttcagtgcattttctaatttctcctctctgatgtgaaaataacacaagatttagaaatcacctgcaataaaacatgtttatttacaaagtgaaatagtttatgttgtattaacttaaattttcctatttccgatgcccaagtaatacccctctaagcgaatcatgattattgacaagtttacttttatacactttatagtactcatttcccataaataatgtatgattctttaataaaattgataaatattcaactctcaataaggcaaaatcctatgtattcaaaataaaatttaattgaacattaaaattcttgtctagttcccattttgtgtgtgtgtgcacgtgtgacttaggctgtttttcctgacatttgtgaagtcaatgagtttttctgctgtacattagtttctccccttcagtgctgccttacagtaccctattgtataaaatatgcattcagtagagaaaacaatatactgcagacatcagacttaaacaaaacactttttattgttgctttaaaaaccagactttacacccctgcactgaaaataggaactatttgttcctagtccatgtgcctggaccaaagcattttaaagtacctaaaaaaatttaaatttataaattcaggtttataaattgaccttattgaccaatacctataagtccttttaactttagaaaaccctccacaaataacaaatatgatcattttcatttggctatttttaatataaattaattttttcttacagaaaggaatgaaaagttttattaattagagcacttacttaaaccaatgctttcaagcaatctttctttggagtcagtgattatctttggctctataccaaaaacttcaggtattttttcttctttgcagtgttttaaaatgtatttggttgggtaaaagtcactgtttttaggtttcaaaatgtttctacaatatattaagccctgatatatactaatttacctctttatgatttgagtgctagattagttttacacctaataatgtagaaaaaaaatttaagcttataaatttgtatatattatactaatttctgaatataagcacaggtgatagcttattatatttgttcatatgcagctcctggaataatcctagaacaacgcatagtttataaaaaaaatagaaggggagtaggaaggaatgaaaggagagaaaaatagcatctgagcagtctgagaatttcacaataatagctgttctaaagtttagatgactataaattattcttaaacagttatgttttgcctatgtttaatatatataaaacagtagtatttgtatttctgtaattaacatttctctagaaaacagtgttaaatatatatttgttatagtctaaatttgtgttcataacatgtaaattgcaagcatgagtttagaaactcatgattttgccccctcctttaaaaatcagttaatcaataatttgtattgatgcactagaactccaagcaagcgtctcagagtgttctatcacaaagaattattaaaaggaaagcttcaaagctaaatcttcaatggtagctaaagagcagataaagactatatgaatctgattccccaagacaagaagttcttataaattaaaggcaaataggcaagtgattaggtaatatgaacatgtgatttaaggtgaaaatcttctttcaatggccgtgaataaatctcctttaaagacattatattgtgttcactaaattaaaatgtgccaattcttcaatgatcaatggcaatttgttttgctttaattagctgataaaacaaatgaataaatagcatcagctaaggtcatctgttctacctgttgctttaggttaatgtgtatttcatcctcagattccttagctctcagaaatttgactgacatgactcaaggaaataaaaatatttgaaatatgtatataatttataacataatgttagttttatgtaaaagcaattcagcaagtctgaaattacttttctgcaatgactataatgtaacaaatagaaataatttgtaacactgtgttctatgtcaattgtacttaaacacttttgagatatggcagaggatcttgcttccctcaggactaataatgtacacttcatctaagtccaaattttaattaacagttcttgttaagatagttttttctacctctaaacctaatcatacttggtatttaaatggcatattcaataaaagttgtcccatttcacctgttttgaagtcaaaggtttttgctttaaaacatttttgaactagctctacagtttttagaagctgtttagggacttcacatactatatgcaggagtaagtaactaattggtgctatactttatggtattgacacattcaaagaacttcattgattcagtacactttctctttcttaaaaacatgagacccttaaccatggtagaattctcattgttaatttattttggctgctctattgcctgttactaagttattctgtttcaagggcaaaagtatattttttccacatggaaaaaaattcaaaaccaggcagtagatagataaaattattctttgccattagcatgctaaataatagtattgcaaacagcagttcactatgcacagcttgatacgatagatgaaaatattagtttatgaatctgatacttaaactttactaagtaaagttagtaaagtaaacagtctttactaagtaaagactgggttctttaaagcccaacctttggtcttttgaatcgttctctatagcaattagtcactcatataaagtgagatattataaaccgcaactctgtttcagcatgtagaattctttatatatatatatagacacacacacacatgtatatgtatatatacatacatatacgtatatgtacatatatatatgtatatgtatactttaagttctgggatacatgttcagaacgtgcagttttgttacataggtatacacgtgccatggtcgtttgctgcaccaatcaacctgtcacctacattaggtatttctcccaatgttatccctcccctttcccctactccccgacaggccccagtatgtgatgttcccctccctgtgtccatgtgttctcattgttcaactctcacttatgagtgagaacatgtggtgttggttttctgttcctgtgttagtttgctgagaatgatggtttccagcttcatccatgtccctgcaaaggacatgaacccatccttttctatggctgcatagtattccgtggtgtatatgtgccacattttctttatccagtctatcattgatgggcatttgggttggttccaagtctttgctattatgaacagtgctgcagtaaacatatgtgtgtatgcgtctttagagtagaacgatttataatcctttgggtatatacccagtcatgggattgctgggtcaaatggtatttctgggtctagatccttgaggaatggccacaccgtcttccacaatggttgaactaatttacactcccaccaacactgtaaaagcgtttatatttctccacatcttctccagcatctgttgtttcctgacttaatgatcgccattctaactggtgtgagatggtatcttattgtggtttttatttgcatttctctgatgaccagtgatgatgagcttttttcatgtttgttggtcgcaaaaatgtcttcctttgaaaagtgtctgttcatatccttcgcccactttttgatgtttttttttttcttgtaaatttgtttaagttccttgtagattctggatattagctctttatcatatggatagattgcaaaaattttctcccattctgtaggttgcctagtcactctgatgatagtttcttttgctgtgcagaagctttttagtttaattagatcccatttgtcaatgttggcttttgttgccattgctgttggtgttttggtcatgaagtccttgcccatgcctatgtactaaatggtatttcctaggttttcgtctagggtttttatggttttaggtcttatgtttaagtctttaatccatcttgagttaatttttgtataaggtgtaaggaagaggtccagtttcagttttccgcatatggctagccagttttcccaacactatttattaaatagggaatcctttccccattgcttgtttttgtcaggtttgtcaaagatcagattgttctagatgtgtggtgtcatttctgaggcctctgttctgttctattggtctatatctctgttttggtaccagtaccatgctgttttgattactgtagccttgtagtgtagtttgaagccaggtagtgtgatggttacggctttgctctttttgcttagaattgtcttggctacatgggctcttttttggttccatatgaaatttaaagtagttttttctaattctgtgaagaaaatcaatggtagcttgatggggatagcattgaatctgtaaattactttgggcagtatggccatttccacaatattgattcttcctgtgcatgagcatggactgtttttccatttgtttgtttcctctcttatttccttgagcagtggtttgtagctctccttgaagaggtccttcacatcccatgtaagttgtattcctaagtattttattctctttgtagcaattgtgaatgggagtttgctcatgatttggctctctgattgtctattattggtatatagaaatgcttgtgattttgcacactgattttgtaccctgacacttttctgaagttgcttatcatttcaagaagtttttgggctgagacgatggggttttctaatataaaatcatgtcttctgcaaacagagacaacttgacatctggcttgaggagctttaagtgaccagatcatggccattgtttcgagtaaagtggaacccgtatacttgagggacgtggtaagaccaatgactactgggtaaataatgaaactaaggcagaaataaataagttatttgaaaccaatgggaacaaaaacacaatgtaccagaatctctgggacacagctaaagcactgttgagagggaaatttatagcactaagtgcccacaggagaaagcaggaaacatctagaatcggtatcctaacgttacaatttaaggaactagagaagcaagagtaaacaaattcaaaagccagcagaagacaagaaataactaagatcatagcagaactgaaggagatacagatacaaaaaacctttcaaaaaagcacggaatctaggagctgtatttttgaaaagattaacaaaatagatagactgctagtcagattaataaagaagaaaagagagaatcatatagacacaataaaaatgataaaggggatctcaccactgatcccacagaaatacaaactaccatcagagaatactgtaaacacctctatgcaaataaactagaaaatctagaagaaatggataaattcctggacacatacacccacccaagactaaaccaggaagaagtcaaatccctgaatagaccaataacaagttctgaaattgaggcagtaattaatctaccaaccaagaaaagccaaggaccacacgaattcacaaccgaattctaccagaggtacaaagaggagctggtaccattccttctgaaactatcctgaacaatggaaaaagagagactcctccctaactcattttatgaggccagcatcatcctgataccaaaacctggcagagacacaataagaaaagaaaatttcagggcaataaccctgaggaacattgatgcaaaaatcctcaataaaatactagcaaactgaatccagcagcacatcaaaaagcttatccaccatgatcaagtcagcttcatccctgggatgcaaggttggttcaacatatgcaaatcaataaatgtaatccatcacataaacagaaccaaagacaaaaactacatgattatcttaatagatgcagaaaaggcctttgataaaattcaacaccccttcatgctgaaaactctcaataaagtaggtattgatggaaggtatctcaaaataatacctatttatgacaaacccacagccaatatcatattgaatgggcaaaaactggaagcatcccctttgaaaactggcacaagacagggatggcctctctcaccactcctattcaacatagtgttggaagttctggccagggcaatcaggcaagagaaagaaatagcaggtgttccagtaagggaggaagtcagattgtctgtgtttgcagatgacatgattatacatttagaaaaccccattgtcttagcccaaaatctcttaagctggtaagaattctttatttagtatttagtctagttttaagaaagtcttctctcacctaccactattgaagttttatgggaacacaaatgatattatagtctaagtgaaagacatgttcatagtaggcttacaagaaatatttcatgaaaaaacactttgtactgtaaaatttgtacataagccattgaccattttttcatgagggaaaatataatgtcataattcggattggtattttagtgaaatggaaggtcgctgtatggcctcttcctcattcaaagtttgtgaaactctcttctcttttctttgaggctgtgtcttgagcaaagttttactgcaagttggaaccaaactgagatcaaatggccaccagttagtagtgacatctggaaagtcatcttctgtattgggaactcacctaataccacttgaaattatatccttgtctttcattcaaactctgacctccatctttctgattgtaacatagtcatcaaaacctgctaattgctcatcttcttgtaagttatttatgtggatgacctcagcgaatcttctcaaacattctatgaggcaggtactattattattctttctgggtctacccctttgtcctctagctattttttggagagctgataagtgaacttgaaatctgactacagggacttttctaataaccagataactttatttctctcttcttgatatatttgttttctgtgctcctgcatctagactgggtcgtgataaagctgagtccagctgtagggccagacagagccttcctctccacacagcattcttagcattgtggagctcggcttcaggaagcattttccttacttaatagaagctgttgctcctcttcatgggaagtcttggcaatgccagtgatctaaggtgatggaatctgttgatcctacatgcagcagcagtcggtactgaaatgagtaatattttaataatttttttttgccctttcttcttccagttttgctattcaaggtgatgtttcttagtcttctgctccttaattagcacctgttgactaaatggatcaacaaacctatcccacgtgtgacttactctcctggacacgagtcttgttttatagtctagcttagcagacttcccactggtttctgtcatgatactgtccatctagtgaacactttttttgttataatttcctccctctaaacttcatactgttaagtagtttctggagtgcaggatttttttctaaagtcagaacagtgggaaatgagttaataaagcttctacgttccttggaaagacccctgagagatacttaaccagttgcctgctgtgtaaatgttattgagaatgaaaaacaaaaagtaaatttacagcttctgttgtgtccacatccattccaaactagatgcaccataacaaaaataacacttagaactttaattgtagtatctgtgaaaaggcaccagtgtgatttatgtaataaattggatactaaaaactttcttatgatatcatgcatttaaaaattaggaaatgacagccctgaaggtaaatgtaacttgaatgatagcattttcccaaaagaaagcattagttttcaaataagtgtacttttaccaatttaccagtaaacagatcttgtcacagaaatacatacttataaaaactttggacatatttgaaaaataagcagattttcttaaacctcagtttttgggtggtcttattttcctcttctctataagcaaacctttgcccatcaaatagatatgtactttttaatgaaaatatcatatggtaattatattacccataaatttctcctatggaattttctagtaagtaggtgttattgtcacagaaatacttatttgtaaaaacataaagtaaattaatcattatatgctcattgagtaaacatagctgagtaataggttgcagtcatttttaacacaatttaacaaatgtttgaacgatctataatttttattcatgtgtgatttatggcatccattttaactaatgtaaagggtagatgatgaatattagtatcagtcaattccagacttcaaccttaatacacataaaagtgactaccaagcattttctcctaattaaaaaaaaagcaaattttatttattttcaatgaaattttagcttctaatagtcttcaaaagctatgtagttattataataatgttgccattcctcaaaaacattctcaggctgctttggaatcaccttaagcatttatttctgaaaacctattcatgtactccctaagcatagatgaacacaatggcctcatttgttaaagctgtttactccttgtttggtaaagctgagctcacaagtcaaaaccggcctgcagacatacggttttgggcaccatagtgttttctaaagggattttaagaccattaggcacatctagctcaaaggtaattgtcttatacctggcacacttcattttaaacttgcttaatctctagaaacctatgctttagttatccctaaacaagctgaatatttagtttacttttctgcatctcatagtgatgtctaataggcatcaaaatcactcaaaactgtgctcttaatctttgttcataaacctgttctgtttcagttttctccacctctgtaaatggccgctctattccaattactcatactgtaaaacttggagttctctttgactcaatcatcagcaaatcctgttgcctttatcttaaaagtatgagcaaaatctgctacctgctgtcccgagcccctatagctgtcacctcgctttactggcttatcacagtgatctttgaattcatctcccttttccacccttctttgcctatagcctgctctcagcacaatgggcagaatcatccttttttaaaacacaggccagatcattttaccctctccttatgacctttcaatgctccccattttactactaaagaagtcacatccttgaatcagcctttaaagtcctatacaacaggtccttggaatgtttctgacccaccccatgctatttctccttcattgcctctgctttaactgtgctctttgtttagcacactgggaacagtgctgccccaggatctttgcacttcctgttccttctgcctggaatggtcttctcttacttgctcacatggccacttgtctcctcttcttcaaaatattgcccaaatgtcaccttcttgatgaagccttccctgaccgccctaaagtagaaacagcctgccacccacctctctactccctaaccctcttttctactaatttaattattttttcatccaaaactcttacctctcctaatatgatatgttctttattcatttgcttattgttttttataaacaacataaacttgaatataaacttgattataaacgtgaaagttcaaagaattttgtctgtttttttaactgccacatctttggacactgaatgagtacctggcatgcagacacaatcgtatattaaagataggtgtttctttccaaaactcctaacaatcctagaaaactaaaatatacaccactactagtattcaaaacatcttgtttatgcatggcttcaagctttgacctaatttgtttatatatgtccctatattcagttactgttttcataaactttatttataaccccttagctttcatcctgtgtcttcatccttgtggttcagcaatgatatctagtctatatcttggtatataaataatcattgaatttttatgatatttcagtatgttaaggtctcctaaagttgaatattgtaatcttaatcttttatttatcccgtgtctcctgtgattcatatatttgaaagtaaattttaattctttctccaaaagtgtgttgaccataccagtccctatctttaaagacatgagataatttttcaatatttattgtgcatctgtaattgataccattggcttattttcttgattaactcttactactttagatttctctatctaaggcattcatggtgcttttttcactctttatatatcctcagtgtaccacattcctttctaccataaatatttcttttgaaaaaaaaactctctgtaccctctgtagatgtcacactgtgttctttctgatgtctccatgacccctatgtgttcatggatatttattaattttatatagtgactggacactccagtgaattctcaccagccatttcgaccccccacctgccattccaactccccatccctaaatgaaatcagcagagagaagattaaggccaaggcaacaaaattatatgaaaaggtatgtaggtggtcgcagaaggggtcagagaaggtaagtggtttccttgaacattaccaatgggttggattcatccattagaaggattttcaactgaaggtcatgaagcccaaaacaacaaccaaaggttatattataccaatgaagggtgtaagagttcacagacataaaggctggagattgtagaaagccaagaaaagtcaaagtgctggaacttatcatttaaagaaaaaaacctaaaatatagaaaaccaaaaaagattaactaaataatctggaagtccaaggacaagagctacacagtgcaaatgaatttggaaagcaattatgaaaaactttcctttaggatgtatgatcttcttgagagctgtatactcttttacctattctgaaaagtaccttaagctagcagagtccatgattttctgacaacaatgaattttatacattcttgctatatgaacactaataatataatgttaggttattcagttttgtgtgcatgctttgcaattttcaacaagatgttccattattcgatctgtctatcttgttcttgcttactcagagatttctaggaatgcaatctataccctgtataatttaacttttaagtcacgttgtgttagacaagagttatgccttatcttctcactaataataaagtgtcctaggattaattttattatttagtgcatagttccctagttgtatatattacttcacaaaaaacaacctcaaacttattgagtaagatagtcttattgagtaagataaacttacttattgagtaagataaacttgaatataaacttgattataaatttgaaagttcaaagaattttgtctgttttttttaactgccacatcttgagtaagataaacttactcaataagataagatagtcttattgagtaagataaacttattgagtaagatagtcaccttttttatttttaacaatgacatattgatgagtcaggaatttagacccagaatattgaggatggctcttctctactgcatgatatcagatggctaagggggtaactcaaaattctcaagagctggagctggaatcacctgacagcttcttcacttctgtgtttgacactgagactgggaaaggtgaaggatgcattcggctggaacagtgggcctgagccctcacctgtggcccttccaactagagagtctcaggctggttaagtattttatataacagtgcagggctccaagattgagtgttttcagtaaaggagtaagctttgttatggtttgttttgagactaggtctcgctctgtcacccaggctggagtgcagtggtgcgatcacagctcactacagcctcaaattcctgaactcaaacaatctttccacctcagcctttcaagtagcggggattacagttgcatgccaccacaccagctaatttttctcttactcttagtagagacaagatctcactctgttgcccaggctggtctcagactcctgagcccaagagatcctcctgcctcggccacacaaagtgctcggattacaggcatgagccaccacttctggcctaagctgtattatcttttatgtcctagccttagacatcacataatgtcacttccaccatgatctgtcagtcacagtaatcataaacattctcagattccaggggaagagttgtagactgggatggatattgaggcatttgtagctataatttagaactgccacctcacctacaggcatactgactgaatgttctttactcctattccttatgttatctttaactattacagtagttgctgagtgttatggagtgcatatctgtgtcccttcaaaaacgtcataaaacgcatacccaaggtgaagccaactctaaaactgcctgtcctagatacagtttttggaaacatggcattggagaattgagcctaaatggataaagaattactggcataatttttgtatatttccctaaggccctataaatactataaaatgaaatacagaagttaataaaaaaaattaaaaaaatcaagagtcaattgagttggaaatgacttcaagacagagttgataacaatatatgctttatcaaagagtctattcagtgatgactgaatcagatttatactgatccatgaatttgaggtacaatcaagatgaaaccctcacctccaatgggtcagtgggtctgaaccttcacctgtggctcaggtgatagcatccaacgggatgctaatacgtggtgggacctttggaaggaaattagattcagatgatatcatgagagtgtggtcctcatgatgggattagcactcctataaaaagagaaggagactagagcttactctctgctgtgtgaggatatggtgagaagatactgtcaacaagccggaatgcaggccctctcctgacactggatctgccactgccttgatcttggattccccaactctgaactgtgaaaaaggaatgttattgtttaattcattaactctatggtatttcttcatagcagctcaaactaagacacctatttgtaaagagaatgtgactgttatttgtcaccccgtataaagacagttacacagtttaatgattatttccatatttttctaactgcacattagctgaggcataatttttcttgtacacattcttttttaaaaatgttctctttattctgatcatacctcaaattcatggatctgtataaatctgtatgattcagtcatcaccaaatagactctttgataaagcatatattgctatcaactcagtcttggagtcatttccaattcaattgcctcttgattttttgtatgttttctattaacttctcattttattgtatggcatttatagggccttagggaaatatacaaaaaaagtaattatgccagtaattctttatctatttaggctcaattctccaatgccatgttttcaaaaactacatctagcacatgcagttttagagttggtttcaccttggatatacctttcatgacattgaaattatataaatctttaaataagctttttgtgttatatagacctcgcttgtttctgtcaacagttggcgtatgctagtttgacccctacattgtccaagttattaaataacttgtagaagatcactgaatagaatacatgcttgtagaaaagaaatgcacatcaagtaagattctagtagtttttctttcccttatggttaacagattttaagatattatctctcatcaaataatcatgttgagagcttacattatctttttatattatctctttctatttgcttacataagctagtctacatgctgctaagaagaatgtggataaaagatccaaaatacttggtaataagtattcattggaaatgagtgtcactgtgtaatattgccaactttttctagttttgttatttccatgtacacactgaacacttagaaaattatatgtgtaactttaagtatttgttcacatatcattacatacatatacaattgtatatcagctgtcaacctgctatgatgttttctggtgttaaaagggactcagtttcttctatgtcatgtgaagaaacatgctgtcatccatcagactgttttacatttacataataaatcatgaaattccagacagtgttcactcatttatggttggtcattccttgatgttaatggaagacaaggcttatgagaatatttcacttctttaagttctgttggttaaaaatattcctaaccagcggatcacaaggtcaggagattgagaccatcctggctaacacggtgaaaccccgtctctgctaaaaatacaaaaaattagccgggaatggtggcgggcacctgtagtcccagctactcgggaggctgaggcaggagaatggcgtgaactcgggaggcggagcttgcggtgagccgagatcgcgccactgcactccagcctgggcgacggagtgagactcagtctcgggaaaaaaaaaaaaaattcctagccatgttaaaaattactttggcgttttaaaaatgtttaattttgatatactatgtcacaggaacaaagagtttataaaagaatttgtatttttttaagtaaaagaacccttataaccaagagccaattagagatgttcttctagcagcatatagactatgtaagctagtgtgaatttgggatattttttgtcattctttaatttctattctttacttagtttttcctgtttttaaaacttatatgaataggccgagtgcagtggctcatgcctgtaatcccagcacttgaggaggcagaggcaggcgaatcacctgaggtcaggagtttgagacaagcctggccaacatggtgaaaccccgtctctactacaaatacagaaattagccaggtgtggtggcgggtacctgtaatcccagctcgaacccaggaggcggaggttgcagtgagacgagaccaggccattgcactccagcctgggcagcagaggagagacactctatctcaaaaagaaaaaaaaaaaaaaaaaaaaaaaaacaaagaaacttatatgaatagaaatataaagtcgttcctattgtttctggctattgtcacacattatctttgtcagatgaatgtttgaattaattaataaatattttctactattctatttcccccatctttttgaatgttataacttcactttctattattttagtggttaccctaaaaattaaaacatggatatttaatatgtcaaaacattatcagtctctttactcacctcttagatatttcaagaactttaaaacactttctagatttacattatagtgtaaaatatatattctagatttttagtcttacaaagttatatttcctattttataattatttgttcatttctatcaacatagtcacccactgtttcccattgcttctagaatctcagaaggaaacaaaatcctttagaatttcctctacttaatgtttcttgatttttgtttgtctggaaatacattataatctgttgctgattttcctagttcttgaattatttgccagtctgttctgctggctttcattctctttccttaaatagttggccgttttttattcggcactgattatgatgctgaaataattatttgtgtgaattctttgaagtctatggtgaaggtcctttccttcatcaagaattttcattagattctcctgggtacctggactcacagtcattattttagatgcaaatagcataatagtcttaaggctattcaggcgtgctgttctttgtagatattatatcacaatctgtacttttatcccattcattagatttccaaaattttacataaagttcataggattctcattagctttttaatctggaatgaatctaaagttttgcctccacttgagccttctccatttttttctttatctgtctcaatggagatttgtcttatctttccagagaatatgttcttagactcactcattcctctcatcagttttctattttagtagactgtaatttttttcataattttcataaaatctaattttctcataatttccttttctctgccttctttgtattacctttcctttatttcagtagagtataaattttttcataaaatctaattctttcatagtttccttctctctgccttctttgtattgacttttcatttttgttacttcttaagatgaattctcaactgatactatattctttatttttagtataagtaaaacaataaatttcacttaaatcttctcttccgttgcatctcacaagttttgttatgcagtactttcattattgtttagttatgttcagtatcttttgatatccacaatcaagttttattagtccaggtatgtttttaagtgattttttacgaatttgttgcacgcacacacacacacacacacacacacacacaccccaatgtttattagtgatttctaatataattgcattataatcagagatattcttagacattttagagactcgcaatataatttattatatatccactttcgtaaaagttccatattttctggagcggactgtatatttcctaattgtcggccaaagaattatttatatatctttagatctcaaaagtttaggtgtgaagtttattttttattgtaggatcaaacaagttaatttagttcacaaccagcctggatgacatagtgagacccggtgtatacaaaaagcaccaaaacaaacacacaaaagataatttaacatggtgaccactctccaatgcattgttttaattagtttttcttaaaaaccaactttctcctgttgctttatttttgtaaatgtctttattgaagagaggcacatcagcaaggaaatagggccacatcctattggagggaattccgagttctaaaatgcacctctacattggcagagaaatgacaaccagttaatgaaaacgagtgtttggcagctgttgtctcctttgcctgaggccgttctctagtgtcacagcagggtaaagatgtgtgaaaagttgtatgaccagatggccatgagatccagaatgcctagaaataaaagttctaattgattctgcaaaagagaacttttaaaattgctataaggctagtcccagcatgatccagtacatgattaaagaacataataatattaaataacagcaaaactcaaagcaggaagaaagattgtcccatgctatcatgtgactcatccacacaacagaaaaggcaaaacacactcagcaaatggaagaatttaccacccttattctggccactcatcacctaaatgaacctaagccattccatctcaggactgtgccagttatcacacttccggctccagttaagagaatggtgggcaaacactggttaaacaatagagggtttttgtaaattatcatttttaaaaaattttatgagaagcctgaaaagtgggaatcctagatttggttaatgccatggaccattggtgttagacactttacttttcactctaccatctgtaatgggctaacctttgcggtcaggtccttccaggcatggttgatctcacatagccacatacaaggatgaggaaaagcctttctttctttctctctctctctctgtctctctctctcccccccctccccctcctcctctgtccccctccctccctcccttcctctctctttctctccctcctttcctctctctctctgtcacacacacacacacacacacacacacacacacacaaatatacaccatcagtgagaagtatcatgccagaatccctaacagattttattttggatcttattagtcaggattagtcaccatgtgctagctacatagaagcctgggcagggaagtctgtgacaggttcagggtcattctggacagctggtcaactctctaagcacagaaggaggtagaggacaattgagtagggcatccctgaggatattctgaagaatgtcagttgagttgtgttgggtttggttttctgtctccctgcaaacagtggcaagcctggaaacttgctttagctcttaaatagtacttttgtacttacttgaaatatagagtgtctaatattttgaggcatttcaatgatggcagccttgttctgtagatgttacagagagataatgaaacactcccactgcttggttcctgtccttttcctctgcccacggcccggtcagagctggaagggtcagtctgagagcaggagcagctctggctactgcaacctttgggcaaatcacttaacctttttaacatggaagtcttcattaaaataagggcatgcatgtatcaagggcattgtttgacttatgtgattatctcgcagttgcttttgccaatcacatctttctaaatacaaaagagttcctcttattgctgaagcacccagctaaaacagagttggtatttctcacaactcattcagtgtaattaaaaacaattaatagatacctactatgtataagatgccaacatgaatagatcatagttcctttccttggggacccacagtagagatacagttattgaaatgtaaatcaatacattaaaatgcaaaacttgtggaaggcagagaagtagcagaaaggagggatgctttgctgaaattaggtcacaagtagtaacttgctgagtttaaggacttttggactatggtctatacaacggaaaaaagtatgggagactttgaatactttctaaccacgttaaatactttataaccaggttattttatagacacaaagtaaaggatattttataaccatgttagaacttgaaaaagcacttgctattttggatttagtttattccttcttcttttgtgactctttatttccagcatcgtattggatatcttctcatgaagatggcataggcctttcaaactgaccatgtccagaaccaaactcattctctgtctcccccaagctaaacgtgtctcatttgtttttggtgcaagttactgacatgaccatgaacacagtcaccaaatagaaactaaggtttgttcatgagacttccctcttcctctcctactacacacatccaccagcatgtacgatgaattctatagtaaatcatttctcaaaatcgtttctgacttttctttctcgctcccttactctaagtcaagaatcagcagtctgtttttccataaagggcctaataaatattctcagttttggaggccatatggtctctgtcaaaattactcacctctgccattgtagcacagaagcagtcgtagacaatatgtaaatgagggaacatactcctgttcctcaaagttattatttctaacaacagattgcacttggcttaagggtcatagtttgcccatgcctgattgaggccctcctcaactttcacctggattaatattgcagcatatctctaattggtcttccaggctttaattctgctctacaatctcgcctttgtatttacctgcataaataacaaatcgaattcatactgtctgtatgaaaagaaatcattgcccataagaaagtgatatttcctagcttgtcacacgtggtcggtccttgcggacttagattcgtgtggctctttgtggcttcctgttccagcccttgttgcttcctgtagtcctcagaaattctgtcccttgcctctccccaaacacagtaacatcttccgtatttcctacatggttgcagttgtcacctcagtgtatgggtcactcacttatatgtgcatactctgtgtgcatgagagtgtgtgcgatttgctacagattttaattaaaaatattatagtcatatgcatgattatatttgtgtgtacttaaatatatatggaagaaatggacaatgacgtgtccatgacaacagagatactgtttccgtgcatctgtatttgataaattcttagtcatcttttaagacagagctattttgtgaagccacaccacacgtccttggggcagtcattgtctctctgagcaccctttgcacatcagtcgtttcttgtctatcacttgcagtggtgtgctggagcttgcttagactggctcaagaaaactgatggttaaattttcaggaattccgtgagtcgcttgttaaattgttgtaacttgaaattaaccatgatgggagtatctacaatagcagatgctacaaaccaggatgtgtttttagggtttattttgttggagaactggttgaccagcacaccactgaatctttccttttctgatcgacaactatgtaagacaatatgcctaatagatacccaatatatagatacataataacccttaatccttagtatgttttagatgactcagtagacttcctgactactgtctttaccaatgttctattagatgagatcaaaagatgcatctttacattgaatttgattttagtagagagaatcacttatttttttaattagaaattaagctgcatttagaaagttaaaaaataatgattactgattttacatttaagtcaactttcaatatgcttagtattaccaattgttactttaataaggtgtttttctgggaacattgcttataaaatactatttatatgtttttgtttgtttagctccaatatcaaagagaaatagctatattgcatgtgctataactgactgtcaatgaatgggtaatttaaaatagcctcagatgcctcaaaccttaacgctaaattcacctcacaaagggaatttattcaatccaaacgccctcctattgcttaaatgaagacattgatatgaagattcatatctgaagttaagatattagtaaatcaaacaatgtaaaattcacgaccatatatatcatacggatttggaattagctgagtgatctacttttgtatatttttgtggttaaatttaagcactatacatttatgagaatgattttctaagaagaaaccccatttattttctaagaaattgcagcctacctttctatgctggtttgttttatgtactactattgacttttcttcagttttatataagatacacagcctagtgaataataaaaaagtattattacatttactttaactcttagcctttgctttgactgcacagaaggagacctttaatttttatatgctttgaaattcatgaaaattgacatttttgcctgacaacttatttctccactttcatatgcctttcctcttgactgaatttagtcttttgtagtgttgcagaggctgtagattaccaagttctcctagattcacagggcagtaactataggcttgaagaacattcaccactaaacctgagtgaggctcattcgatgttgtaagaaatagagggctcatttgttccctctgacagcctctccaggggtgctcacttatgtgtacatgcactatgtatacatgtcctatgtgtatgtatgagagtgtgtgcattttgttatgcattttaataaaatatagtcatatatattattatagatgtgtatatacataaatacatatggaggaaatggacaatggtatgttgtaatgttcagaaatgaacaaggtgatgtaaacactgtccctaaatcttgtttcacagtagagtttccagtagatgacaagtacggtagccaccacaaagggctgtgagagagagggtgcatctctccaaaacaagtattccccacaacacagtgacagtaggctaaaacatttcgaatattttccctgcctgcttagagaaagcatagggctcaggctgtcattccatgttacagtaacagttctcgtttaaattcattaataaacaagcactcttctaaacttagctaatgtgctcttactcctgaaagataaagaaatccagttttgggatgctgacaaagtgagtcttctgagcctattagagtaaaaacagcttaccctagtgtaaggcaactataactgtaagatcatgaatgttctcgagagaccacttaaggacagacacaggctattctgggcatattttaatgtcctttttggcctttctattttaaaacatttcatctttcttgtgtgtggctcctatcattgctttcctaagtttaagttggtatattcaactgttcattcctgaactctatcccaggaacttttttctcccactcttaacagaagtcaagagacataggtcaattttctgtaatttagtaagtaattcagtagcactcaatactcagtatcatcatttatacattataaccattataacatttattctgcacatctaagtttgctttgaatgacagaattaatactaagagaccttgtctcccttgaaaattgatgggaaggaagctttagccagataaatacttttttaaaaaaaaatgtcatcaagtgagagagcctgaaccacaatcccaatgggatcagaacacttgagtcaattagccaagactccacctacctgtgcactagtgatggcccagccaatggaaacccactacttaacatcctggcaaagctccctgtctatgggcactgcttaactgggccatatcctcacttcctctctgtctcccctttctttttatgctttctttgctgaccaagcccctgttcacattctttcctatatttgttaatatattccatcacattattaaaatctaactgatcgtaccgtccagggacacatcgtgtccctcgaagacttgactctattctaacccgttattgttaaaattaactttcaaagggcaattagcatttgtaatttcatgaggaatagtcaaatagcctgaaagtaatatcaacaggctctctctatttagaggggcctcactgagaaaaggtaaagaatttcccgttttaacccatgatggtgtttgtaacctagaatgccatttttacagcattcaaaatggccagtttcaaggtggctgacgtggtttcggtgattcatattatcaaaaaatgtctgtcttactagatttttttaaccagaagttgatgtagttttaaattttttaaactgccatttactatgaattttaggtaggtgcacaaataacctacagctttgaactttctgaagtaatattttcatactttttacttcaaatgtagaataattttttactggttaaattattttgacagcttaaacccaatgaaagagtatatgtgtatatatttatgagaacattgaaatactgtttgagagtaattatttataacagagacttctggatttgacaaatgttatcattgtcttgagaactgtttctagttgtaaacagtaaatagataatactgtggtcagaaactttcctggaatttagtagtgtttgtatgaactgtataccactgagaaccagagcagggagaactttagtttattatacttgagttctgttttttctgtttgttttttgcttgttggtttggtttggctttcatcttgtaaatagtaaataattatatttcatctagcacatttttatgtatagaagatatacattggagatggaataaaaatataaactgccaatattttacttatacttttgaaaagatgacttgttacagataaatttatcaggaaaaaaaaagcaaacatagactgcaaatccctttgttttatgtgtcttcctaacagatgatgggagtttagtctaaagaatagaaagccatacggacaataaaactcattcacagagatgaatctcgaatatttcaataatattgcatttggattggaaactgtaaacaaaccttcagactgcaattcaaattttacttttattttttttcttacttaaacatatgtacattatattcctatttctcaaaaatatgactaggaaggtaaaaagcaactaacgttatagccttcttataaagaaatttggccctttatgagttcaactaaatagctaaatgtctacttttctatttgtaacatgtttttttcactgttaccagtaaaaagtcatttatttataggcctctttagatatttgtatttttcttcaaccacaatttaaacattcatcttcaaatcttgcctaccattgcatttatttgaaatcgacacttgtgttttagttcatttttaataatctgaaccaaggcttctgaatcatttatccatatggttacatagtctaggttatcaatgcctgtgcatatcatactgtaaagtgctttgaagatgtgttcatctctaggtgaagcttgttggctgatggatttattaaatgatttgtgacatagcatatcccttgttctacccccaaagtcttccattgagacagtatgcttcctccagaggaggagccggtagtctctggctatattctggaaacataggaaaagaggaatttcccttttttcttttgaggggcccttttcctggtgttgccttaaaatatttttgtcacgtcattttcctcagtagcagtgagcgttactgggtcagagtgttactatacactcagtaatttcacacatatttactcagttcatccttgatatgatttggctctgtgtccccacccaaatctcatctcaaattataatccccacaggttgagggaaggacctggtgaaaggtgattggatcatgggggcagtttccccgatgctgttctcatgatagtgagttctcatgagatctgatggttttatcagtggtggttttccttcttgctctctctcacctgccaccatgtaagacgtgtctgcttccccttccaccatgattataagtttcctgaggcctcctcagccatgtggaactgtaagtcaattaaacctctttcctttacaaattacccagtctctggcagttcttcatggctgtatgagaatgaactaatacaatcctcatgatgatattatgaaatagatactattattttctctatttaagagatgatgacaaactgtgagtcacaatttttaagtaactcagtaacacaactggtgtgatttgtgttactgcaaattactgtctgttttacagtaacattggtaattatgccattttcaccccgacacaatttcaaacacacccttccccaccaaaaactgaatccaattgagattcccagttgcagattctctgataattactcttgcaatcttttagggaggaacagaaggttacatggctgccttgagtggtgtagggggccccagccaatctccaagttttatcttctataccttacattctgccgcttttcatgatacattctgcctcttgattttgagcctttctggcattgagtggtgtagctcacctcgcacagatacctctccccacaagtactaaagtagtttttcaccatttccattttcacttctcatggacttcattatctttaaaaacttcattgaaatctctcacccaacagttgtactcatatttcgttgacgtttcagcctttatactttttaaaaatcagttcactcttactttggtgagttttcagaggcagaggaagcagaactataatcaactaatcaagcccctttgagccagcagttcttccaggtttgtgattcacagataccctggaagaattgatgaaggcttctatcatctcccctagaaatgtgaagacacaagatattctgtatgacattggggctgaggatagcttttgtggttgggaagaagtatgataatgtgtggagttttcccacatatatttaggaactttactcttttattaaaaaacaaattaaaagttgcatctgttaaattttctcttacaaaaacatttatggattcatcattaaacatacatgttttggaagcttagtatttatcacgtttgtatgataactcggtagtgagagcacagagggcagtcccagtgttcagagagtttatggcagatagtcgaaggagagaaatgaggaacaaggaagtataactgtgtgacaggagactatcatacaacttatgccctgggtgctactgaagcactgaggggagggacctagcatttggagtaagaaacagtcatcagggaaggtttcatcgaggaagtagggttcatatgttttgaaaatgttatctatttgaacactctgttatcaggtacagacatatttagaatttttctaacttgtagtgaattttaccttttttcattgtatactaaccttccttatctctcagagcgcctttttccttgtgttgtcttaaaatattttttgacacctcatttttctcagtatcagtgagttctctgtgcttcagagtgttattctatgctcaataatttcacgtgtatttactcagttcatcctcataataatactatgagatacaaaccattatttcctctattttagaggtaagaaaaaacatgatgcacaataacttaataacacaactggggcaataaataggatcaaattcagacaccagcaccttgaagcctgaacctctccacacagtaacactactgtatattacaaatgatctcaatacgtttatactatagcactaagattggtatatgattgtaaccatactaattttctttttcttaaaaaagttgtatttgccttagttacctttctcaattcttttactttcaaattttcttagttcctgtgtgttagacatgcttctcagaaatagtattttgctagatttaagaaaaaatcaatagttctgtcttttcagtatagtatttcttaatatatttctaccatcttattttgctttttctttttgattttcctttattccttcttctccccccccttttggttgatcaaatatttttaaaatatcgatttcccctacaattgctttgaaatgtatgtatgtcatatctagtattttagggattatccttattttttttcaaaaatacttattaaattccaacatagcttaagatcttgatctttctcctgaacataatcctaatcacagtatttgaaacttacttctaatcacaccctatcatgctatagtctactttttgtcctgagttttagttctcttttttaactttaatattagtcattatcacttttataattttagtttatgtagtcaatatagttttagattttaccacatttgcatatttcttctgttattatgtcatcttgtatttctctcttttctggacatagttccattctttgacacacatcctttagtttagatggcttttaatgggaatgtgttggtactaaggtgcttctatttttacatttttaatttaaaattttttcattttttgtttttctgaaaatatcttaattttaccatcttccctgtttatttagcttggtatacaagtctatgttgaaagtttagtttctctcagtactttgagtatattatcctactaaattctaccttttgttttcacttttcttaagaagcttcctgactgttttaaaattgttccttagggatactctctcttttctcccttgctacttttatgttccgtggtaatgtgctgttatagcatgctgtgtttagtgctagattacctttataaaaatgtttaattgggatgtattgtcctttctgaatctgaatttttaaatgttctggaaaattcttagatgttacgtattttaattgattctccatcattctcccttttctctcctctgaaattctattaatattgttccaaaagtaattacagtttttgtcattacttttaatggcaaaaaccactattacttttgcaccaacctaatacgttagaactcatttttatactgtatattgtagaatttatatttaatgtttctaagtttttttaaatttctgaatgacattgtcgatattcaatctacctttcagtttacaaactcactctgtagctttgtctcatctgcttaatgcaactaatgagaggtttttttctttaaaaaaatttaacttatattggtatataataggtctatatatttatgggctacataagaatgtctaataattatatcagggtaaatggggtatccatcacctaaagaattcatcgtatacacaacagagtactattcagccatataaaagaatgagatcttgtcatttgcaactacatagatagaactgaaggacattatgttaagtgaagtaaaccaggcacagaaagacaaactatgtgcgttctcactcatttgtgggagctaaaaattaaaataactgaactcctggagatagttgaatgatggttatcaaaggctgggaaggatagtgggtaaggtgggaaatggtgacagttaacggttacaaaaatacagttggatagaatgtgtaagatttaatgtttgatagtacaacaaggtaactaaagccaacaatattttattttacatttaaaaataactgaaagagtccagttagaatgttcataactaatgcgtttttaattccaataatatatttttaattcctggagtatccatttatttccttatcaacaatgactggtaatttttaagtattatttgatatggtttggctgtgttcccacccaaatctcatcttgaattgtagttcccataatccctacatgtcgtgggagggacccagtgagagataattgaatcatggcagcagttccccccatgctattctcacaatagtgagtgagttctcacgacatctgatggttataagggactttccctcacctttgctctgtacttcttgctgcctccatgtgaagaagggtgtgtttgcttccccttccgccatgattataagtttcctgaggcctccccagcactgcagaacagtgagtcaaacctctttcctttataaattaccagtcttgcctatgtctgtattagcagtatgagaacagcctattacagtatatcttattcttttcttgtatatttaattctcattttacttcaaataatttatgaatgttttatttctcaatccccaaatttagctgaaattgaattcatgggggccaaatattccatgcggtgtttctgctgaattctgttcattatacttgttttcttgagttttatatttttggattgtgagtttaaatttttcagggctttgtcattagtaatcctataattccagagtgaatccagagaggggttacactttatttcaaaagataccagcttggaaccattttttctattttaagttcttgatttgggggttatatccaatagtcagtgtaaattcaaaagctgtaatttaattcagcaagtttatggcttatgcattctcaagaatcatcattttttttggaaaaagataaaatacagacaaatttccttgtcatccctctttgctgactagttaatttttctccagtgtctgctttactgtgaatttagcatttttaggttttatgtggtggggctaggggcgtgagggagttcctattctttgcacaggtctattacttgatttctaattctgtttggccttgaaatccaaaattctgcattgtaaagattagtaaataccctctgactactatagcccaccatcagctaacaccctgaatttcagtgttctctttttttcttgatacccaaaagcttctcctattttactggatgctcagatatataacttaaaagatgtatgttacattttatttagcatttctaggtgtttgaaactggaaaattttcaggctcccatgttgcctcgtcctaggaaatgtaatccttagagattattgtttctgtttcctattatgtgatgtgacattacagaatgttaagtattttaaataaattatcttatatcagaaaatttatgttataaacttttggggtgcagttaatattttagaaatgttttcagatacaaaaagccatgttttaaaatatctcagaatagacattataatcttgaaaaaaaaaccctgatttttattgaagggttttgttatgaatgaaatttggaggtgctcttgtagcattctgcatttacattctagcatcacgcttcatcaataaacatgaagacatttgtataacatgtaaaaccatcttatttataccaagtgcagaaaattgaaaagcttctaaagattatatcaagaggaataataataatacaaacaataacaaacaccataacaacaaagaaaagaagaagcaggaggaagaatggcagtcacaggctcctattttaggccaagcacactcctaagcatcaaagccaaaaaaaaggcagaaaaatgttaaggtgacaaaggcaagagcccacgctacacaaagcatttcttggctcgccaatttcaaagcaactcctgagatagagcctcacaatctggctttgctattgatttgaagttaatatcaaattaacagaataccaaaatatatagtcatatatagaagcattccaaagctaaataaaactgtgtttgatttcctactagttgggattgtccctatcatcttaatgcagataattgtgagtctagtttatatccatattttacttttccatctgcaatgatactaatttttttaatagcagagccatcccccatatgaaagtatttggaaaatatatagactttcaaaatgacaatatagacgagactaagaaattattttctgggtttttttttgttttttaaatagagtgaaaaacgaatctctcaaatacaaaatatttttaaacgtgagaaacttgcacgctactccctcaaagctgtctaattcaagcaaacactaaatgacactggcagagctgattgagcagctgctgggtgtcagtcactgtactaggggcttttaatacagtgttttatttaacagtttacaaaaaccataggaattgggtattattaattcctgccttacaaatgaaaacactggcgttaagacaggatgagtgagttagtcagggtcacacaaatacatcttaaaccagttctggctattctgcagcccaagcttccaaccaccggcattgtatttttcagaatattgtataatttcatagtaattaagcaaatgtttacacttataagaaaaaatcagtaagacaatattattttatgttatgactgtatctgccgatgttttagatatactagcagtttgtggatataaggaattaaagttatctgatgtaaaaattatttattttatatttgcattttctctatttatcaatacacaactaggtcatgaaaaagactatgtaaaaaatatatgaaagtgtcaaattattcagtttgttcatccttttattgtggcccctaggcaacgatggctttttaaatcattttgtataatttgatttgcaaattgctaagtatcctagtttgtcaacatactagtctgcttctctaatttcttttcaattttacgttcttgtaaatctctttacgcttattaaaagatactcaaaaatatcactatcttttaatgttaaaccaactttagtataaacatattttatatataatgagtattatatgaaaataagatgggaaacccacaaatactattaaaaaacagttgctacaactaacacaatatagttattataaatatccatgtataaaaataacattctaaaccttaaatattatgaaatattctagctaaagtataatttaaaataatatggctactctaaatggtccaataaattataccaaattaattttcattaaatcaattaatctaataaacatcacttttaaaaataagtattttcttgtttatatatggcataataatttgtaaatcactacaaacatattttgcatttggaaaaccagatcattagagggaaaaaaaagatcctgggcattttcaaaattcctgagtttgttttattaaataaataaaaggctcttgaacaggagcataacaggatcagattaatatttttgatagagacacctcaaacttcaagccagaaacaaattggaagtggacagtagaaaatctgtggtagtctgggctcaggtgggaacgaagagaaagagggctattcaacaggtagaattaatatgatatgattgtgcattttgcagagtgaggatggaagtgccaggatcaactcttgattgattaatatgcacaaacttattgataaactgaagctaagactttttgagtgaccagtgatatagagacaatgacagaataccagcaatatcttgagttttgaacatgagtgcaatattaaaatggaggagtcaaactaaactttggatatattagtgttgagttcagaggagagagctgagacagagatatgattagagacatcctcccatagttggtagttgaagcaatggctttggataaggtctttattaaggagaatctgccaagaaaacagaagtagcctaggacaagctttaggaactctctcacttacagacgaggtaagagacaagaagtcagtacaggaggttgaaatgtgattgtcagaaaagtagaaggaaaacctcgaatgatgtagtacattgtcagccaaagaaagataaattatcaagaagagagtggcaccttctcaaactttttaatactgccagtttatctactcatatgaatgggcagtaacattgtttttaatcctattatattactctttctgtagtttatcttcctaatgagattatagcattcctgaggacaaaagcaatatagtttaggtgcttaataaatataaacaggattgaaattgccaacactatttttatcctagaaaaaaagtgatacttaatattacatcttcacttcctttaggtcttggtgtcagttctcttatcagaaaggtctctgaccggcagtttaatatctttcctctctcctggctctgtatccgccttactcaatacatttttcttcataaaaattaatgcattcattcaagtgatcattcacctaacaaatacagagcggtctataagtctggaaaccaatatatattatgttttaaagaagatatttttatcactattttcagacttaataaataccttgtatcttgatcttctctctgatatcatatggattgttttagataagtaaggtggtgatttttaaggtttgtgaattttgtgtcaacaaatatttttaaaaagatacatagtgctgcaataaacgtacatgtgcatatgtctttatagtaggaacagaaacccaaacaccacacgttctcactcataagtgggagttgaacaatgagaacacatggacacagggaggggaacaccacgcaccggggcctgtcggggtggggagcaaggggaggggagagcattaagacaaatacctaatacatgtggggcttaaaacctagatgatggattgattggtgcagcaaaccaccatggcacatgtgtacctatatagcaaacctgcatgttctgcacatgtatcccagaacttaaagtaaaaaaataaaaatcgtttatgaatcattgattcataaaatgaatatactagaaaaagaaaataccatattcagaagtgcatacacacaaacacagcccccccaacacacacatatgtaactaaataaaccaatgcagataattataaattgtgacaaattctgtaagaagaaattagtagttgaagatctaaaatgaaaaaaatttatagaaaaattttaaattgactggtctgggagggcctcttggaaggtgacatttgaactgacctgaatcatatggataactcagccatgaaaagtacaagtgagaaaaataggaagaaagggtttggttttcctgagatgcatagagaagagtatggctgaaacatggtgaccaaggatagacatcttaagtattcactctgaaaactagcaaagtagccacacaataacatggcagaactattgctaaatatgatagatttccttgaagagtaaagtatatattacagaaaaagtgaaactcatgtataattttcttacacatatttaatggtttaattcatattgttttaatttgtaaatttcagaagagggatgctctaagtgggtgaatgtatcctacgatttttagggttagggatctctctatgcctaaatctgcctaaaagagatgtgaatttaccttgcagtgagagtcaggagtcagaatattcagagtctttgaaagccacagaagtcaccctggtttgatcatatagaatacatatatgaggatcaagtgtaaaatgctactgacaggtctagtaagagaaagactgaaaatgttctttagtggcctgaaaattatcagacactatgaagagcaatctcatcaataatccatagaggttgaatgcataacaaggtggaataaatgtaatccaaattagagctcttggatgacagaatttttagcgttaagtgccatttcagttggaacataacattttatacaaatagtttttattttgaaacaatttaaaacttaccaaaaaaattgcaagaaggataaaaaggccactactgtacccttcacccagagacctccttcaacgtttgttacttgtttgaaaatgtccttgtattagtctcttttcacactgctgataaagacatattcatgactgagcaatttacaaaagaaagaggtttaatggacttacagttccacatggctggggaagtctcacaatcatggtggaaggaaaggaggagcaagtcacatcttacatggatggtggcaggaaaagagagagaacttgtgcagggaaactcccatttttaaaaccatcagatctcatgagacttattcactatcatgagaacagcacaggaaagacccatgcccaagattcaattacctcccaccagattccttccctgactcgtgggaagtgtgggagttacaattcaaagtgagagttgggtggggacacagccaaaccatatcattccttgtctggccccttccaaatctcatgacatcacatttcaaaaccaatcatgccttcccaacagtcccccaaagtcttaactcatttcagcattaactcaaaagtccatagtccaacgtctcatctgagacaaggcaagtcctttctgctcatgagcctgtaaaatcaaaagcaagttagttacttcctagacacaatgggcgtacaggcattgggttactagagctgttccaaataagagaaattgtcaaaataaaggggctaaagtccccatgcaagtccaaaatccagcaaggcagtcaaatcttaaagctccaaaatgtgtcctttgacttcatgtctcatatccaggtcatgcagatgcaagaggtgggcccccatggccttgggcagctctgcccctgtggctttgcaaggtatagcccccttcctggctgctttcaagagctggtgttgagtctgtggcctttccaggcacacagtgcaagctgtaggtggatctaccattctggagtctggaggatggtggccctcctctcacagctccactaggcagtgccccagtagagactctgtgtggggcctctgaccccacatttcccttctgcactgccctagcagaggctcttcatgagggtcccatctctgcagcaaacatctgcctgggcatccatgcatttccatacatcctctgaaatccaggtggaggttcccaaacctcaattattgacttatgtgcacccacaggctcaataccacatggaagctgccaagacttggggcttctgttctctaaagcagcagtccaagctgtatcttgcccccttttagtcacagctgaagggactgggacacagggcaccaagtctctagactgcacatagcagagggaccctgagcccgacccatgaaatgattttttcctccctaaacctccaggcctgtgatgggaggggctgccgcaaagttctgacatgccctggagacattttccccattgtcttgatgattaacatttggatccttgttacttatgcaaatttctgtagcaggcttgagtatctcctaagaaaatgggattttcttttctatcacattgtcaggttgtaaattttccaaacttttatgctccgtttccctttaaaagctgaatgcctttaacagcacgcattcacccctcaaatgcttttctgcttagaaattgcttctgccagataccctaaatcacctatctgaagttcgaagtttcacaaatctctagggcaggggcaaaatgccacccgtctctgctaaaacataacaagagtcacctttgctccagttcccagcaagttcctcatctccatctgagaccacctcagcctggatttcattgtccatatcattatcaacattttggtcaaagccattcaacaagtctctaaggagttccgaactttcccacattttcctatcttcttctgagccctccaaactgttccaacctctgccgtcaccagttccaatgttgcttccacattttcaggattcttttcagcagcacctcactctactggtaccagtttactgtattagtctattttcatgctgctgataaaaacatactcgagactgggcaatttaccaaagaaagaggtttaatggacttacagttccatgtggctaggtaagtctcacaatcatggtggaaggcaaggaggagcaagtcacatcttatgtggatggtggcaggcaaagagagagaacttgtgcagggaaactcccatttttaaaaccatcagatctcgtgagacgtattcaccatcacgggaatagcacaggaaagacccacccccatgactcaattacctcccactcggtttgtcccatgacacatggaaattgtgggagttacaattcaagatgagagttggatgggcacacagccaaaccatatcagtcctttacagcaaaaggacccactctgggatcacatgtcacaccctgtttttctgattctccagtctctaacaatcataattatatcttcactttagtaatttcttcactttcacaaccttctcattcttgaatattctatcccagtcatttgtcgcttgtcctgaaattggattagtttgatgttatacccagccttgtatttttgacaggtgtcttacacaccatgctttattcttctcattgaatctcatcaggtggccccccagtatcaattggtcctgttactcatggtgataacattgatcacttgattataaaggtatctgcctggtttctccaatgtaaagtgactgctctcccctttgaaattaataaacatatatatttttaaaattggggtacttggtgtatatatttatgaggtacataagaggttttgatacaagcattcaataatggggattggggtatccatctcaaacatttatcctgtgagttacaaacaatccaattacattgtttgttattttaaaatatacgattattattgactgtatttaccctattgtgctatcatatagtaggtctcgttcattagatgggggtggtttatgagttttttaaaaaactatatttttaaggagatagtttgaggctatgttctgcttccaactttcacccacttatttgagcacctattgatatgccttgcctgaattaattattaacatgatggtttccaaatggtgactttcttcttcctacattcctgttacatgtattacttagtgtagtgctattggaggagctttctattttccctgtgtatttattcacttttagacaggcagactcttggattcctactttattcagtaggatatgatctgtagcttcctctttttttctcctcccttttttattttgatattcaaaatctctttttgatactcaaattatttattttgtatgcaaattgcccttaatttgaggagcagatgccatttcaggctggctcctgtgtcattctgacatgaccccatcattctttgggcacttcattactttttggtgtggcaaaatgttccagattcttactgtactttccctaacacagcttagaatcagtcatttctccaaggagtcttggttttgcccagcatagaaaccaggatctgggaaacagaactattcattgctttgagagtgaccctgtacgtaggctgtcttcagtggatgataggaaccatctgtatattgaccaaatatacaatttcattcatacttatttctgtatctatctacatatagtgaaaaccacaaatttacactaattgattaaatcctaatgcaaacccactgggttcattctgtctttttttttcttttcttttttgagatggagtctcgccctgtaacccaggctggagtgcaatggcgcaatcttggctcactgcaacctccacctcccaagttcaagcgtttctcctgcctcagtctcccaagtagctgggattacaggtgcacaccaccacacttggctaagtttttgtatctttagtagagatggagtttcaccatgttggcgaagctggtctcaaactcctaacttcgtgatctgcccacctcagcatcccaaagtgctgagattacaggcgtgaacattctttcttatgtttcatatgtgtaccctctttctttgacgttgggaatttgactctcactatcctccatgtatttacttatttgcccaatcaacctgtactgtaaccaatctcccagccacatggggtggagatcctgtgtggacatcctctgtgcacaggtcctggacaccactagactctcttcccctggactactctatcttcctgcctgctgggaccctagtttttatgaggctgttttcctgcccctgctcaatgggtttttgactaagttattcaggaaggttgagtaaacagtagagattagtagacattttgttattcaggaaggttgagtaaacagtagagactagtagatattttgtgcaatctgccaagatcaaattgaaaggaagacagtaggtggttttaaacatccttaaagcattccaccagcctcccttggacctcccaaccttcccaactttaaaaaaggcagagagaagctttatatgcacttggttttaaacatgtcaatttttcaaccttgttgtccaccgtttgctttttctgtcccatcagatgaacattataacttacaacaatttaggttgccattttaatgtcaaaacaaatatcagcaagtttttcactgatgtatttctgaattaaaattttaaaaccttgaaaatgcttgtgttttctttgtcagcaagaatagcaatatactgagtggacttcaaatcaagtatgaagtttttatatgcaagtcttgaaacagaaatttcagacatgccagtgaagtaatataattacaatgttcctggaaagaagaaaggtttccagtgcatggaaagtaagatgcaattgagactgacaagattacaattcactgtgggtgttttaacacattgtcagattgtagaaaccagttacaatgacccatgtatagacattgtattttttattccaaattcatagaaattcaaagatataacaaaaatacgcaaaaattttaactttatatttttactaacttgacaattcgttacattcactttatttccattttatagctattcatttctgaccctcaaaatgccagctgcaaatttatattaccaaaaaatcccactgttaatctaagtaggttaaatcctgagctttggagtagtcactgaaggtatcacaaacactaatacactagtatttttactgaaatttcatttgttcataaagagaacaaacacagaaaataaataataggttctcctctgtttctaagggagttaaaacagcaggaggttcagtatcagagatccaacatctttagctcattgttgactaagggaactgtcaatattccaccagttacataatgtttcacaggtgtgagtaatcttcaggttctaattattaaaactgatttgagattataatagcaggatgtgtttgttatactttgtattagttatatattgctgcatagtgcattgcctcaaaactcagtggctcaatgtagtaataatttattatctcttacttttctgtaagaggccagtaatttaggagcagcttggctgggcagttctgacttgatatttcttataaggctgcagatacatgtttcctagagccacaatcagctgatgacttgactaggattagaggctccatttcaagatagcagactcacatggctagcaagctgctgctggaacttggtaataggctttagttctcctcctaggtgcctctccatcttactacttgagggtttccatggcttttaggctggcttccctggagtaagggatcaaaagaccaaggtgcagcctctaatgcctttatacttaaccttggaaatcatatcaccttgttactactgcaacattctgtgtcacacggagcagcactgattgtgtgggagggaactatacaggccgtaaatattaggaggtatttaaaataacataattataatgtgaagatttatggccatcttggagattgattgccggtgttcaccctacagcccacagagatacatatctttttccacacacgaagtacacccaacctcctctaaaagccatccaaagtctcattccactaggccatctgctcaaattccaggacctcattgtctaagtcaagtcaatccaaaatgaatctcagagagtccaagagaaaatgaagctgtttaggtatagtcactcaagtaccacttcccaagtacagttgtcaatcttaagacctgtaaacaagttttgtgccatcctcacaccacatatacaatggtagattatgcacagagaaaccaaattagactctctggttcaaaagtggagaaaataagagagacaagtcactggtccacagcagttttgcaatccagtcaggcacatgctggtcattcttgattagaactcagtcatgctgtttcccggacatgattctccatggctcttggctctgccctctgtgttagttctgccactgtaagtcatcctttttttatgtatatagaggttgtctatgtttacagctgcatagactcctgaccataaagtttggaagtcaaaggcctgtttctattttgtcccaactctgtccctttcagtacaagctggtggtgttacctccaatatagttatcttaaaaatgaatgggttttctatgaattttattcaggtttactccacttaataaaaggcacatccacaattatataaagataagctcccccttaccccttgagcttctgtagatctacagaaggaaaatgcttttaagataattagaatccctattgtttaactgaaaagacctgtaaagcataaaaataagctctttagagggtcttctgtctcatggagtgtctccctgaggaatacctaataattttcttgggtctttatgtagattttatagtcacgcttccttgtcatccttagatcatgttttcctggaatttgatctttgcttagaaatgtgatttcttaatgtttgcattgttcaccatctggagagattggaattgaaagagcattttactttaaaattcagtaatgcctggcttcttcatttgtaatagttcttctttagctttttctctcccattttctttttcttttactataaacagaagatgcccgatggctccttcaatactctacctggaaatgtccttagctagattatacaatttcatttaactgtatctttttcttttccatattatcacaagaaacaatgttgctaaactttccaccagaacatagcaaagatctaattttctctaatttctgatgacacttttctcaccttcctttaagtcattacagctcctcaagagccatcacgcttcttttaaggcctgtcccgctaacttgcatattcctgtccctaaattactgccacattttcaggtttctgttataattctctgccagtatcaaattctttttttttttggtactaaagtattttattctattttattttatttttaatttttatttccataggtttttgggggaacaggtggtatttggctacatgagtaagttctttcgtggtgatttatgagattttggtgcacccatcaccttagcggtatacactgaacccaatttgtcttttatccttcacccctctcccacctttcttccctgagtccgcaaagtccattgtatcatttttatgcctttgcattctcatagcttaactcccacttatgagtgagaacatacgatgtttggttttctattcctgagttacttcacttaggataatagtctctagtcccatctggattgctgtgaatgccattaattcatttaattttatgactgagtagtattccattgtgtatatgtataaaaaagccacatattcatggcagcacaattcacaattgcaaaaatgtggaaccagctcaaatgctcatcaatcaacgagtggataaactatggtatatatacaatggaatactactcagccataaaaagtagtgaattaatggcatttacagcaacctggatggcatgtccagacatcacattctttatttgatatctattgttgcattatgtgtcaccttaaaattaatttcaaacaatgatgaatattcattacctctcctgggccactccagaagacagtgtatgacatggtgatgacttgccacgaagtaagtgatctcagagaccaagttgcagagttttctattgttcacagaagtcaggcctaattgattatagaaggggacaacaaaagggtgtgaagtcaggagccaaagattaacgatgtccatcttggaatattatggagagaaaaaaattaatgaatatgtagtattttgtcctataattatcttctcctagaatatatctcctattggaaaataaaaggacttaaccacttcaaacttcaaaattaccaagatcaaacagaacattgttataagcgaatgatgaattcttgttttacaaccttaattatacccaatttgtagtaatcggtatttatgcagctgctgtgcttcagagcagcttttattttcacacatacatccattcattttgaaatctttcaaagctagtgtggatatggtgagactcccaattattcaaaaaaaaaaaaaaaacagaaacaaatgacagtcttcttaagagtggtcagtaagttacaactgggtgttttctctctgctaagtttagacattacactctattcaattttatcttgattaaacaattgaaaatcatgtgtgcacgcaactggtataaacagatcatttacctaatatcagcatttttctgaagggactaagtcaatgcgaatgaaaaaaatgtggttgactagaaaatacacatacacacacacacgagccatatattaacattaaagtagagccttacatggattttttttaagtcaagaagttaattcaaatacaatcttatttttatacagtactgtgttaataggaaataatatatacctttgtgattaatccttataggagattcaaatgacagttattggactttaaatattgtaatccattaatgaagagaaaaagaagatttctgctctactaaaatactatccttggtcaaaaagaataggatattttgaaaatgtcacttaataactggtatggtttggctgtgtctccacccaaatctcatcttgaattgtagttcccataatccctgtatgtcatgggagagacccactgggaggtaattctatcatttcataatagtgagtgagttctcatgagatctgatggttttataagagtctttttccccactttgcctgacacttctccttgctgctgccctgtgaagaaggatgtgcttgctttcctttctaccctgattataagtttcctgagccctccccagatattctcaactgtgagtcaattaaacctcttttctttataaattacccagtcttggcatgtcttttttaacaacatgagaacagactaatataatggccattttttgtttttattgaaaattcacttttatccatttaatggaactttggttccatcccattttatataaattgtttgttgttacagatataatattagatgaagtgaatgtgtcaataacttcagatttgcaagcagacaaattagtacagtttaaatttgcccagtaggcagatttggtatggtgaaccatatgaaaagtagaagctctggggactttctggagatacttaatgggattgaaaaatatcattttcttatggcctacaaattttccatccataatgggtgtttctatccaattatgcatgtttctcttaaaaagatataatagtaattgattggtggtgatctcttaaagttatttagcaataaactcttaatgtctgatttcaaggttggtgtgggcattctatttcctaatagaatcaacagtattgtgtgtgtgtgtgtgtgtgtgtgtgtgtgtgtgtgtgtgtttactcttgttatttactcttttaattttagttctatctgttattatttactagtatatataccatattatggtattttatatataccatattatggtattttatttataccatattagatagtttgtagaagatgtatattcaaagtagggtggctgacccttatgcctaaatttatttgcttctaatgttcccttagattttataaattaaaaaaaggcatctataatgcaaatatctctttgtaatgagttacacactaatctactttatttcataatagtaagtttggcttatttgacatctgaataacaggcaatagggaattaagaaaatagaaataaatatcaaagaaacaagaagaagaaagttggatagttgggaaagttctaaagttttgtgtcctaatctctgagggctggctcagcagagaaagaataacagtgagtctttgacagcagagggacagaaagatgtgacagtgagaaagatgatgtcaaaagagaaaatttgagtgacagtagaccccagaggcaaacatttacctggtaacccattacaattcaaccctgacttcttcctctgtaataatctcactttctcaaaaaacttcctttttctacactgaatataacatcagcaaggattaaagaaacagtagttggatgtgatggctgtggccaggtagaatacccacaagaattttagtgaaggttatactgtacaccagatttacattcccatttcttctgtttcacaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacaggtaaatgatcttttcatcctacctcacgttgtccaaactttccaaacctgtgtttctgttgtgagaccagtgaaacatcccaaaagaaaattaaagttaaaaacaggtaaggtggaaattaccattcaaagtacgtattgtagtatacttgtgatattagcagtgattatgtttatgtttttatgtggatatatatatcatatatctatcatgtatatcatatatagcatatatatgctatatatgagatatatcctatatgtgctatatgagatatatcatatataacatatatacatatatatgtagcatatatatgtatatatagcatatatgagatatattgtatatatagcatatatatgataaatatatatgagatatatcatatatatatatagcatatatatatatatatgtgataaaacacactgtggtgttatatttgttcaacagtctccaatcagagaatctgagccttcaataagtagttttgcaagcaacagcagtgtggcagagaaactctgacagttgatttttagtttacagcagaaatgtgccttctctttctgtctcaatcatgacttggcctcagcatgtgccttccaaaacccgcttctgaaagaaaaggaatattacaaaagtgtcagtgtgcaagatgggtatttatgaagcagaatatttagagtaactggttcagcttacaaaatacacctattaaaatatgacaaaaatcaaatctttattggttttgcaaacctggggagaaatttttaataaaaactttaattgtattctcacacagtgggaagatgcaacttttctgtgaaatattatgattatactgcatacactaccttaatatacttctagatagggcctgtcattccactatgaacaagtttcattttgagatgctttgtctgtaaacaaattatatatgatttgaagttaacctagtgaatttatatgattttctaagatatattgaagtcttttgaggaagaactgtcttatcctaaaagctcattttattaattttgtgtttagggaagatgaaagttctttaaatttttttaaaattttgaactaagatattaatcctatctcagtctacccacaacaaaatgtagaccataagtctttaacaaatgtattttattcaagaggaaatactttaagaagtcactcaaaaatgaattttacaaacatataaaataatctattttgaagtaagtttgctttcataaaatctgaataagatggcgttcgtgtgaatggtaagttacagtttgtggtggctgtaagatagaacttctataaagccttcacatgtttataagaagactttatgacatagtatactgcttatttctattcatgtatgcaagtactgatcttagtagcctaaacagtttatatttaaatagaatagtgaacaattttaatggaaatatactcctaattattgagccattaataatgtatcagctattatttctgcctagagcaagtagcagcaataatcagaaaagctgagatgaatgttttaaagatcatttgttctgattttagataattatctacatattgttttgtacagaaaaaaatattttcttcataatagttatggagttttttagtatctactctttttttcaggtcagtaattgtgatgatacaataatttcattacctctttcagcttggtaaaagggctaggtaatatgttgctgtttctctctaaacatcgtgtttctaggcattatatataaattgtttgctactaaagaaagaggggtgatatgttgagatattaatgttttactctgatagagacaggagttaaattggtcccaaaagaatgaatgggattttggtaaattaataaaatggaaggtgatactcctggtggggagaccaacacaagggaaggtatagaaaagaaaatacaagtttcaatttttcacagatacagagatacacaaaatttttttttttttttgccaaaataggtcaggcccaatattcatcttgccaagtttcctgcagctaaaagaacaaagttcacacctttcttattctttaggatgacaaatgaaaagattagctgcagggaagtagccacctgtgacacatctccacgcattttctaaacccattatgggacctatttttagcttacactttttttttaaggcaacaacatctgtacattaaataccaatgtgtgaaacagcagattcctttagtcacctaaaatgttcccagttcaaaatcttaagcatgaagtgttgtactttcataggtatgagacaggactattttacttaaaccactgaagagtgtattgatgatatcacccttaatctgtgtctttccaggtaaaagtaccagtggttttagtctgtcctcatagagcagtgatgtatccagataatcctttaatgatacacccctagcacatctctgcttctttctcctcgctgagactttgcaactgccccgtatctacaactttcttttcagattacccaaattctcccaaaggaagcctacagtggcttttcttttctccttcccagttccagcttgatcgatttgagagttatttttgagagggagaaaaaaaaaagtataaatgagaacatagggtaaaaaaaataaaagagctacacaagcctgacttttatagaatgtttggagataatagtcacagctgcaatgatttgatgagtagaacttagggaaacaatttgtctgaaggtgtttttctgtgtgttgtattggaataccctacgatttgaactttttttttttttttttttgctttgtgtgtagatttgcatgtggcttattttgttcacgtgcttattttctgaacgcagctttgaatcaaggaaaaagcaagcttgccaagctacagaattatgcattcagtatttattttctgagtgcatactagatgtcatgctattctaggcacttggaataaatccttgaacaggacagataaagattattgaaaattctaagctgacatggtagagggaggggaggaaggagagatgacaaactctaattaaaaagtaaataatctagcaagtgagaaggaataaattttatgggtaaaaatactagaacaaaacaaggaagcctggcatgtcagtagatcaaggtgttgagttgtagtttaaataggttgaccaggataagcctccgttgaaaagataatattactgcaagacttgaaagaggtaactgaatgtactaatgcagggaaagaacatttgacccagagagcacaggcaacgaaagaggcacttgcatgatccaggatcagtatggaagccatggtggcaagtttcgggaggtcaagaatagttgaaggaatagacgccagaacaagccctccagacttgtaggttattgtcagggtgtggcttttactttgaatgaatacaggagccatttgcagcgttctaaatagagcaacatgatgtactcacgtcttaaaaggatgaatctgggctgtgggagcaagaaaggtagaagcaggaggctaactaaaattatgccattataatccaggtgagagacgcgtgtaccctagaccagggtgctagcacaagaagtagtgagatgtggccaattctgaatatattttggaggcagagtcagtagggtttctttacaaattagatgtggggtatgagagaaatggaggaaatagggataaatccaaatgatttgctaagaacagcaggaagaaaggagatgccatctcttcagactgggaagactagttgtagagaaaattagtcaaaggggctaaagaaaaagtcagaaattcaaggttggacatgaattgaaatgtctactggacgtctaagtagaaatgtcaggaagagagttggatatatgtatgtaacaagcctgtgtctgcaggtttacacaataaacctttgtgattgacagaatcccttttgtttaactcttgagggtctttggtgtctttagttacattttataagcaatcatagaactggaaggggaggtggtggataatgggcagaaattgctctctaacaatggaagctgctagcttgattcccttagtgataatctgctcttagagaggaggattgtcatcaaccttcagtttccaaaacattctctgagaaaggtaaaatacccagagataacatttttgtttcttcttgcattgttactctcttttactcatttctagaacccttgcattattgactgcttgtggcaaacatcttaagatgcctgactcaactcttattctcaatctttttctctccagcctctttccaggtgtgaaaacctgagagcccaaaccttcagaaacactcctttagccacagttaggtccactcacttcttccttcaagagagaatcacaaggagaaccatagggcatctcaaagttggggagagggggtgcttggggagggacggacattgagggagagtcagggagggtattaggggatggagtgagtcagtccttgttggtattggctagaattcctaaactcggagactcgctacaacagatctgatagttggcctcagaacttgtgaattgttgtagaattattgtttgacctgtttttctgtggttgtagccaggacacatggttaggaagaagctgatgttaacatattttgagcttaattaagtggtgatcatgcttggtttgacaatttttttttctgttttgtgagtaatagtgaagtccattttgcaactgtggtttctgtttcagtcctaagagcactcttcacagctcagctgccagaggaatgttttttactttatgctaggcagaagcagagatgagacacagttctggctgctaagagctaagcagaagttagctgtggtgttcttgggaaagcttttgttctcctgatacagttgcccctcttgctctccaccatccttggtaaaatgtagaactgatgtctagagctgtagggtcaagaaaaccatagatcgagcagccactgatactaacttgtatgtgaaaaatatcaactatcacttatctaagtaattatgaattaagttttatttttcttggagccaaaagcacctgccctttccctagtccccacttctaaaattaaccagtaccatcattttaccagaatacagaagaacaaattcctaaatatggaaatgactttgaaagaaaagataatactttttggagtgtattaagttgcattttagtgatgtcccctagaggttgaaatctggggactaaatagctgtttagaggccaaagcaaattcatattgttagagccagcactagtaaaaagtgactcattagaattagaatctcctctgctctttcctgtctaactccattgaaaatatattaaaaaatacatttagaaacaaaatcagtaaacatcccagataacacagagagcggaaaaggaaatgcaaattgcccaacttaaacatagcctacaaaattaccacttgagaaattatgaatagactagatcctattccagagttagtaattaagtcttcattatatttttggatgaagtacataatcacagacccagtttttttttaattcaatgctttattttcaagaatatccagtttgatttttttctttcaaagaaaagaataagtaaatgaattttcataagaacatttaaatgaggattaggtagatacatgaaaaatatctcaaaactaaattgactctgttggaaaggcgaatgaaagcagtcaagaaggatgatatggtttggctctgtatccccacccaaatctcaagttgatttgtaatcaccatgtatcagggaaggggactggtgggaggtgattggatcatgggggtggatttcccccttaccgttctcatgatagtgagtgagttctcatgagatctgatagtttaaaagtatggcactttccccttcactcactctctctcctgctgccatgtaagatgtgccttgcttcccctttgccttctgccatgattataagtttcctgaagcctctccagctgtgtgggactgtgagtcaattaaaactcttttctttataaattatccagtctcaagcagttcgttatagcaacgtgaaaatggactaaaacaaaagaggtcatgagtttctacaaaagcaggcttaaattttgcgttcataacttagatgaagaaaacatgtaacatttatcattttctaaaatttgtcttcattcgctaattccctatttctagtcagtagcagaaaagataaatacttgaacacatacattttggtactgtaatcactcctcctttccgtgtatattcggtcaacatgggagttgatctcagtcaaaggtaaacttccttttgtggttgtactaccatttcaagagttctagatgccctagcatggcttgggtcagagtcagcttatgcaatacgttatcaccacaggggtgggatctgtcccacctgctccaccaaggttccctctgagctccctgagagtccccagcctggtcggccttcagggtcccacttctgtccctgccacccactgtcatgacaactgctccttctggccttcagatatgtcatgggtattgctggacttaggttctgggatctgtgtttaaggtgacagctattcccagcatgtctgagtcccatttggttttagcattgagagtcctgcttctggagaaacccctcagttctgggtaaattaggatggttggtgactatacacactaggtcttctttctcctaataccttcgtctgatctaccagccatctaagcattttataggccctatagggacacacagtgatttctatatcttttggagactacataaagctgaaataaatcatggcatatgtgttgttggggagaggttaggcattagggacagcttccttaggctacgccccctttacttcagcatgccatccctccctatctgctctacacagccactcaggctgacatgaggccctctacacattagaccctcaaaggccatcataggattcctaagtctctgctgtataaaccaaatataaaattctaagccatcatactgactgatgaaccctccccttagccaaagacattccaaataatcctgaaaaaaaaaaaaaaaaaaactagtttaggtcagacatgcctcacaaacatcaacacagagaccttaagactgatagaatagtctctttaagtctgataagaaacatctacaatccattctctctgaagactgctacctggaggcttcatctggatgatcaaagttgggtccccatgactgcttatcctaacccagacattcctttctattaattccatgtctttaaataataactctttcaaccaattgccaatcggaaaatatttaaatctacctatcacctgggagcccctgctttgagttgtcccacctttccagatggaaccaacatacatcttacatatattgactgttgtctcatgtctccctaaaatgtataaaaccaagtcacaccccaaccaccttggccacatgtcctcagatcttcctgaggatgtgtcatgggaatgtccttaacctcagcaaaataaactaaattgattgagacttctctcagattcttttttggcttagggttgagatttattcagtcaacaaatacttcttgaagatcacaccaaccagcagacagtacctcctgggactgaatgctgaggtgacgaagggagggtgattgatcagactctacactgttttaatggttgtttggcttttatgtcttaacacttacaatgcctctgttttgctctcaaaaatatagctttttccaatcaaaagctacttggttttagactacttttccaaaattaaatccacatgtttcttaattttctgtttcagtccagactctagaggtgaattatcccagaacctactttatatgataattgtataaccattgatccactggtaagacagccatagagtaagaaaaaaaaaattttattagtgtttctttagtgatggtttttatgacagatttcctttctctttcacctgaatcttgctgactccaaactgctaccctctaggtcggacacctccttttttcatacatttccaggttgaccatctccttctctttttttctttagaaatgttaatgtcatcatttaagctggcgtcaaactgtgcaggcatttctcttactttgggaaatattttgtcttttaccattaggtgcttatttcattacgcatactgtaggcttctggaaataccttactttcattcatgataattattgataagaggtaaagggggcagaaagtctcccagataaattcacgttattcaaaactctacatttgctcaatcctgacatcgttgtgactgtgatcccatcaaactacaaataatcaaagaacaggttggctgaagctaattctgaaagaacttgagccaacaagcaatttttcataagtgaaactggatttccttttagagactgtgcttcggacaaaagctcttgcgtcctaaaacctaatccccaacttaaacatatagaaaaacgtcagttttctcatggggtcatcctattgtgattctttcaggtagatacgttcatcttgtcccttcaccttaactcggtttatttcccatattggattccactgatttttatgttgcaaatcgctatgctctatcttagtttctgataaatgaaactactggcaatttctgagaagtcccatttcatcatgctaaatctgacttattcataatattagatgtgtgactctttatttaaactttattggccttccatgctaactccagtctttcatttgatctttagcttcctttggtttcttttagaagggaggagcttcctgtttatacataaacatttaagccatgggcatctttctagcacaaaaacatcagctcaatgacctaaaagtatcacatacccaggcgaacccatgttcaagtcagttgcctctctgaagtgatttcaaagtgattttattttaagtacaaatagaatactagagtgacaaaaacatattcttttttaaaaaaaggtagtgaaatgccagaggagataactctcctaagaaataaaggaaaagaaaaaagttgaattagccattttaagattcaacagcagctgtattcttctttgatgcattgcatgtattaggacaaaagaaaactatatttgcttttggcatggcatatagctgtgctttgacatttaaatcccaaggaaggcttagtgcattaaagtaatgtcagaaaaacagttatatgtttgaagataagcagaaaggaaatagataaatagttttaacatgtagctaaatcaactacggagagatttaaataagccaatcgattttatttcttgcttttgatatcatattacctgcaaaataaaaataagagcaattgattttaaaacatttaaaatatctttcttaacaagtgctttcttcttaaaataattgtttttgtcaattacttgaatacattgcagttacgatttcacactaagaattcatttaactgctctcccctaaaccaagattacagactcatggacatgtaccattctttttgtaaaatattgggactgatacaacttaatgaaggggaagttggagcttgtaggacactatccttcatttgctatatgctccctaacatgctgtgtgggagtcagttgttcattcctgaaaatgcatatgcaagtcatacttgttactgtaataacatggtttaattaagtactaagtacattttcaaatgagcagagacagaaaaaagtttctggtaaaatcaaatgtaaaagttttagaaagacaagtggctcaaaacaaacacaaaaccataagtttatgtgtgggcctagacaactgtaaacatttgcagagattcataaagcccaaggtgaactcactgaaattcattggcgattttagttttcgctgcacttgaaaccaaaactgaaaaatgaaggtgatactatatggaaatggtttgataaaaaggccggtggattgaactacagacttcaaataagtcttcaaaaaagtctttgggtgaactcacacccaaaggccccagagtaattccctctaacaacgagtcattgaggtgacataatgtaggttttcagttaaattaaaatggttaaggtgtgtatctttttaatgacatttctttactggatttcattaaacccaacatattgaagacttgtatcattccccaatctgaataaaaggagagttcattatttctttttgctttctctttttgaggagtctttgcattccaaatacagagaaaaaagaaaaggaaaggagaggagaggaggggaggaaggacaatctgttacatcacattgttatctggtttattagtataagactcttttactttcattaaatgtcaggagtaaaaatttacaatggtatttattatagcatttgaaaataacattttgtttgaatttttttctttggtatttaaatgatctataagctgaaaagaagaggagtcatagatttttctatgccaagaaaaaaacagttttaaaaagatgaagttgtcattttcattttgtttgattaaaaacacatatttccatttcctctttgtattgttgtatctatactgcccaaaaactagttttaagagggcaacaagcttagtttttcagatagcattgtctaaaattctcatggcacccattgctatattagagataagtactttgttgtctttgcctatgaattcattgaggaatattagagtctgaatcttgttttgtttaccaaatcctgcttacatcaaaaagaatgttacatgagtaagaaaggaatgcagatggaaggggtgaggagtatgtgtgtgtttatttgaaatggttttgaaaaatgagtctgtaataaattttaacaaattacggtatctgaaaagggtgtcttaatcagtaaacaggttgatttaaatagaccattatctacaattgtgatcagggtaaaaccactaagtaccatacaacatttgtgtatagcattaactttgtttgccttcaacgagtcgcagctgttatacttttactgtgatagtttcatgatttttgcttctttggcatagtcccagacaggcttcatcaacaagaaacttatcttcatgaacacacttcagtgaagacccccccctctgggaaattagacatgacataaaagtgcattgcttttttaaaacacttcaggcatttgaaaattacaagagaaattttcaagtggcacttcctaagttagaaataccatacacataaggccgggtgcagtggctcacgcctgtgatcccagcactttgggaggccgaggcgggcagatcacgaggtcaggagatcgagaccatcctggctaacatggtgaaaccccgtctctcctaaaaatacaaaaaattagccgggcgtggtggcgggcgcctgtagtcccagctactcgggaggctgaggcagaagaatggcgtgaacccgggaggtggaggttgcagtgagccgagatcatgccactgcactccagcctgggcaacagagcgagactccctctcaaaaaaaaaaaaaaaaaaaaaaaaaaaaaaaaaaaaagaaataccatacacatgaaggcaagtttctctcacatagttattataggacacttgttaatctcctatgaaggtcaaggccactggtactaaactacacaatgagaaaaccaaaagttacaggataggatctcttctcccagaacaggtactgatgtagcctagagacagtaaacattcacaagaaatgttaaaactatgttaagaagcatgtaagcatttgcttcttaattgttacagataatgatttctatagaaaattaataagaggaataaaaccactatcagctgcgtggttaatgaaaaccgcataaaagaagtaggttgaacttcagaggagcattagcctcggatgatgagaaagaaaggcaggaacatgccaggcaaaatcagaggcatgagcagaagtgtggaggcacagataaccatgtcccatttctgaaacagtcaagagatcatttaaactacagcaacatgtttgtataggagagtcatggaaaagttgaaaagatctatttttcatttattcatttatccattcattctacaatgtttcattgattgcataccatgtgtccaaggacagttttagccttgaagaataatttgtaaacttatggattctactttcttactgatttatgaaagagttagacatcagaaaaagcacacacacacacataccccatggaattgttggaaaaaaacacacaaacgccaaaatcaaagtatgcacaagggatcttgtgcctaattctccctgggatctaggttgggatggagatggcagaggagcagttcaaggcacatgctataggcattccagggagctggaaagtacatgggtgtgaatgacttgagtacgtgcagtaaactcaaggatttacagtaggttctttcacagactggcagctactagtgagggaagatttgaagctaggaatttagggggatcctaatgaaagaggaccttgcggccgggtgtggtggctcacgcctctaatcccggcactttgggaggctgacgcgggcggatcacgaggtcaggagatcgagaccatcctggctaacacggtgaaaccctgtctctaaaaaatataaaaaattagccaggcgtggtggcgggcgcctgtagtcccagctactcgggaggctgaggcaggagaatggtgtgaacccgggaggcggagcttgcagtgagcgaagattgtgccactgcactccagcctgggcgacagagcgagactccatctcaataataataaaaaaaagaggacgttgcattactagaaagactgtaatttatcctttgagcaatacgcagccattgagggattttcaggaaaatcaagttttgcatgactaacacttgttctgattacctgggcagaggtgatgagaaatgaattactgcagtagaaccaggtgaaaaaggaaatatccaaggtatttaggagttggactgaggagagagggctcattagatgtggaaaccggaaaaggtattggctagaaagagaaactggtttcagagtaagaaaaggctttaatgaaagattgttatattcactagtctccccaaacaatgtcttaactgactatttgtttagtagtgggtctaccggttagggtaagattttactgggatctggaagatggtgaaaaccagtagcagcaattgagcaatagagagtggtaaaagagaaaattaaaatagaggcagaattgagatagaagtgcaggtacacttagaacgatctgatctttgacaaagctgacaaatataagcaatggaaaaaggaatccctattcaataaatggtgctgggataactggctagccatatgcagaaaattaaaactggaccccttccttacacaatatacaaaaattaactcaagatagattaaagaattaaatgtaaaacccaaaactataaacactttgcaatacaacatatgcagtaccattcaggacataggcatgggcaaaggtttcatgacgaagacacaaaagcaattgcaacacaagcaaaatttgacaaacatgatgaaattaaactaaggatcctctgcacagcaaaagaaactatcatcagagtgaacagacaagctacagaatgggagaaaatttttgcaaactatgcatctgacaaaagtctaatatccagcatctaataggaactgaaacaaatttacaagaagaaacacaatcccactaaaaagtgggcaaaggacgtgaacagacacttttcacaagaagacatacttgagatgaaccatcatgaaaaaaaaaaaaacctcaacatcactgatcattagagaaatgcaaatcaaaaccacaataagataccatctcaggctagtcaaaatggctattattaaaacgtcagaaaataacaaatactggcaatgctttgggaaaaaaaggaatgcttatacactaccggtggaaatgtaaattagttcaaccattgtggaatacaatgtggtaattcctcaaagatctaaagacagaaataccgtttgattcagccatcccattactgggtatgtaaccaaagaatataaatcattctattagaaagacaatccatgcagacattcattgcagccctattcacaatagcaaagacatggaatcaacctaaatgcccatcagtgataaaatgtggtacatatacaccatggaatactatgcagccataacaaataataagattatatctcttgtgggaacatgaatggagctggaggccattatccttagcaaactaacacaggaacagaaaaccaaatgtcacatgttctcacttataagtgggagctaactaatgagaacacatggacacatagaggggaaaaccacacactggggcctgtcagagagtgaaggatgggaggagggagaggatcaggaaaaataactaatgggtactaggctcattacctaggtgatgaaataatctgtacaacaaacacccatgacactagtttacctgtgtaacaaacctgcacatgagcacctgaacttaaagttaaaacaaaacaaaaacaaccacaaagaaatgcaggtagtgagatactggattaaaaaggaaagcagaagatgtgcagagctatactctctaatactgcagccactagccatatgtggctatttcacacttaaaaagcagctgttctaactgagacgtgatgttagtgtaaaatgcacaacagattgtgaatacttcatacacacacaggaatataagacagctcattgatcatttttgtattcattttattttgtgttaaataaaatattaatattattgtcacctccataagattttaagctacatatggcatgtggctcacaagttattaatattagtgctgttctggaatctttctctaggtagttccagctggatgctgtattgcaagaatgagtgccctagcttctttgttggtcttgtccacagatgagtaaagagatcctcgcaacttctgataggactcaacaagttgtcctttataactgttttatctcagagacaatgcagatccccagaatgtctgtgaaactggcatcattctgaaatcacagtcccttttcattagttagaagttttcttaagcctaagtgtatttgcaataccatctccagagaatatctttacagacttagaagccagatgtgttggttttctcccagaatattaattccctgttcattaaaaataaaataagaagtattcaatgggaaaaaaaatgtggcctaaattaagatggtattttaattgagcacaagttagaactttcctggctcaaagattaattttttctagtaaagtatctgtcagttacacaactgtgtataattcatcatccttgaagtgaaagtttgggtctcagtaagaaagtgctttcagctgttaggaacagagacccaatcagttttccaggcaaatctgaagtttatttctgcacatgtaagatgtctgaaatagacaattcaggctttgtataatatatctagaaagcgatccgagacccagactcaaacattctgctccagtttccttagctcatggtttctattttcccagtgattaagattgctgctagaactccagaaatttcatctgattttcataaagaaagtaggagggtccaccttccgttttaaaaagccattccagaagttccgtgcaacattttcaatcatatctcattagccagatttaatcacaaccacagagttgcaagatagactgagaattacagtttcattctaggtggtaatatgcctgctaaaactttgaggattatcactaggaaggaagaggaaaatctgtaatgagatagatagcactctctgcccagttgatgtttcgaaagattataaaatataaatagtaaaaaagtgcatgcttccagaaaaaaatatttgatgcagcatttatcttattcaaaccatatattttatatttttcctccaaaaatttaaaatatagttatcaaacttcaggcttagacaatcgacattttagggtattcaagagtgaagatgatccagcctcccttcaaggatttcataagagagtggcagaggtatctagttcttattctgacctcctactcgaaattcatcagtaacttcttattgcccttaagaaaaagacccagatccttaaaagcagtgtattagcctcttgtggtctggcctttgtcttcctttgcagcttcatctcacatcactctcctccatcccctctagccacgctggcctgtgctcagtgcctcagatgttctttcagtggggcccctgcctgtactgatctctgggtctagaattgcttcaccccaccacccatctctgtctctgtctcttgctttcttatccttcatatctcaattcatagataaactccattaggggagccatctcaggatctgtaagactgggttaggcactttttaacctgtttataatcacacattcaagactgtaattacatcttttcttcttctagactttgagcttcccaagaatgggaaacaggcctgagctcatgccccactgtgtctctgtgcctaacacagtgcttgatacgcaatatgttctaaatacattttttatagaatgaatggaaaaatataatagtagcataaaaaaggactatgaaattataaagaaggaaaagaacaattctaaatggagggatttagcaatgctttatgagtgaaatagaattaaaactggtccttccaggacagaaaggctcatatcagataatatagggcaaggctgtcttggaaaaatggactatataaactaaggcatgtgacacagctgaaataagaagttgcccaaaattctcagaatgcctgagaaaacattctaagaatttatgctttagtctgtagtccaaggaattcataaacttttggaatgtgcatacatgtttgtggttaagtgtacacattccagagacactgtcatcacattttgcctgttagaatggaaactcgtgtcaactcattcattcttaaaactctcctaccagtgtcttcccacctatcctcttcgagtcaatggtcagaaaattctagaagtgcatacatcggaaaagagtttactggaaatagttttaaaataatggcttagagtcaaggaatgctctacacccttctactttgccagtgaattgagtaagaaaacagctggtttctatcgaaaaatttactgtagagtgttttcttcatggagaaactagattttggatgtcacgagggaatggaagcgttggagaaaagtattcaaggtaaaacagtagcttgttccaacacaacaggctttcccctaagacaacactctctaaagaagtcctggaaaggaaaatgagaatgtggtagggcggttgatacagatcagtaaggaaatgaaagtccaaaagttatttacatggtaaacatctgtgccaagaggagtactctcaataacagggattagtgagagagcagttggctggagatggaagctcaggcaggtgagcgtggggtgcagagaaaaaaaaatgtatgaagaataaatcaatatttttttgagaatgagtattttagttcagtacttctcaatattttaggtgcatacagatcatctgggatcttgtcaaaacaggtttggctcagtgtgattgaagagaacactgggattctgcttttctaacaagcttcaaaatgctgttgctgcagctgcttgtgggccacatcttgaacacagcagagctccagcctctgcatctgggcccccagatacatgaaaaatgcagctcaggtagtgacaaaaaagatcagtgatgtgggcctttggtgtgttatggtttataaaacagaaaagcctattttcttttcccttaccatttccagggaaaataaagtaatggggatgatgtagaaatcacctgaaatagtctggcacagtgcttgcaaggctgtaggaaccaactgaagtttgctcaaagctttatgtacttctgtttctcacttgtatcacctgttatctttggagtgtcatgttttacgttacatattagcaatggaaacagaaaatggtttttcaatcactcactgtgtctatgcatagaaaggctgggcgcagtggctcacacctgtaatcccagcactttgggaggccaaggcaggccgatcgcttgcgatcaggagttcgagaccagcttggccaacatgctgaaacccgtgtctgctaaaaatataaagattagctgggctctgtggcaggtgactgtgatcccagctactcaggaggctgaggcaggagaattgcttgtacctgggaggcaggggctgcaatgagctgagactgtggtattgcactccagtctgggcaacagagcaagagtctgtctcaaaaacattaaaaaaaaaaaaaaaaaaaggatgccaacaatataatataacaaaatatctaaatgtgtagttgtttgatacttattgactgacttattttttgattcactatcagcagctttttcttaatttggctctttcattgcaaggaactgtaagtcagagttcttagttatgaataaacaaactaaaaagacagatgcaataaaattcaaatgaatttaagaaatggattctcccaggtgcggtggctcacgcctgtaatcccagcactttgggaggccaaggtgggcggatcacgaggtcaggagatcgagactatcctggctaacaaggtgaaaccccgtctctactaaaaatacaaaaaattagctgggcgaggtggtgggcgcctgtagtcccagctacgcgggaggctgaggcaggagaatggcgtgaaccttggggggtggagcctgcagtgagccgagatcgcgccactgcactccagcctgggtgaaagagagagactccttctcaaaaaaaaaaaaaaaaaaaaaagaaaagaaaaaaaagaaatggattctctatctgagaactgatagaaaacagaacccaaagagggcaagacaaagtcaaggctctatcacctgtcaccagaacacaatgttctagactcccctcagccatacagaataatccctaaagccctacacctttgtatacctccctcaaaatgtggtttcaggtgggagcatacaattgcttatgctgacacctctttcagagctctcacccttattctcccaccttggtctgtcttattaaagggtgctgccctgccttccacttaatttgaaatttctttctaatagacatgtcttctacagagatcagttcaagctagtccaattgataaggttaggctttgtgtccctacccaaatctcatcttgaattgtcatccccataatccccacgtgtcaagggagagaccaggtggaggtaattgaatcatgggcatggtttcccccatgctgttcttgatagtgagctctcacgagatctgatgactttttaagcggctcttcttctttcactcatcacttctccttcctgccgccttctgaagaaagtgccttgcttccccttcaccttcggccatgattgtgtttcctgaggtctccctagccatgctgaactgtgagtcaattacacctctttcctttataaattacccagtctcaggtagttttttatagcagtaaaaaaatggaccaatacaccaagtaagaacaacttgtaaagctacacatggaatgattaggaaaaaaaatgtgaaaattcataacaagggagcataaccattgaatgaccatatcatttgccgttaaaccgggccttttttaatcatggaaggagtgtaacaagtgtgaactgattctacaccggacaggccaaggtgcatggtcaccttacctaataagtgtgagccctcctgtggcttatactagagaaacttcttgattcaatagagctttaaaggtatgcattcatggatctccacccaaacgccctgcattaaaatatctgagctgtattgcacttatctgtttcctttaatcccaaaccaactgaatttctctgcttatagtttttgcagtcttataaattctgtgatgggcatatgttgcttactttctcagcaatgacttcctgtgggtgattcacaccctatttctttccatcagcctctgttttctgtttgggttcagagaagttgatttgtcttcaattacaatcagtttctcaacctgtggccacagggactatttcaagaacattcccatgattaaggccacacagcctgaaactcatgcgtgatcatgagcagcttggccttggactgaagacaaagtggagaacacaatcagaaagagaaataaaccacaatcttggtggctgtcaagccactggatcaagtctacacccaactccacattgagccaataaagttcctttttttgtgagtgcagacttagttgggtttttggtttacagccgaaaccatcagaaccaatacaactccagtgttcacagtgccccatattttgtcctgagatccctccacagtcccctttgtttcagaatggccaactgttttcatatcttatttcaaatttaagaaaggaaattcgttggctcgatttatcttttatctccagaatctagtaatatgttgctcatcaacatatggttcggctgctaggtcaagtgcccagccataaaccagcctctggggctggatgggagggctgctgttcttctctgaagacctgtatccattttcctgccttgcagataccagtaggaccagtattaggacatctgcataagatttaattttagaggccgtgtgcagtggctcagtaatcctagcactttgggaggccaaggcaggcagatcacctgagttcaggagtttgagaccagactggccaacatggtgaaaccccatctctactaaaaatacaaaaattagcctggcatagtggtgtgcacctataatcccagctactcaggaggctgaggcagcagaattgcttgaacccaagaggcagaggttgcagtgagccgagattgcgccactgcactccagcctaagcgacagagcaagactctggtctcaaaaaaaaaaaaaaaaagattcaattttatgctgcatattcattatcatctttgccttttgactgtatcatctcaaccacggttatgtatcacagaggcttagaatattataactcattgttttagtttatccaggctgctataacagaataccatagactagctcataaacgatagaaatttatttctcgcagttgtggaggctgggaagcctgagttgaaagcgctggcagatctggcatctggtgaaggcttgcttcccaggtcatggatggccatcttcttgcagtgttctcacatgctaggcaggcaaaggagctctctggaatttctttttttaaataacagcattaatcctattcgtgaaagtggggccctcctaaaagccccatctcctaataccatcacactggggattgggtttcaatatatgaattttggcggggacataaacattcagtctctaacattcaccttttgcacattagagaacgtctacaaagaaaacgttaaattttagttttggaaaacttcctttccttttctcatttttattctttcctttagcaatgtaattattattgtatggaacccgtatctgatgatggtgagtttaaatggatcaaaattattgttccttaaaagcaacaccaaaattttataagatatgctgcatactaattaaagctcaaggagccccaggcaagaaagaaagataagccattgcttaagttatgcaaaagtgtattaaatatttgagattaattaaaatctagagaaagttttttaagagttccatttaaagtttgcataaaagttcacgcaattattataaaacatttgctatcaaactggtttgatgaataagggaagtcaattagtaacatagtgaaataagagttaattcatgtttctctaggtaatttctttcctttgttctgtaaaagtcatttataactacataatagtacaatcatacaataacaattatatgccaatacccactgttttacaaagcgatggaaagcatagttctatggtacttacttattttctaagtgaataatattcttcttaaacccatcctgaaaatttctacaataaaagattcattgatggaaagtcaaaaagtttgatttctggtggtttttgttgttcataaaggaaatgaaagcacagcttttactgagcaggtggttcctggtgtgtgagcccttaatggaagaatgatctgtgtcaacaggactgggaaagttctgattctgacttctgaaattgacctttattctccatttcagaacacataagccacggtatcccttttattatatagacatcgatatgaagagaacaaataaagtcacaccaagaatgtctgggcttgttcatcttacacaatttattatttttgaggctatcacttagtggggaaaaattttcctgcaccctaatgtaaaattgcaaatgtgtttccccagagtaatgatagtctaaaaatgagggacagtgagtcgtaattaggattaggcttgggaaacaagttcacttatattatagcatgttgctatggcaaaaggaaaaatatggtctgattttcaaacaattgactggcaaatgggcttatcccatgccatctattaataatcaatacagcttattcaaaggacaaaagtcactttctctataaaagaaagtgggacaaatttaacaacggtctactttactgcaagttaggatagaatctagaggtaagtaaaaagctttaggtaatgtcttcaagcctcgaagcaccagctttattctcaccggggaacaaagtctaaagaaactttcatgaccactgtgtctgataaagaatgaaaattctgctgaactcagtggtgaacgtactcattattaaacggactcagaaatactgtggttcaaagcatgcttcctaaaaataaaaccaatataatctatgaagaaagatttccaatgccaaaaaaatttcaatgagcattcaaaggttgaatccatagccaccacatgaaatatgatataagcaagtcagtaagagccactgaagtgtacggtttcagagtgaatgtttgtttcccagggaggagaatccaggccttcctctcttctctctatgccctgcctgccctgctgtcttccagcctgcaggcaagttccctgttgctttcaagctggagcttggcaccacaggagtccctgcttgccctctcattcccaccaccaaagcctcctggcagcatttttagctgtgtgggccttatattcaacaacaaagatgaagatatatggctaggagtataggagaaattatgttcttgatatttatttggaatattaaaaagaacaaaaaaatgagctctatgttctacatcacatcatactgtctagcaagatgccttatttttatttaataatttcatttataaattgcctctttacaattatgattgaagactgagaccaagggaaaaagaaggcagaagttacaatatttcctgtgcctgagcttaaattttggcttccagtttcttggaagctttcttacagggttagcatacatctcagctggagtttcccatttagattatctaccagtgtttttgtaggtgttggcttagtatattaccaacattactgcatcaaatttgaaaataattcttcttgatctggtcccagatttgatccaagaagcacatgagtctgcaggatgtattcagactcaaagttctagaatagttatagattgtgatctctccaaaactctctaatctgggtgtcattaggtatttcttgagtctttgctatgccacttgctgtgctgggtggatcactagcagcagtcaaatttccttcccgacccagacatcttatcaaataaagcttagaggcagagattccactagacacacagggccacgagttaatctttgtgaataatttcattgttaactattgggacaaggtacaaaaaacaaaaacagaaacttgctaatggaatacactttctaagattataaattgcaccatttgccaaatgtatactgttagaaatgagagcaataatttgcacttactgtaagtccagcatacggagagggtcatatgttgaaatgccatctctattgaggtgtcataaaaaatatttcctccagcagcacccagtcattctaaggtattaggtataatttttaaagtattatttggtgttctgaataccaaaaaagtacatcttgagtaccacaattggtgacattaaagttaattattttcattaaatattgcagtgctgtcatgaggaatgaaacagaagagcaaaatgaggttagagatgggatgtgttcaacattgctccccaagtatttccaaataattaatgtattcattgaatgatatttattgagggtcagaaaaagtgccatggtatttgatacagcaaaagatcacatttatgatttcattctgtcactttctgcaacaggtagcatccccttgccagcaccaaggcagggttgcatatttgaaagttactccctcaaaaaattcatttaaataaatagatttttttaaagaaattatgaaatactaacgttgcattcagttagtgattttatatggtgtaggattgacattaaaaaatacttgtcattaattttactctgtattaatgttatattaataatttctgaaagtaaccaaccattctaactgcagaacccagctgtggacatgagtttctaggggaggactctgaaattgtgtcaatgtttgtaatctagtcctcggagaatacaaaatttttgacaaagaaggaggttaaggagtgttttctttttgatgttcacctccaaaggaggatcataaagaagtaattcttgaaaagtattgcaatgcagtcttcacaaaaaaagcttatccctgaagtacagaaacacacttaaaaggaacatagatgaaatctctattcaaagagtttgggtttgacctttatgcattacatattatcactgttttgaattaagctattactgtctcattgttattttagcagctaacaaatgagtaggtgttctgaaaagcagtgtttagcatcatgtaaaatgttattttaaaagttcatttccactgagaggattttctaataaccacgtttctgctagtaactcagccatatatatataaaaatattgaaattagagaaatagaaactactgctgtgatataatttgatagaaaaatattaatagatggtagacattgtagagtttctttccatgtagaaatgttacattggaggattaacagcacttttattcattcaaaatagtcacagcatccattctattttaaaatgttaaaatacaaatacaattaactaatgtatttatccacattatctaaattacacaaataaaatatatatttaatattattaaaatatctagggatctgatatgtcctggtatgtctatctaatctgtgtgtgtgtgtgtgtgtgtgtgtgtgtatgctgagatatatatacataaagatatatacatctatagatattgatatagtttggatatttttccccacccaaatctcatgttaaaatgttatcaatggggcctggtaggaggtgtttgggtcacgggggtggatcccttgtcaatggctagggccattcccttggtaatgaatgagctctcactctgtgttcacttgagacctggtcatttagaggtgtgtggcactgccccctcaactctctctcctgctcccattcttgccctgtgagatgcttgctccctcttggcctttttccataagtaaagctccttgaaacctccccagaagttgagcagatgccgtcaacatgtttcttgtacagcctatagaccgtgagccaattaaatctcttttctgaataaattaccaagtcttaggcatttctttatagcaattcgagaatggcctaatagtgtgtgtgtgtgtaactacagtatatatacagtatatatatatatagtatgtatatatacagtatatatatatagtatgtatatatacagtatatatatagtatgtatatatacactatatagtatgtatatatacacaatatatatactgtatatatagtgtgtatatagtatactcatacacacaatatatactgtatatatacacacacactgagcatatattcatccacacatccagtcctctcagccatggctctaccctgaatttatacactatgtatgtgtatatatacggtatatacattgtgtatgtatatatacatactatatatgtaatctgatatatgtgtaactactgattatataattcataatatttaaattcccttatgcaattttttactctgctattatcctaaatttataatcattccataatgaagcaaataagcctatgcctcattcctggggtgtttagaccctgtttagatcctgacagatgcaatgtcttcaattaagttcttttacacactgaagggatagttcaggaggatcattaatactgataccatctaagcagaaaatagtcacagataattaactaaacttaatcgtactttagtatggataccttctttacatcgaggatcaattttaagttcactgaaatggatgtggtaaacatatcagagttacctcctgtggcattatatttgtagtaaatgtagtttttcaaaaccctttaaatacttgaacatatttttaagctcacaaaatactttgttattattgctttggagccaaattttccaattgcaaatatctaatgataattttttatatataactttactgcatacaagttggcaaaagaaaaaaacaacaacaaaattttaacttctttgtaagaaatcaattgtagataatgaatgatcgagctacttttctgaccagtcaagaagtgtgaacagatgctggaactgaatagcagttgctaagactttgcaggccgaccaccaccaggctctaagtgtcctatacaacaggtggagatataaggacttcttttaattgcaagacacatgatgaaaaataaaaggcacattctgtccacccttaaagttctttccctaattccctaaattaggttcttgtgaaatacctgtagttgttatgaaagtcatagaatttaatttataggtgtctcttaattaagttaggttagctagctgatgtttgtttcaaggatcatggaatcggccatgcagtaatttatatgcccaaagaaaaacctgattaaaatgcttaatatgatgaacagaccttgaataatcttcataattatagagtacacactacttacatttttgaagtggttccaaaaccatttgtccactgtgtgtatcttcaaggaataaacaattcactaaacctcctctctatggaaatgtatagacccttggcccatcacctcctcatccttgcagattttaatgcctggttcactgctccatgatccaataaccctcttgtagtattctttggagttttcaatatccatgtagaccattctttcaatgaacctatctctgaaatattggccctcctccattgataccatcctccagcatgtcttaatcactcagttccaagatcatctcctggaactcaacataatcattaactacaactactccataattgtgcttctcatttcctgcagctctctaaattcactgttaacaaaagttacatctatgtcttgttcactcatgtgctcacttcccttccacttagctttagtcccacattctatcattatgactcccttgcaatcacctttgatttctttgctcctctctctttcctaacacttgctcagaaaaacagcaatgctgattaagtgaaacttgtgcttcagcatctccctggggggaagaatggaagaatgtggctggggaaaaccacacacctatgctgattggtctcactttaaattcatagctcctaaccttcagtgggaccctggtgttgcaatcctacttcattccgctgctccatttcctcctctcccccaataccttcaatctacccatttcttcttcagccaattacatttcctagttgtttaaaatacctacttattttcttgttctcttttaaagtaacaatcatcattgctttcactttcttttgcctcattctttttgaacctatttcaaaaagactttcatccccaccatatcagtccctgtcaagtcatcagcaatctgcatgctgctaaatctagtggaaaattcccaatccttaccttcagcagcatttgatacaaatcattccgtctttcttgaaacattttcttgtagttttcttagtatttctctctctctcttgcttctcctcctactaaacctactgttccttctcatttagatgtctcctcgattttctcatttccaaacagtggagagccccaggtttcagtccttggacttatactgcttcctgtctacacctactccctaggagatctcattcaagttccatattccatctgtatgttgacttatctctctagctatatcctctattgagttttagaccttacacacaactgcctgctcccagtcagcacagtctaacaaacatctcaaactctttgtttctaataccaaactaccattaaaaataaatgtttctctctcagttttctccatgcaagtaaatgtcaactccattcatctattcactcaaaccaaaaaccttagcttcatctttcactcttccttttgaccttcacatccagtccaacctatcaggaatggctctaccctcaatttatacccagaatccagtcatttatcttcatctccattgtatccacttctaggccacctgttggatggactgctgcaataaccttccagttgatcttcctgctttcacccatgccctgtccccatggtctaattttagcacagcagccagagtgatacatttcaatgagatgttttcatccccatcccattcaatgtaaaagccaaaggttttgcaagtggaattttttttttttttagaaattgttttcgttttcagatgatgagaataatgcatgttcaatagaagtgtttctaaacgacaaaaaaaaaaaattgttattctccttcttgttccacacaatgaccattgcctttaaaaaaaaaaaaatcactgttcaggattggaattagctaggtaggtatgaaaaatagagaggatttaagttgtatttgcaatattaccatggtgctttacttacagcctctctcattgtggtaaagaaagactgctccttcatgttacagctggtttatatgtaattattttttttaaatcctgtaagaaaactcactcaactctcctgaaaaaccccaaagtgcagagacaaaatattccataaatatctttagaaactccctgatctagcatccagcccaacctcacaatcatctatttgctctccaccccattgtcaaaccaagccatgtggaatttaatatggctacctaacttctggatctttctctgataacaattctcatttttgtatctgttgataaagaatgcttctactgaatccttcgtccatatacccaaggaagggtaaatggaaaatatcgaagagatgaatttttttgaacttcttgtcagcattgttaattgaagatgtattttcctattgatttgatcatgtgttacttgattttgttctgattctcagtttaacacggtatttccatctgaagcttctgatgcatacttcatttattctaacgttaaacagaattttaaagctcaaaaacttcaatgttaattgactgaaaatgctaatctataaattcattttattgtagaaatcttataaggatatgttgtatagttctatgtcatttcccatgaatttaagatttagagattaaaaaatcagtaatttgtaaatggtaattttatcttgagcagaattctatgcctgtaaaccaagattctgtatcagtcagtaatagggctgaatatgtgacgatgtgtacacagggagggtgtactttacctttaagctggccaaatgtgcttttttatttttttaaataaaaaagagcctaaatagaaatcttatctgtaaatattcattggtcctaattatcttttatagagttgcttttaccttactcagttgtgatttcattattaaaacttcaagtcacagaccaactaagtgcttctttggtgtgtgtgtttgtttgtatcatggatatccagaacatttgtcattggatatgatcattataaaactcttgaacatgacttctctgaccgtggatctcaggagctgtacttgaagtttcaaatcagctggcagtcaaaatgtttaataattcctttccaccgagcaaagatttctttcaatttctattctaggagtttgtactttttctaatgtatcctgcacaactaggtccatcaagataaatttctgtgcttaatgtcatgaatagaacagaaaatatgttaaaaagtgatggctccaaaggcatagcattttaatctaaaacatctgtgatttttcttgttcacagaatgtctgcctccctcattaatctgtcaggttttaaaagatctgggaatgaatctgctttgtttaccactatgtcttcagtgtctcacctggggaaaagtttgtgatagatttttagggaataaattagtttttgttggatggatggatggatggatggatgaatactcttatactcatcctgtaaatataagtgacataaaaatcatcacaaatagatgtattgccaggtggtttttgataatcaactgtctcagtccatttgtgttgttataacaaaataccacagactaggtaatttataaacaatagaaatatatttatcatggttctggaggatgggaagtccaaaatcgaggcaccagcaggattggtgtctgatggggattgctcttcttccaagatggtgcctcattgctacatccttcagaggagaagaatgcagtctcctcacatggtgaaaaggatggcctggagaaagagagtgttccatgtattcttgaacccttttataaggatgttagtcccattcagggccctcatgctgtaatcacttcccaaaagtcacacttcttaatacagttgcattggggattaagtttcaacatgaattttggagaagccaccatcattcaaaccactgcaaaacagaaatcagtcttacctggaagtatgtggaatggctttattgaatatgggttctttcaacagatagagataagataaggtcattgaacaatatgattcttatcagagcaaacagaggcaacggtgactgagcatggagatatgtgagaaagtttaacaatagtttggataaaatgtagaaataaaaccaggaggcccccgtcatggagagtttttgaatgttaagtcagagattgggtgttttagtgggtagataaccaatagggaacacaacaaggagtacataaactacatcatattcacattgaaaactgagagaattgaacggcagccacaatgaagtacatgaagagaagtactaactaaaaatagatatttttcagagatgcttttaccatttacaaatgcaggtacatgcactctctgcctgttattcattttccaagagggctccaggcaatcaacctttatcttttttgggacttcaaaagaggacaatgttaaagctgcattagacataccccaactgtttgtttatgatggcttttactgtttatatgcaaacctaaatatgtaaatcttagaaaagaatgctaaaagaaagggtataaggcaaggaaaatctggcaaatttttaaattttaggtttcagttaaattaaaaaaatagtaacattatctttcaaacgtgaaaatttcagttgcaaagaatagtacaaataaatcaaagtaaatgtagatttagttggctcatattaaaagaaatactaatcagtaacagtacagcttgatttgtcattggatgaatgatgaactggggaaattgaggcaatcacaaatagtctagcttcagtttacctcctcatgaagacttctcagaatactcaaacctacaatgaatcctcagcactttgcctaaggcttgagccttataacctactcaataaatatttgctaaatgactttgcccttactaactttgcagccttttttttcagttagtaataaaactactttgtattgttatttgatatcttcatttttcatctagacagtgtaagatgaaggccctctctcacacttttctttcatctcatacttctcatttaatgattaaaattggcaatacaattagcgttacataaattgcattgaattagattgctactgtcttctaccctagaatggaggattcaatttatagttgacctttcttctgaagcttaattgttgtttattattcagtttgttctacggaagttaccactttcttttacataggatttagagtgtatttataagttggattctctgcttttggaacttccattattcacttaaaacagattcatgctttagaaagataaggagacaagaggaagaatccccctgtgttttatgtcctacttttgtaatacctgctcttctaaggttgtgattttgttgctgttgttttatttcagtagttttttgggaacaggtggtgtttggttacatggaaaagatatttaggggtaatttctgacatttatgtgcacctatcacctgagcagagtacagtacacccagtgtgtagttttttctctctcatccccctcccactctttcccgattctccaaagcccattataatattcttaagtctttgcatcctcatagcttagctcctgtttataagtgagaatatacaatgtttgatttttctattccagaattactttacttagaatgttggcctccatctccatccagatttctgtgaatgccattatttcattcatttgtatgtctgagtagtattccatggtgtgtgtttgtgtatatatatatatatatatacaccacattttgtttatccacttgttggtcaatggatatttagtcttccttatttttgcaattgcagattgtcattttttgatttttttaaattatggccattcttgcaggagtaaggtggtatattattgtggttttggtatgcatttccctgataattagtgatattgagcaagttttcatatatttgttggccatttgtatatcttcttttgagaattgtgtattcatgtccttagtccactttttgatgagattatttgtttttttcttgttgatttgagttccttgtaggttctgtcagatgcattgtttgtgaagcttttctcccactctgtgggttgtctatttactctgctgataatttcttttgctgtgcaaaagctttttagtttaattagatcccatttgtttatctttgtttttgttgcatttgcttttggttcttggtcatgatctttttgcctaagctatgtctagaagagttttttctgatgttatcttctagaatttttatcgtttcacatcttaaagtctttgatccatcttgagttgatttttgtataaagtgagagatgaggatccagtttcatttttctatatatggcttaccaatttttccagcaccatttgtttaataaggtatcctctccccactttatgtttttgtcagcttggtcaaagatcagttggctgtaaatatttggctttttttctgggttctctattctgttccattggtgtacatccttgtttttataccagtaccttgctgttttggtaactatagccttgtagtatagtttgaagttgggtaatgtgatgcttccatatttgttctttttgcttagtcttgctttggctatgtggggtcttttttggtttcatattaattttaggattgtttgacttagttgtatatgctagatgtcaaagcaggaaatagatatttggtgtcagaaacatgaatctatttattcttgtgttctcatcccattttccctctcaactcaccatgagccaaatacaattattttctaagtaaacattttgacaaatgcattatatatttagctagaagaagtttctgccttctatgaggtcacagcctaggaagaaagagatttgataatgacccagttaattggcttgattacaaaattttggcttttagttagcagaattcctatttaactggtttttctaaccatctcaggattaacccatctgttcagtgaagatacttagagaaacctgtattctaagaggttattcaaaagtattctcagaggtacatgtgcatatatcttttgccagtacaagctagcaatccaatgggaagatgtttacctgaaaaataaagaggaaaactaatcccctcagcaagtgtttatcaactgtctttgccaggcaccacccaccagtgctctacatgtgatgtgagcatgccctgaaggagatcatagtctagtgcagcaattaaacagtaaagaaataattacagtacattatgatgagtccaactaggacacagaggaggagggagcattatagggtgcagagaaacattcccagagaactcagagtaggtaagatacatgggttgaaggagccgggcacagtggctcacacctgtaaccgcagcactttgggaggccaaagtgggtggatcacgaggtcaggagatcgagaccatcctggctaacacagtgagacaccgtctctactgaaaatacaaaaaattagccgggcctagtctcagctactcgggaggctgaggcaggagaatggcgtgaacctgagaggcggagcttgcagtaagccgagatcacgcccctcctgcactccaggctgggcgacagagtgagactccatctcaaaaaaaaaaaaaaagatacatgggatgaagggaacagcatgggcaacagaaggttaggagaagcgcaggtcatatggtatgactggcttgttgaattcatgattaggttggtttgagcaattgaaaagtgattaatgtcaaccacttctcatttttcttttatttgataaatatttcttcttacatatctggtcacaaacctttaatgaattccatgtaaaacaatcaataaattttcttattctttccctcctgtgacaatagagatggtgtctctctatctcttttggaacctgtccctttaatagcttctgagaaactttaaactataaacttttccctgtatattgcactgctagcttcaaaccaaatcactgccatcagcctttaaacatacttgagtctgtcccatattaatcttgatttcacacatgtgcccctacaacctctgcttctctttacaataaagacttgtacaagagttgtctctagctccacactgccacttaatcctggaccgctccaatctggctttcacctccatcactcaaccaagacagccctccacaaaggtcactaatgaccgccatgtctcttaataaaatagacttttcagtcctctccttgtttttttctctgggatatgtttggcactgtaaatcagtttatctttcttgaaacaatttcttatgttggtttccatgacatcccactcttgtttttctctatctttttgagttctgcctgcccctgctaatttccttttctaggcttattctcctttacctagttggcaattagaagttcctgaaggctctgcactaagcactttctctttgttctttaacttcttccatggatttgatttctgagtactctaaaaactcccaaatttaattcccagtgaagacttgcctttcagtatatctgggtttgtttaacatgcatctcaaatgcatttcccatttcttatatcctgaaatctgacctgcgccccttgttttctgtgtaggaaaattcacaaatatctatcttgtgcattaggtcaagagaccatggaaaactctttaaattgttaaaacactttagaaccgagtttcttaacctcagccctattgacattttgagctacataatttcctgctgtgggggtctctgtgcattgtgagatgtttggtgagcattcctggcctatacccactagatggcatagcaccccctccagttgtgacaagcaaattgtgtccagacattgccaaatagctcttgggagggataaggaggccaaatcagcccttactgagaatcgcagctttagaaggaagataagagacaaagctgtgttttttaaaaaatagaaatcatgctgaagttttctaccaaggaaattattagttcagttgtatgcccaaagtgtatgacattaagtattatttatcaatatcactacttcccacattagctacatgttgtgagtctcattggttatctaaaatatgcttcacaaaatttgcccagcaaagatttgtccagtgagcaccaagaaaccccatttggaccttgctgatagttccagcatatttccacacaatttctctcctctcatcctcctaatctcccaaccacagtcacagtgttttttgaaatcatatgctcctcctgtcatccagtgtcacccagtgttctttctggaacatcctgcccatttcacttaaccccccttcatcctgcaaacacagcccagacatcacctccctacagaggcctttcctaaaccccaaagccctttaggttttcatgcactcttagagctgtgctgctttccttcactggcacttacctaagtttatgattaaatatgcattcgcatggttatttgaatatttatcacacccaatagcctttaacaaggatgtaacacataagctctaaaacactggtgcctggcagtgacatgtatgattcatttcaaaacagaaaggtagataatcaggcacaaggactgctacctggctcaccagcagcacaggacatttgaaatcagcattgcactaaaaaatgtccttgttatagtggccatccgcagagtgctgaatctttcccctgtgtcgtgacgcctcttttatatcataatttttaaatcttcaaccatcatcctctaaaatactattttttcagagttgttaagttccgtgggcgaataatttgcattcattttaagacaaatttgtttaggcgataaatgcattattatttttctctacctcacaatatgacatggattttcaattgaaaattctgcctgaaactgattggagttgggataaagttgtagacaatctatagtagttcatttggtcacagcgtgtttgctttacttttggatcttgagaagaaaggactgttatctgcagggcactctgggacaacttcttggtgataagagtgaagactcatatttgctttgtaaatcaataaaaaagagacctttcaggcaaaagtgttgatgactgaggaggacaagttgtgaattttatattggaatgtaatgttacctatgaaattttccacctattttaggattttcatattttcagatcaatcaaaatttgttgtgaacaaggtttctcctccgtgtcctacgaactacaaaaaaatgagtgcctgtgggtgttttcaaactgcctgtgggtagacagagctatgttactacctggaactctgtgaatgtctaaaagaaagtcaaaatatcaaaatcgaaaaggaacttattttctttgatatgtcttgttgtatgaccttggtaggaacaatgacaaaattttgacatgttcagatgtcttagaacaatgaaattagtatatattaaaatagcagtgctttgttgtccttttaaataatacatgcattttaaagtattcagaagctttttctactttgtataaataccttatcagtcctctaaaataatccaagcttaataggaaaaaaaatgaaggagctttgttgaggcttactgaatgtcacagagcctgcaaggttagaactgagcatagaaagtgaagaaatatgttcttgatgcctattcaactgggtttcctgttcaaggttatgcactctatttgctaatagttgtagtattctgtaccacaattgctgagattaatatcttgagaaaatattgtaccattccagttaataattatgttgatttctattcttcagtttaaagtagatatatgaaaataggacctagtgtgtgaccactcaaaaaccctattttcctcacgtttgtagtgtatttctaaaggcctctccaggattatttcaaaatcaaaattgaaatattgtctaccaagatattgaattaattatgtatctatttcattttactgtttgaacactcccttctaatttgtatatagagagatagaattgtctagcacttttccgaaggaaaaagaaatcaagaataatatttaaaggctcataatatcttccgtctacatgtattaattgtatatggactttaaacaaatacaattaaggatagtcttgttctgcatataattgatttgcctatgttgatgagatgctgacaaccaggtatgaaagctggttttgcttatctaaaagagtggactaaaagtaagttaagtggtttctttagtgttctgtagctttagttgtacatggagcacctgctcctcttggaagtcacagcactttaagtaagttcgccatggtctgctatgctgcgcagactaagctgtgcagactatgctgcccagactcctcttcctcctctttagactgtggcagtaacctaaaagacttggcctctgtttcaactctcatgccacacatcatcttttgtctttcctgtggttcaggtatttgtgtgtgagggttgaggtgggggtgcaccaaattcatacagatttcctcagtagctttattttctgaatttgaggcaacaggacagtgaaaaatggcgatcgttatattgattcatacaacacagagatctgaaggaagcattttgtacaaaccctgctctgggtaacacaggaaatgccaagattttgaaatgtaactttcttggtcttgaagaccaaattgtgctcagaaaaggcagagtccctataagttttgtcacaataaatgagtagagcccactgcaggttggaaatctacaaatcattgcagggtattattaagataataactgcacgagagccatcacagcagcagaggtaaggatctctgccaagattcaccttagaccggtgattctggaacttgagcaagcctagactcaccaggagggcttgattgctagagtaggagaattttccccgtcttacatataaccaggtgatactgaccacacttggagaatcactgccttaggcattaggatctgagactatatatccatggattgcagcaagaagcagacaaaaacatttcttcatacacaagaatgtttgtgacttagcaaggctgttattggagacctggccattttaggtagttttgtataatttgccttattccatccaatgttctaatttctaatgtttataggctgcaagcctagacgctactgttgtgaaacagttaaacacgttgggtgtggtgccgagctccttcctaggttatcaaatccaagctctgccatttattaattgtgtcattttgaggcaggtatttatattcttagggccatggtgtcttcatctgtagaataggaataatagcacctattgctagtattgctattaggattttcaaaataacacacataatgcattggagaaagtgcctggcaaattataagtatgtaataaaacttatctctctttttactccttatttcttattacagtggttttgtttttcatttcttttattttttggatagttaaaccttataaggatttaaaagtttcatgtgaccattcaaatatcccaatttatcatttaaacgtaaacaacaatggtgccagagtagtcatggggccctctccagcttcatcctacagaggagccccacctgggcaactgaaataagattataagctactagaagaataaagaggtcttatttcattatttaattaagccgctgaatagtttattcttcctaaagcaacatcacatataccaattaggttagatacccttattaactagccagggaaccttctctcttgaaaaacatcaacaagaagtttttgttgttatttttgtcattcttgtttggttcaagaaatataattaaataaatttattccagaaattttaaatttcagttaaaaatttttaatttgatgttatatcagagttatgaaaatcatggctaactataatatggcctgagaaaatccacttatttcaaaagggaataaacagactaaaaaacaataagaaaacaaaaagcagatgagtgtgaaaattacaagataaactcagaatacacctggtcaaagcaaacattacactgggcaaagttacataggcaagagaggctttattcaaaactattgtaacagaagagagaggctgtaactcagcctgagctcaactccactgaaacaaagggatgaagagtttttaagagctgggatgggagaatctgtgtaggccatttgtgcttgctaattggctttacccacagatgaagtaaattttctcctatcttcatgacaggaggtagttttacaacttagagcaaggctctttgaagttaggctcccacccacactcaggtgtagactgtatccctttaatgcttttatttcaaagtgatggctcctgggtgcttaaggaaaacattccagggttttaaaactgacaagaagctttaaaaaaaggtttacatctcaatcgggcaaagaaagagtttcaattacttgttttctaaagtaaatgctttaagaaagggaagttagggacctagagtcaggaggaagcctgtataaagtttagtccagctgagggaactgctaaggccatcttggtctcggtgaacacttggttttcacatagttttaatcacggaactagtatgtggcctggacacacttggaaagaagccaacaccagagggattgctgatatactgtgaatatctaattcctacatttatgataatgaggtggaatgaaataaagaggagacagtgtgaaattggaaagtatgtagtttgatgttacttgcaagtatactgtgaggcccaatttatgacactgggctgcatagagctttttctgaaagtccatctagctaaaccctgtcctttaaccatatgggccaaatgacttttgctttattttattttagggaattttctttatttgtaacattcctttcagctctttttagattctaatattccagaatgtcttttttccagtgtaggttcttggcatctttgtccaacatttcatagtaggtgtataaatttgtttttggtttctgaattctattccattgatctgtttgtccacttgaatgccagtaccaggccattttggttactatagctctgtagtataatttaaagtcaggtgattcctccaattttgttatcttgctcaggatagctctggctattctgggtatttttgtggttccatacaaatgttaagatatttttctatttctgtaaagaatgccattgatgttttgataagaattgcattgaatctgtagattgctttgggtagtatggacattttaacaatattgattcttccaatccataaaaattgaatactttccattttatggtgtcctattcaatttctttcgtgttttatacttttcattatagagatctttcatttccttaagattgatcattgttggcatatagaaatggtactaatttttaatgttgattttgtttcctgcaactttacataatttatcagttctaatagtttttttgtgtgcagtctttaggtttttccaaatataagatcatactatctgaaaacaaggataatttgacttcttccattccaatttgaatgccgtttatctctttcttttgtctgattgttttatctaggacttccattactacattaaataatagtggtgaaaatgagcaacttcgtcatgttacagatctcagaggaaaggctttcagtttttccccattcaatatgatgctagctgtgggtttgtcatatatggctttcattatgctgagatatgttccttctatccccagtttttgagagtttttatcataaaaggaatgctgaattgtatcagataatttttcagcatcagttgaaatgattatacggttttggccttcattctgttgatatgatgtatcacattgatttgcatatgttgaatcatccctgcatctcagggataaatcccccttagtcatggtgaattattttttttttggtttgctattattcaggatttttgcatcaatttttatgagtgatattggcctgtagttttatttttttcatgtgtctttgtctggttttggaatcagggtaatactggcatgatacagtgattttggaactatttctctcttcctctattttttagaatagtttgagtaggactgctactagttcttcattacatatttggtagaattcagcagtgaagccatcaagtcccgggctttttttactgggagactttttattatgcttcagtttcattacttgttactagtctgttcaggttttgaatttatttgtggttcaatctcagtaggttgtatgtgtctgggaatttgtccatttttttccctagatttttccaatttattgacatatagttgctcatagtagccactgataatcctttgaatttctgtggtattagttataatgtctcctttttcatcctgattttatttatttgcatcttctctctttttctgtagtctggctaaaagtttgccaattttgtttaacttttcaaaaaaccaactttttatttcattggtcttttgtattgttttcttcatttcaatcttatttatttctgctttgatttttaccattgattttctactactaatcttgtgtttggtttgttcctgcttttccagttctttaagatgcattgttaggttgtttatttgaagtttttcttattttttgatgtaggcacttatagctatgaactttcctcttagtactgcttttgtcatataccataggttttggtatgttgtgtttccatcatcatttgcttcagaaaaattccaattttcttaatttttttattgacccactggttattcaggagcatattgtttaaccatgcatttgtatagtttccaaaattgctcttgtcattaatttctagttttattccattgtggttagaaaagatgctggatattatttcaatttttttaatgttgtgagccttgttttgtgacctaacatatggtcaatccttgagaattattcatggtctgaaaaaaagaatgtacattctgtagccgttggatgaaatgttctgtaaatatttattagatccatttggtctatagtatatattaagtctgatgttcctttgttgattttctctctgaaagatctgtccaattctgaacgtggggtgttgaaatctccagctgttattgtactggggactacctctctctttagctctaataatatttgctttatatatctgggtgctccaatgttgggtgcatatatatttaaaattgttatatcctcttgctgaattgacccctttatcattatagaatgacctttgtttcttatagttttaatcttgaaatctatgttgtctggtataagaatcgtaactcctacttttgttttggtttccagtggcgtggaatatctttttccatcccttcattttcagtctacatgtgtctttataggtgaaatgtggcaacagatcattgggtcctcttttttcatccattcagccacttcttttcattggagagtttagtacatttatattcaatgttattattggtaagtaaagacttactcctgccattttgttctttcttttttgttgttgttttgtggtcttctcttccttgtttccttcctgtcttccttttagtgagggtgattttctctgattatataatttagtttcttgttttttattttctgtgtatctgttgtgtgtttttttacttctggttataatgagacttgcaaatactatcttatagcccattattttaagctgataacaacttaacatcatttgcataaacaagcaagcaaaaggaaaactaataaaagctctacaccctaatttcgtcccctggtttttaactatttgttgtttctatttatatcacactgtaccatatgtcttcaaaagtagttgtagttattatttttgattggtttatcatttagtctttctagttaagataaaagtagtttatacatcatggttaccatgttatattctatttttctgtgtacttactagtgagttttgtacctcttggtgatttcttattgctcattaacattcttttctttctgattgaagaactccctttagcatttcttgcaggacagatctggtattgatgaaatccctcagcttttgtttgtctgggaaaaatctttatttcttcttcacgttcgaaggatattttcaccagatataccattctagagtgaaggttttttcctttagcacttcaaatatgtcatacgactctcttctggcctgtaagttttccaataaaatgtctgctctcaaaggtattggagctccgttgcatgttatttgtttcttttctcttgctgcttttaggatcctttctttatccttgagcttttggagtttgattattaaaagccttgaagtagtcttctttaggttaaatctgcttgttgttcgataatcttcttgtacttggatattaatatctttctttaggcttggaaatttttcttttattgtgtctttgaataaaccctctacccctgtctatttctctaccttgtatttaaggccaataagtcttagatttgcccttttgaggctactttctagattctatatgcatgctttattctttttgttttcttttgtctcctccgtgtattttcaaacagcctgtttttaagctcattctttcttctgcttgatcaattcagctattaaaggactctgatgcattcttcagtatgtcagttgcatttttcagctccagaatttctgcttaactttttaattatctcaatcttgttgttaaatttatctgatagaattctgaattccttctctgtgttatcttgaatttctttgagtttcctcaaaacggctatttgtgaattatctgtctgaaaggtcacatatctctgtttctccagggttggttcctgattccttgtttagttcatttggtgaggtcatctttttctggattgtcttgatacctgtagatgttcatttgtgtctgggcattgaggaattaggtatttattgtagtttttgcagtattggcttgtttgtacccgtccttcttgggaaggctttccaggtatttgaaattacttgggtgctgtgatctaagctgttccttatttagggagcaccccagtaacactatggttcttgcagactcatacagattcatcttgatcgtcttaaagaagacctgggcgaattctctggattatcagatggacactcttgttctcttcccttactttcttccaaccaaatgtagtctctttctctctctctctctctctctctctctctctctctctccctccctccctccctccctccctccctccgtctctctctgttctgagccacgtggagctgggagtggaatgacgtaagcacccctatggcaaccaccactaggtggacctgaagccagcacagcactgggtcctacgcagcatctgttgtaatcactctctggctactgcctatgtttcctcaaggccctgggactcagcagggggcaaaaccatctaggactgtgtccttcacttcagggttgcaagttcccctaggccctgggtgggttcagatgtgctgtctgtgagccagggactagagtcaacaaacttaaatgtctactttgtcctcttttgtcctgcagctgagctggcactcaaaccacaagatacagtccttcccactcttctctcccctttccaaaggcaaaggagcctcagctcatggccactgccactacaggtcctcagtgaatacttccagcctaccaaaaatgttccattgaggtccaaggactcttaagtcagcttgtggtgaatgctgcctggtttgggactcatccttcagggaagtgggctcccctctgaccctggaaatgtttagaaatttcatccaggagccaagtgctggaattagggactccaagagcccattttgtgccctactctcctgtggctgagctggtacctaagatgcaagatgaaatcccctttgcttttccctctgcctttcttaagcagaagtctcaccccatagccatcatagctggaaaagtgctgagtctcacctgaagccagcaagtgtgaatctcacccaaggccctcagtgtagtaccaggtattgctgctggttatttgagcccaaggacacttcagttaccagggtgaataaatcctgtcaggactgggtcatttccttcgaatgagaaggttgctctctggcccagggtatgtctagaaatgttatcttgcaggtagggcctggaaagggggcctcatgactctgactgctgccctatcctgctatagaagagctgctatccaagaggcaaaacgaaatcttctccagtcttctgtctcctgtcctcaagcagagaaaaggggtctcttttggagcagttagttgtacagcctggaattaggggagaggtggtgcaagcactcctttagccaccctggatagcatctcaggaggttgtgtgccccaccctcacccccagtcagctgggtttgggcccagttcagcactaggacttaggagttgcggtcttcatggcctatactgcctttcaagattatttagggccgggcctcagggcactttagccagcagtagtgaggcttgtgggaactcaagcactgaccactgggatcagtgattcccctctggctaatgctggtttaaatggtccctccatgggtgggtgtcagcggagtttgatctggttttcctttctgctataacaggacaccactgagtccaatgactgaaattgctgcacgctgtctctctcctcagcacatggaaatgctctcctcacccatgctgccactgcctgcaggtggtggaggggtgtcgtcatggcaattagtggcaatagtcctgaataggcaagtaaggactatttttttttctccttctgagtgactctttcaataataggaagttaaaatccagcactgcgagtgttcatttggtttttggtccttaggaaagtgcttctctctgtagatagttgttaaatcggtgtcctagtagggggatgatcggtagaggcttcttgctctgccctctaatttgtaacatttttttagctctttttagattctagcattccagcatatggcaacattttaagcattaaatttctgtataggccttccagacatgggtaagtgtgtgtagagatatgtttgtgactttatgtttcctttaatatgcaatttcacatttaccaatcctaaaacattaaaaagagcataatccaaatacagtgttcaaataaacactgcagttatttgttagcaaagcaactggctgtgattctatttcaggaagattatctcctccaagacgtagaaatttgccagctacatttgtttgctactgattcctgagtttggtttgctttcattcttctttggatctcagtctcctatgcaccattcacattttctattcccagtaaaaaggtttttgtatggtcttggttttgttcctatcagtcacttaaaagaacagacacccaaaggcaagggcattaatcatctgtttgaaggtccctgggaaattattatttatatgttgatagtgaatctattttaccctttaaggggcaaaattgctagattaggaacatggttaggaaaacatagcagtcattaaccttatcgcttttccaacaaagaaaaactgtgtaacaactggccaaagcccgtggcaatttgagaacacaagagatcaacaaaatgaagcccaagatgagataaaacaagttgccagccttttggcataggtttaaaataattttctgtaaacacctatcctcaaaaatggaaatcagtgaaaatatttcataaaatggctagagaattctaaagcttacattatattctttagtattttatataagaaaaattttgtttgctttagaaatttcataacgtatttcttttagtctaattaaattttctttttttttttttttttactagcatcattccccttagtcactaagagtgaaattaaaaccactaaattttatttttttaggttgttggaattacaggttctctgaaggggttgctctgcatagattattgacaataaatatgttccaaaaaactccatgccaatgagatgagaggaattattgggcaagagccaaagaggaaccagggagatagcaagtgcaggaggaaagcacaggtatggaaagtgagtgaaagtaaaggatgatgtattagtccgttatcacactgctataaagaactacttgagactgggtaatttatgaagaggtttaattgactcacagttccacaggctgtacaggaagcatagctgggaggcctcaggaaacttataatcatggtggaagggtaaaagggaaacaagcacgtcttcacatggtggaaggagagagaaagagtgaagggggatgtgctacatgctttcaaacaaccagatctcttgagaactctatcaggggaacagcaagagaagaatccgcccccatgatccaatcacctcccaccacatccctcccccaactatgggattaaaattcaacatgagatttgggcaaggacacaaagtcaaaccatatcagatgactagccgaatgttaacctgatctgtcctctcagcagggacaggtgccctcctgctttatggatgatttaaagttattataacagatggtggtgcttcctttcatcttttactttggaattttagcattaatttaaaaaatatttcctatgaaacagtgagacaataatgctagaacattctagtggttcataaagagcctttacaggtaggattcacttggttagggcgccacattacagatttgatcccaaaattgtggatctagaaattttattttcacatggtattttatgtgggttagacatattagaataccctgcctcagtttccttgttggttgttgtggacaaaaataaatgtacttagcactgttttgaggataaaggtgttagaacactgcttgacacaaagtacttaacaaatgttagttgtcattcttagttttattaacattctcaacaggcatatgctgatttattagcttatgaaaaatacatttaagtgggtccagaattattttattctcctttcagaatactctgttcatgataccaaaataactgagaagctgcattagtctatctatgtttctttccttctttctctctttttcttctttctttctctttcttctttctttttggagacggggtcttgctctgtcactcaggctagagtgcagtggcatgaacatggctcagggtagccttgacttcgtgggctcaagtgatcatcctggctcagcctcctcattaattttaagatgattctactatggagaaaatttaaagagtgatcaaaggttctgagtggttgtaggagatgttttatttgggatctgaagactctgataaatcgcctaccaccctacacctgcataccatcacagaacagtccacaagatgtcagttgcacaaggatcagggcaagacacacttgctctttgtttctttcttttttttttttttttttaacctgtgagtctctgtatgtctctctcttgctgttgctctcactgtcggcctcctctctcctccccccacccctcactaacttttgagctatcatgttttgtttcctagattccaaggtggcactcttccttcctaacatcctttttaattccacttatgccattgcttatgttaaggtttcctgcaaatgaaatgaatcgaaatgaaataggatcaatttcttcttgcttttagctgggagagtccttaagtgtatcactgaaagtggttgctggtttgaaacaatatttttgggttatctggggccataagtaatgacatttgatttgtccacatcatcaataatggagttagtagtagactgaggttcaagaagttgaagacctgagacccatatccaagttttccactgtttacaaccacgactgcgagaggacctaactgttgtatcttccttacaattagaagagacacaacttttcccaagaacaccacctcaagagactgtttacattattgaattagactaagctttaacatacagtgagtattcagttaaattatttctcttcacatcagctggtagggacttatggtgagtacaaaatcagctatgggcaaagtttaaaatgttatattttctctggacattaattataatagaagatacatcttatgctttccacataaagaagtagcatgttaggttaaaagaattttagggtgtctgataagaaaatcaaggtcagtgtgactaaagaagagttaaagagaggactaggatggtttatggatgaagagatggcagaggctgcatttcacaaagccttgcagactatggtaatattttccattttattccaagtgcattagaatgccaagaaaaggcattaaagaaggaaagtagtacaatcagatttttattttttttaattactatgacttctatatgaagaagagattcagaagagacagattcagctgtgaactagataaggggcgcttatttcaaccatgatggagctagtagatgcacacaagtggacagatttcagaaagttttagagaatgcatgcgtaaatagcttccacctgcatgctcttgtgtacatgctctacatgtgaatatatagatctacttacatatacatatgtatgtttgtatatagatatgtatttgtttaggaacatacttagaaaagaagatagaaaaacacaccaaaatatttacagtgacttcaatatttaaggttatagtatttggggttatgtttacttgctggtttgttttgagatggagtctccctctgtcacccaggctggagtgcggtggcacaatcgtggctcactgcaacctccgcctcctgggttcaagcaattctcctgtctcagcctccccaagtagctaggactacaggcgcgcgccaccaagcccagctaattttttctgtaattttagtagagacgaggtttcaacatgttggccaggctggcctcaaactctggacctcacgtgatctgcctgccttgggctcccaaagtgctgggattacaggcatgagccactgcacccagcctatttggggtaatttttgctgccttctttacaatttttcttttcttaatattctacaatgaatatatgtaaataaatatatatagtatatatagtatatgtacacacttgtgttaatgaggcattatggaaattaaattataaatatggctagtatcaagaaagtcctaattcaagtttcattacaaaaattgtttcccactactcaaatatgataaagcacttttaacataaacaatttttataggcaaattattgtgttggaggccctctcaattggttcatgatcatgcatagctcctaaaatataagaaggtaacaatttataatacaatggatttcaatcgatgccctttgccattaaatcacactagaattcaatgacacaactgattaacaattaaattaatggtggtgaccttgcaaatgaaaagtgatatatagtatttatattttcctcatcttccctctgtttctgaaaatgtaaaaatattcttttaatgtttgtagtttttaatcttaaaaacacaatgttgaagaggaattatctggagagtgctagattagagtcaattaagatttccaaattaaatttttaaatttataactagagagatttttaaaatgttagcagtattttttccccagattatctatctgcataagattctagagaattctgagacattcttcttgctttagagttgggtgctacataaacattaatcagtgctaagtaaaaacaaaccaaatatgtgtgtgtgtgtatatatatatatatatatatgcacccccattgtttagtatcagtaaattttactagaaatactgaacaagtatatggcaagcaattgacaaaaatattggttcctgatctccttttaaatagtatctatgatgctaaataaaaagtgttctaataatagaggaaatattttcatattttaggtcatatacatatacacaacataatagggacggggagaggcatcatgaaataactcaaggtagtatactatctgaaaatttatacttatgaaaatttatgttataaaaataaagttaaattgcttttttaaaattgctttagggtttagctctctgtctacatagttggcaaccttgggtgacttattttattgtaatctattgttatgttaatttcccctattgctacttgtataatttttatatacataaggcctcaataaataaactctttgaataaaaaagaaccctaagcatctttttgcaaatagttctaaatcatgaaaacactaatattttataatgctctaagaagctaatgaaccagaaatatctttaaccaaaggcacttttcctttggttttcacaaagcagagaatcctaatggacaggcaagataaatcatttactgtgtaaaacactcatatacctattgaaagggtaaccacatcaaatgttctctggctatttaaattacctacaaaaagaaatcttagcaaagtgcaaaatgtgatagacatttgcagtctatctgtaactagcccaattccttcaaagagaaatgtgaacataaaatgcaaaagcatgactgaggagtcatttcatgcattccttgattcctcagaatggctacaagcaacgttctcatctagtgtggggcctcactatgcaaatctgccaaggttatccccgtgggcaacctacaaccaacgtgtctttgccttgggctcagtgagttgactataatggttatcctggcaagacggagctgatcctctctcagaagtagacgataagatattatccagctaaaagttaaaagtggaagacagcttacacttcaaggactggagaaatcaaattcagtaatgccatttctcagaggaagtctcagattaaggacatagacaataaagctttatataaggaaaatatttgtttaaggttgaaaaggctaagatataaacatccagtcagtttgatttaaggtggaaaaaaaagaatctaattcttagaatggagctagggatatcagtggaaactcttcttccctacacaagtgacttgacatgtttcttgtttttgattctaaagttgttttagaaattcagatgtgaaaatacaaacattctctgcttttttctcccttgtagctttgattcctcaatattcaatttgtcagccaatcacattaactctatgtccaattgatttcccatatgcctgctttattttctgtggttaccacttcgggacatccttctcacttcaatccccattcttctgtggtaggcaaaaatttgtaaatcccccaaccaagggtgtcctgtcctgatccccaaaacctgtatttatgacaagatatcactcccatgatcatgttatagtatatggcacaactgactttcagattatccaaatcagccgaatgtaatcacatcactctataaaagcaaagaacgtttttttcccactggtggaagaagagaaagtcatagagattagaaatatgagaagcactcaaatgccattcctgacttgaagttggagatatccatgtgagatgcaatatgaggagcctctaggagagaaagtggccctgtctggctcacattcagccaggaaacattatcctcatgctacagcaataaagaactgaatttttccagcaacctgaattaccttgcaagagagtttttccccagtgccttcaaatgagaacccaccctaaccaaccttgatttcagccttatgagaccctaagctgagaactcagccaagctcacatggactcctgacctatagaaactgtgacataataaatttgtgtggttttaagctgatgagtttgtggcaatttgttatacagcaatagcaaaagaagataccttcccacctagccatattcatcagatcagcctttataaatgactccattcatcttaacatttgactatgtaaaaatctacaagtcttctcaatgtttcagaccaaattcaaaacctttattttgactttaagatgccagtaaattaataagccaaagtttcttatcctaccaaaatttttactattcttgtataaagatgctcctctaatactttgttgcatttgttctcccatttgtcatgttataattttctatgtatttgtctgtcacctccattaaactggacattaattccttatattctcagtacctaggacatcacttggcatcagtagatctgtaatcccactcatggatgaaacaactccacattaaatccaggccagacccttactgttctttgaccaggccatgcagagctcctgcctctttgccttggctaatatgcttccctcagctggaatatctcatttcttccactatctaccaacgtgctgagggaagagtcaatataagacagtcaatatacgggtcctttgttgaggcaaaaaactactctggattaatgtctccttacatgattgcagaacacaactaaaaaatctgcatagaaacaagagcccactagtctggagccatagagtctccttgacactgaaaggatacagcccttcggggatatgtttgtcaatttcttaacaagtctatgaatttcttgagtaaaagaaccacattttctattttttggataccactaataatatctcgttggcatagaatatatgcttaaggaaccaaatttgcacttaagcttcacaaatttcagacaacatagcaactggtgtagttatcttactgctcactttgtcactatttctttaattcaaactccctccctgccttgacttaccaaactgaagctggatgggagaaacagtgggagtaataatacaactagggcccagagaaaactttctcaagatcacgtagctagaaacatactggacccaggattgaaacctgtggtttctgacgccacagctctgcccatcataactcccacaccttcttgcctatccccacccaactcccagtccctaacagtctaggataagaatcctttgtattcctacaaagaggttgctatgatttgaatgtttgtttcttccaaaaaaaaaaaaaaaactcacattgaaatttaattgccattgtaagaatattaaaaggtggaacctttaaaaagtgactgggtcattagagctccaccccgctgggtaggatatgtgctatgacacagggcaagtttggtgacctcttgccgtctcttgctcttccaccatctgcaaggggaagaggcaacaagaaggcccttgccagatgctggccccttgatcttgcacttctcagattccagagctgagagcctatacagttccatctattacaaattaccccgaatcaggtattctgttatagcagcagaaatggactaagatagtgtataattcatgggtagaaaaataatgaaatgacatgagtgttttgagataggctttcgactacaaatattagagacaaaccctaaaaaggattacatagaactatctttatatgaatacacatatcagacagatagacattcaaacttcctctgtccaagtcctatacatgccactccttagtattttcagattgcatcttagagaaatcattattttatatcaaaaagtagctggccttgacagagtataatcaggttcacagtttatggttctactgtgattaaaattagaactttgatgcttgttttatagatgagaaatgaccttcatataatgtacattgttagtaaatgatttctaaaaccacctagggcatttctttaaatctaattaaaagcacaatttcaaaacaagcagatcaaaatgtttcctataaatcagcctggtgtagtactaataaaaagtaataaggagaaaatattttaatatttacatatgaaaagaagttcatgctaaattttacaaaaggcagttgtacctgctaattggatgtgttactaaacataatttatgcaaagaattcaccttttggtgtaacctaatatatatatcagtcattacattacattgatattgctagattatggtggggatcaggtctccctagcttactgcctgatatgtaagtatgcaagaaatgttacagaatggagatagaaggtaaagaaagacaaacgtagagtaatgtggaaaggaaggggacagagtgaagggagaaaataaagaagacagacaaagaatataaaggaatgagaaactagaaaaaatagaatgggagggagggagaagaaagggagggagggggaaggaaaggaggaagggaagaagtagaaacagaaagggagaaaggaagaaaaaagagaaagggaaaaagagagaaagggaaagaaggaagatgtgagaaagtagaaaagggagagaaatggaaggcaggcatactccttgccctctttttccctttctcctgctggcaaagcctgctcctcagccagatgaaagatttgttgtcttaagcatgccatgttctgcaggtctcatagctgcctatttataccaacccttttcctcctggtaaacttctcctcattgttaaacattcaaacagtagtgcctcccctagtccaggtgcttcaggaagaatcagagacaccggccttcctgcttccctatgacttctgctgtctcagagagtcaagtgaagttaccattagatacttttctcattattgtgtacctgttgctgtagtgataggtggtctccccattacggtgtgatctccttgagtcaggaaatggtctcagcactttgtattcctagattcttgcacagggcttggttcacaggaattattcaataattctataaattatcacattcagttctcacaactaaccatgtgaattaggcgttatattctacatttcaaaagagaataaacctcaattcagattatttaagtgacttgtacagtaacactcgtgtaagtgagcctgaaaataattcttttgttttcactgatgagatctagaattgaaataataagttctaagaattaaagtacaacaaactcccatgacacaagtttatccaagtaacaaacctgcacttgtactccaaacttaaaagctaaaaaaaagaaaatgccaccaaaagttctttaatgtatttttaaatgataagtggaaataaggccaaattgtggctgtttcattgtgaatttttgagaattgtattcttcccacgtatctatatgagaaagggaaaatttgtgttaatttatgaaacagaaacctaagatgcgccatgttctcttatttgttatttataggaactggcttataaaactggggcaaaaataaaataaaaattctacaactgaaagcatttgcatttgttttagacatagagttttacatcaactaaagatttgtgaatttttggtgtgttctttcatatattaattcaataaatgtttcctgcccatatatgctaagtaagcactgactctctgtttaatcttactttagtttacacttgttaaaatattttcccatgccatacatttctagttcaaacatggaattaattttctttggtggctttttgttggttttccaatcttatattttgtttattttgcaataggacgtcgagtttaagtaaactatgtgttcagccaaggttatgcattcctcttgttttataaattgtcattattcatacaagactttgctcttttctactgtattatacagtattttgtgattttctttattttgtcttataattacagtttgggatatatattcagtatatcattttatatttgaccaaaatcacaaatctattaatattgctaagacagttttccaacagagctatgatttccgagtatttgccctataacttcaaggatacaataaaatttaacttaagggcttaaaatctaagcagaactggtgctgtttcatcaggcaatgcattgaatggtttataaactgaacatgaaaatgtctaaaagaaggcgtctcccagagcccattaaccttcaagacgccttagcctttctctttttttttttctgacatgagtaaagtgaacaggattttaataaaagtcctgcagcagatattcctgaaaggtcagggctcatgataaagctgccagcactgcaactttaagaaaagagatcccgacgacctttaataacactaggtctgccagtgctcattgtagaggatctgtattttaaaattccatttgagaaactgactcccccatttgacaggatcatggtctttaatcttacttttggtgtgtaagagctggcggtatgccccatggaaacttgcattttgtatgcttctgaggaccttgggaaataattttctctagtgatagaaatgcttccccgtcttcaactttgactttctgatcacccatttcattaatactaagtacaccatatctgaaagtagaaggaatttaatattgaagaagtagacttgattcaccaaagcttctatttcatttattttcattttcgttccttaatctctcttcagctttttatagattgaataactctgaaatcaggaattagtgatatacaacagtaatttccacatctatgttttcactagcagaacaaaggtacaattattactaaaaatatatttgttattataactccaatttaataaggggtaaacaaagactttaaaaacttcagtaagttgctcgagttaacataggtaataaataacaatgccagaatttactgttttcagatcactcagtttcaaaacctcatacaatttccattctctaagatgtacatctacatttctgtcttcatcatctcagtttaaattaaattaacaaataactctttggaagctagaataacattatgagtaaaaagtaaaatcttgatgtaaactattccagagaatagaaatagagggaaactttccccattctttttgtgaagtaatttcatcaatgaaaaatctggcaaagaatttaccaaaagaaagcaaaaacaaaaacaaaacaacaacaataacaacaactcagaccactctcaccagagtgccaatcgaaagtcttcaataaaataacactaaataaaattgaataccacattataaatgatatcacaccatcaagtgaagattcttctagcaagccaaggccgttcaacactaggaagtctaatagtataattcacatcataataatagagccaatgagtaaagcaatatcataatctccagagatgttgaaaaggcatcagacaaaattcaatactagtaatttaacaaaaacaaaaacattctgtaacataagaattgatgaattgatgactcctttgtaaacatgagagtgtacttgtatgtatgtatatgactatatttgtatatatagttttgtttatatcttcatcaaaagccatttatatctccatcaaaagcagtatttagccagcatcttccttaaaggacaaacactagagacctttccactagaacaagatggtgctacccactgtttttactgtgatttaatattatattggagatctatgacaaagaaagcaattagaggcctacaacttggggagacagagctagaactacctctgcttacagatgatattattagttacttgaaaactgaaaagtatcaatgaaacaactagtatatagaaagagagaatttaagaagatggcaagcataactttaacatacagaaatcactagcctacatgtaattacaaacagttttgaagatattatgaaggtgagcagaaaaccttttaaccttaattccaaataatagtttttcaattttttttctttcattggagaggtggggcaagtgtgatgtgtgcctagaacaatgagattttgtgactcagaagaaaggaaagaggaaacatctcagtagagaaccttgcatggggaagagggaaatttgttgctgtgaagcagtactttagaaaaattaatcacagaaaaaaatacaactagatactttagaaaaattaatcacaggaaaaaaaatacaatcaggatgcgatgagaacctgaaaaggtgaagcagcagtgttaatggaatggacgggataataggagacatttaaaaggatcaaccatattaatggctggaatcaaacatttgtagaaagaagtaaatcaattaaggcagggacagaatgttaaccaggaggtctgtataatcatttggtgataagtgtagaaacaccagtaaaaggagtgctatagaaattgtggtcaataactattccactaagagtttctactagttcacatctcttgatgaaaatcatttaaaagttacaaagtagtcaggccttcgatatgaattcaaaactaactggaccagtacttttcctttttttctgatattttcctttgttctcatatgtctattccaaaaagccaaatataaatgcctttcatttcactgtgtcatgctgagaaaggcaagatgaaaagggcgagaacaaagaaaaagaacagatgaaaaagtaatgttggaagttgtaaaggagttctctgggcttttttcccatcacttacaagttggaaggtgaaaattaaagctcaccagacatcaagaatgtcattttccttcgactcaatgtgcttccattttgggttctttgcagttgtaacgctcagccggaaattcttcttccgccatatcctacatcgctgatcacttggtcaaatgccacatcaccagaaaagcccatctcccactgttctgtatcccctgaaccttgctgtatttcccactgtagcgcttactgtatatttagttcataatttatctcctgtcgtgagactacaaagttcaagatatgagaggttttttttcctgtttttcttatattcccttcgctgttgcattctgagagcctgaaactgttatctgccatatgataggcatccacgagatattggttaaataaatgaatgaacaaattaatgaatgagcaagccctagaaacagtattctacaaagttcttacaattatattttattttgtaatcaagacaatttcaagaaagaaaaaacaattagagcattttccctttaaaaaatactaagcaatatctatgctacatagtttattttcaatgaatcaacaaaaaaaaaatctgatctttcttgaattcttgaagttgaccagttttttcaaaagggaggcagtgattagttttgggtggccacatctcctcctgcctgtttccagctctttctctttgtattagggtatttctccttttcattcagactcacatttgttaagcttcaaagcactccatggtttattatggatttttcactctaggaaagaggtcatcactttattaaacattaaataatggtgataatcaataataattgatatattgtctctattggtactatcagaaaaaacaaacataagcatttcaggttactatgtgcatcaagaattctaatgttttgaaaatctgcataatatatcaaatgtgctgtgatttatttatctacctgtttagtgttgaacagtaaattttattccattttttggtgttataaatagaaacgtggatctctcttggcacttgtccttatgtccaatttcatcccaaattcatgcaaaattaatcaaattgcaagctcttgatgcatagactcacaagcaaaagtctacttattgagatactgtgttgataacatgatataactttcatgttgcttctctctaacttatgaacttgttgtcctttcatcagtgaaaatgaaaatgaagaactatcacttaagaaagttctactacagatacaccagggctttgatatcagacttgacctgaagggctcctctagttatgagctgagggatgagaagcggacatgcaggaagatccccttggcatggcaacctttgcaaagcactgcctgatagtctccctcctgctgtgcccagtgtcaagagaatgagcttataatattttgtaaaatatgtagattgagaaatcggaatctcatttatcccagaaaacagatttcctagtatcaatatagcttaactttttcttgaaatgaaggtcattttacgaacataaatttttctccaaaatgaattcaaacagaattttaaaagtatggagctggcataaatattttgtgaactgaatataaacactttgacttcatttctcatatgtatttcacatgcatgaaatcaagagagaaagaaattccattggcattcagccaaggaaattgattttttttttaccactgtgccactatattatggtttattatctccagaatattactctaaatagtgctacccaacagaattttcagcagtgatggagatattctgtatctgcactgtccaatatggtagcctctagccacacatgattgttgaacacttaaaatatggctaatgcaactaactaaggaactacattttaattgtatttaattttagttaattttaattttggttttaatatttgcatttggttagtgggacagcccagccatcgggtaggtcattccatttctgcatttcttttatcctctctccacattctgcttgaaagctgagaaagctgccttgtacctccagttctatgatttcactctggatactgctagaaaagtagccctttacctatgacagaatggtggtttccagaatgtactaatccccaaacctatgaatatgtcacctgacatgacagcagagactttgcagatgtgactaaattaaggatcttgaggtttagagattatcttggaaatgtgggtgagctcaatatgatcacttttcagagggaggcagtaaggttagaaatgaagaggagatgaaaagactaccaggaccaaaacaggatagagaggaaagaagatgctacgttgctggcttgaatatagaggaaatgggccatgagccaaggaatgcagactgcctttcgaggttggaaaggcaaggaaacagtttctctccaacaagaacttccacatttgaaacttctggcctccagaattttaagacaataaaattgtgttgtggtaagccactaagtttgtggaaatttgttacagaaacagtcggaaactagcattctgtcctggaaaatcacttgttcccaggacactgatctgtgatgaaataggtaggtctgaaacaggaaaccaaacaccgcatgttctcattcataagtgggagttgaacgatgagaacacatggacacagggaggggaacatcacacaccagggcctgtcaggggatggtgggctaggggcggaatagcattaggagaaatacctaatgtagatgacaggttgatgggtgtagcaaaccaccatggcatgtgtatacctatgtaacaaacctgcactttctgcacgtgtatcccagaacttaaaaaaaaagaaagaagaggaaaaataggtctgcggtgctgctccacagagagcggccaggaccccatttcatctgccaaaagaaaatgtatacgcagactcgtattgctggagtccattatgccttttaagaactatgcctcttaaacagtacggtgcttgtgggtaaatcatccctgccatttttcctattcaaacatgttctggtatctactaacacaactgtattaggtgtgtaaaaggcatctcttccctgagtctaagcagaagtgctacctcgcccccctacctcccatcaaatctgtggctgcataaattgactttataaagaaatcctgctttgcttaaacagctttggaaagctgtttaatatatttggccgtaattggttttgttttaccatctggtttagacttccccctcagccaactttaattttgaagttaatcatttttaaattgggctttgaatgcacctaggtcagatttgccacatcagaggagagtttatgtttgcattattctcaaaaagattcttcagttttgctttgttttttgcagtttatttccctatgtgagtttcatttaaaggaaattggtgcctatactaatagctgagtattcacatgtgtggaagactttccttggcattaaccattagataccatctgatgcagctgtcagtgacattggatgtgcatggggctgtggaattgaatgttgaccatagtattctgcatctagttagggaagtcaagcagtaattttgatctttctacttagtcaattgtttggccgaatacattgacttatttgggagagtagaactttttttggtggagaagaagttgtgtcgtgatggtatattttgagttaacctcaatcatgacaaaccagaatgatttcctagatgcacagagaaggaaaatgttaaagactctcaattgctttttaatatataatatgcaatatggaaatctgtcacgacacttgaaaagaaaacatttataagtgaggcctgcttcacagtaatgacaaaaacaatagacactaacataaataaataaatacataacaaaatatttgccaataaactcaagtttagatttcagtaattaggtttggaaatgcatctttgctactgagacacaaacccctaaaaacaaacagttcattggttgtatgaaatgctgagaaaaaaaatggtttcaaaaaatgctaatgctgtaataatttgaagagaataaaagtaggatcaagatcctctaaccaggatcaaattattgcctatccatttttctgaagggcaatcagacgatttttatgtaagataataaatctgtagaagtgaactgtttgtaattaaacatggcacatcatttcatgaccatttataaagtcaagtgcttgttaacaaaaccgattttcattgttattactttctttaaaattattttcatgtgagatgaattcttttcttgaaagtagtccagctttgggggcattctgaaatttaattatcctgggcttgaaaaaaagctacgttttgacttaccatgttttttgtttgtttgtttctagtgaactgaagaataattgaataatgagtttatagtaacaattttataatatgcatatctatcatagaacaggaactacagtagaatcattggtgcagtcttgatttcttaacttaaaactaaaattagggattgagtgcctcattcgaaaatagcagcatttaagtgaatgtagagttaacttataagaatgtgaacaatacaatatctttccaatatttaatgttatcatttgtcatatataaaaataattaaaacatctctttcctctcccagttttactttcaaagtttcagcaatagtcgattccctgcatacacaatttaccatgctgctaaaagcctttatacctaattttgcccacactgctctcgtgacccagagttccttttcatattcttaaccctcatccaccctgcaaactcagctcaagcaccacatctaaagagattccagaaggacaagcctccccatcaccaccatagatagcatcatatatatagcaaccctgtatgccccacagtatcctgcccatgcgtctacgaaaacacttcctgcattgcacggaatttgccaaatttgcttagagtccccagtgcttcatacagtgcatgaaacataataggcagccaataaatacccttttcatttataaacaagaatgtaaagtactgcttacttctcactagtggtttcttcaatagaccttaaagataccttctctagaaagcatttcattttccagcccctattaacgttagccaatttacttatacagtcaatttcatgttttgatttgaatgtatgttctcaaatggagccctaaagatatcagtacatttaattccatataaaaacaaataaaacagtgtttagcaattgacgttgggacataaacagatgaaaaaggcagttgtcatataccatagtaaccagaacttccataaacgagttaagacctttaaacgagaatacatttgaaatgatttatttctataaagtcttgcttagttgagtattcacataaatagtgacaatattgtgtaatcaatgggattttttgtttgtttgtttgttggtttttttgagatggagtcttgctctgtcacccaggctggagtgcagtggcgcaatcttggctcactgcaagctccgcctcccgggttcacgtgggatactatattctaacaagtgtatcgagaagtaacagttatgaacacacttgttttgaatgtgctgtaaataacaaaatggtaaaactgttttatttgaattaacacattattaaatgggttatgttccatctttactaaaacaaagcatgagattatgatgaaagagtaagcgtgtaagtcaccagttctatctcccactacttgttgacatttatgagatgagatttgtgccctgggtcctctatcattttttaacagaaaaagaaacaagtgtgaagaaggctagaaggcaaggattaaggatattaatcttagaattgtatggcaatagcaagctgtgagacctttggaaagctgtttaatatatttggccataattaagtgcatctctgaaggaactattaaaaacagatgctttaaaaaaatgttacaaccttgaacttttttgattctttttgggcttgaacatctaaaatagatgaggagaagttccttaaactgttttcttcaactcagtcattaaaacacatttattgagcttctactatatctcacgtgcagacccaggtcttatagcaataaccctcccccagaaatttagaatctaattggagagagagtaaaatagagataaaacaaaaccctgtgtcatgtacctattaatccaatatctcttggccttctgaaggatcagaaaacttaactccctgccttctttcaaacatgttcaaatcctccaactccagtaacatagatctcttttcttcactttttggcaaaatcaacagcctttttgcaaaccgtatctgtcacaaatggcctctcacagagagatttctagctagctcaatttacaacaaacattgccttccaaacggaatagcaggttttccaggaaattaggtaaaatagcaaggaccataacaaaacagtagtaattgtttaaatagtttaccacaatatttattttggatcagctacaaaagtaatgtcagaaacttcatttcagtttcttcagtctacaaatactaaaaatctgcataaacacagtatacctatttggccccactactaaaaaaaaaaaaaaaaaaaaaagagctagagccagacattagagagaatgtgtctggccaaaagacatcccaattgtttaaagacaatacatatgtgtgtgcttgtttgtttattggtgaataagaattatttaagtatatattgtgtgctttccaaggatctctgattggcagctatgattctccactgtaacttatgacaattctgtggcattaaaaagtactagggcagggtgtggtggctcacacttgtaattccagcactttgagaggctgaggctggtggatcactaggtcaggagatcaagaccatccaggctaacatggtgaaaccctgtctctactaaaaatacaaaaaattagctgggcctggtgacgcatgcctgtattcccagctacacgggaggctgaggcaggagaattgcttgaacccgggaggtggaggttacagtgggccaagatcgcgccactgcactccagcctgggtgacagagtgagactccatctaaaaaaaaaaaaaaaaaaaaaaaaagtgcgtgtttgtgcccaagtcctgactgtgtcacaaatgtgctatgtgaccttgagcactcttaatatcatggaattgccacaatttttagtttcttcatctgtaaaataaaggcattaaataaggagttctgtaatttttctagctctaaattttaccactccatttcagtggtttgaattttctttgaacccaggagaagtgaacagatgtggattttacaatttaaaaatttaaagcaacagaaaagcatacacacatgcatcatgacaatttcatagcagtgtgattttaacaggctgttaccttaaggtctgaaacaaaaataaaaagatcttcaaccatattcataggagtgaatataacattagatgtctaagactgtgtaaacaatcttcatggccaagaggctcaattataatgattctctcctgatatgtatttcatttgatgtgatacatatacaccatgaaaaactatgcagccataaaaagagtaaaatcatgtcctttgcagcaacatggatgcagctggaaggtattatcctaagtgaattcatgcagaaacagaaaaatatcacgttctcatttataattggaatctaaacagtgggtatacgtggacacaaagatagaaagagtagacactggggactccaagagtgggaggaggggcagagagacaagaggacatggttgaaaaactacctacggaaaactttatttattatttgggtgatgggttcaatagaagctcaaacctcagcattacacaatatacccatgtaacaatcttcacatgcataacttgaatctaaaattttgcttaaaaaggaaaaaatgtatatttcatttgagatttcccatcatctacagctcttataaattgcagtgatgtcagtggtctttgctgaagattttatgcgcataaattgtgttctcatagggagatttgacttcatatcttggctactgacatagaaacattttttatattatgcgcataaattgtgttctcatagggagatttgacttcatatcttggctactgacatagaaacattttttatatgtctaaatggcaaattgctcaatttaagcataaatcaacaaatgtatcaccaatatttcagcagacgctaattctttttcccgtatcatttaaaaagttattagatccgctggcttgatggggtcaattccagtttttaaaatcttggtccacgtgtctatgtgtctttggacagttctaggcatccagtgccccaaagtcatgggagacttaattcagcaaatcatatgctaattgaatgtcttccctggtgcagttcttccctggttactatttttacctttcctttttaagagttggggcaaaccttatggtatcttctgaatacaagtcaatattcaatggacgttttaaataagttaattgtatctaatgtgtgtgtagctcaatgtaaacattgccatatttatatctactataggagccaagggccctctcaaagctcactgaaaaatcaacttgcaaaaagcatattggagaaaaagcatacaaatgtatttaatgcatatacatgggagcctgtagaataaaggccaaagatacagaggaaattgtccatttttaatgtctacgttcaaccaagtgtggacagccatctagaaacatgattgaaggaaaaaagggcctgatctaatgctaatagatttagtggggaaacccaacaaggcctaagttcttcttggcctctctctacagcattccttctttcagggtatggaaggaccctctctggaatggaggttttatgacctacagtcaaacaatatacaatatatcaattgtatattgataatttcttatggccagtttttacacagaatggtggagggaaaattagagtgatgtttttaggttttatggctggctttggggaaaaggggttctggtttctatgacccactttggggaagagggattctagtttttatgactaaccttgggggataataggatctagacacaggagagcaggaaaagtacagagaaaatcttttgcttctgagactgccactgaggccttcatttgggatattgttttctgatccccaacatctgagcatcctagaaaataaaaatttatgcagtggctcattcctgtaatcccagcactttgggaggccaaggtgggctgatcgcctgaggtcgggagtttgagaccagcctggccaacatggtgatacccccgtctctactaaaaatacaaaaattagctgggcatggtggcgggtgcctgtaatcccagctactggggaggctgaggcaggagaatcacttgaaccccaggaggcagaggttgcagtgagccaagatcatgccattgctctccagcctgggtgacaagagtgaaactccatctcaaaaataataataataataatttactaattacacacttctgccttgggagaatatcttttatttaagttaatgtatcttatataggcttttagaagccatttgtgtctccttatttttcagaatactgattgcagcatgtttgatactttttaagcaaaatcacactgaaaataagacatttcaactgttcttcattagtgaatatttgggagagcagaatgcaatgatgcttatctaaggggatgtttcagtttgatttcagggctgtaaaaaatggtgaagccattaaaagagacatcccacttcaaatgatatagttatatttgtaaattgtcctattttgttaaacttaaaacagttctatatttaagtaactgtaactacttgtaggcattcggaagaataaaccttaaaataatttattgctttcatggtgattttattgaaaacgtcacttcctttaaatcatttcatcaattattctcataagaaaatacaatgtcagtgaaataaacagaaaatcaaataccacatgaactcacttataagttagagctaaatgacgggtacacatggacactcagagtgaaataatagatactagagcctccaaaatgttgcggggaggaagtattgaaaggtcacctgttgcgtacaatgctcaccatttgggcgacggatacattaaaagctcagacttcaccatatatggatgtgagacatctgcacttatacccactaaatacaaataagtaaatgactgacacgatattatattatccaataacaattactcatactagtaatttctttaagaaagaacagctgtggctgggcattgtggctacacctgttacccaatactctgggaggccaaggtgggagaattgctttaggccagaagtttgacaccagcctgggaaacatagtaagaatgtgtctctaaaaaaaattttaaaaatcagccaggcatggtgatgcatgcctgtagtcctagcttctcaggaggctgaagagggaggattgcttgagcccaggtgtttgaggttacagtatgctatgatcacagcactgcactccagcctgagcaacagaactcacatctgtaatcccagaactgtgggaggccaaggcgggaggatttcttgaggccaggagttcaaggccagcctgggcaacatagagaccccatctctacaaaaaaaaaatttaaaaatataattagttgggtgtagtggcacgtgcctatagtttcagctatataagaggctgaggcaggattgcttgaccctaggagtgtaaggcttcagtgagctatgattgaaccactacagtccagtctgagaaagaccctgtctcaaaaaaaagaaaacaaaatagaatacttacaaatttatggtgttttcattcttgtatagctttggtattcttgtatacttttgatattacttgtatattgattaacttgtgaaaatatatctttgcttaactattgggtttctccaagtttggtcttgcttttctaagtgttgtatctatatataaagccttcagtaattttgcaggtaacgggacttatgttaaatattgtcttttcttcatctataaatgaaatagcattctgatagatgagattatgtaaatcctttagtcagacgattagacttactgcataattatattttagacatgagatcatatagtagcctcaaattgtatgacagatttgagagaaaagggataaataatctaaaactcacttgaaagtcagcagcctgagacattctctgtttctgtgtacaaatatgttagaaaaatggttctgaaacactttgacattcctcactacttaaagattatgtaagaaagtagcaggatggaaactgccttattattttcttttttcttcttcttcttcttcttttttttttttccccccagacagagtgtcactctttcacccaggctggaatgcagtgacacaatctgagctcactgcaacctccgcctcctgggttcaagccattcgcaagcctcagcttcccaagtgcgccatcacgccaggctgatttttgtatttttagtagagatggggtttcaccatgttggacagattggtcttgaactcccaggctcaagtgatccacccacctcagcctcccaaagtgctggggttacaggcatgagctgccgtgacagccaaaaactgccctattttcacagtgaatacacaaaagagctataaaattaaaacatgaagctcctttgcagtaatcattaatggagcacaaaaccctcaagccagcctatgaaatgccagttcaattccgtgtccgttctgtaattcaggaaaaactctacaaaagtatcttacaaaggaagtattctgctttactaaatctttcctttaatgaaatactgatctgaaaacccctaattgaagtaggatgaaattcattcaaaaaatatcaagcatgtgccaggcactgtatgccagtgaacaaagatgcatgccttcactgcattttagcagagggagtaaaacaaagaaacggcagggcagagcaccaggatgtcaggctgcaattttttttttttttttttttttttttctgtgagacaaagtctcgctctgccgcccaggctggagtgcagtggcgcgatctcggctcactgcaagctccgcctcccgggttcaagcgattctcctgcctcagcctcccgagtagctgggactacaggcgcccgccaccacgcctggctaattttttgtgtttttagtggagacggggtttcatcgtgttagccaggatgatctcgatctcctgacctcgtgatccgccctcctcggcctcccaaagtgctgggattacaggcgtgagccactgagcccggcccaggctgcaattttaaacagagcgattagagcaggcctcattgggatggcatttgtgcacaaagtcaaaagtgatgaaaaaattatccatgaagttttgtgggagaaaagcattctaggcagacactagcagtcacaaagatcccatggccagctacactggaagaatagcaaagatggccgttgtggacaaggcagagtgagcaggaggaattcaataggaattgaatgaggtggggtggagtgcatgtaatttagggctccatagaccattgtaagctttcttttactcaggtaggaagccatctaaacaagacttagacttttaaaggatcagcctggttgctatgagagtagaataggttgggtgagaagagacacagatgaggcaaaataaacaccagccgggaaaccacagaaataatccaagcatgctatgatagtgtcttggatgagaataatagcagtagagatggtagctatggtagtgtcttggattagggtaatagcagtagagatggtagctatgatcgtgtcttggattagggtaatagcagtagagatggtagctatgatagtgtcttggatgagagtaatagcagtagagatggtagctacaatagcgtcttggattatggtaatagcagtagagatggtagctatgatagcgtcttggattagggtaatagcagtagagatggtagctatgatagtgtcttggattagggtaacagcagtagagatggtagctatgatagtgtcttggattggggtaatagcagtagagatggtaagattttaggtaagattagatgaaggatgtgaggagtccaagatcatttctgcctgaaaagccagaagaatggagtggccattaagtgattgaggacgactgagaagaaaaatttcagaggcaaaaatatgctttatttatttattttgaggtgtctagtagatacctaactgcagatgaggtggggtggagggcaggtaatttagaggttaatataatctgatgtccttataatgagatgagatcaccaagatgagtactaagagaggaggcaagcagcccaaggtcgagctcgggggcacaccgatgttttatcaaaattcagggaaatgaagattgagccggcagcaaaagacagactgagaaggagcagccagtaaaggagaaatgtcaagcaagtgtagaaatttgcaagccaactgaagagtgcttcaaggttaaatgctggctgctgattagatttaacaatgtggaaatctttggtgagttttactaggagtagaggagtggagacaaagcctaatcacctgtcagatgacctaaccaagtgtccaaacttaacagcctgaaaaagccataactgtatgatgcaatatggagaccatagcatcaccttgcactcttgcatacaaagtttaacctgaaacttaaaaaatttagacctttcagtttacaggaagttcaaagggatattagaagttaaattaatgacactacaaaggaaaactctacaagacaacaggcctagtatttccagaaagtgagaatcttaaatgaatcctgtttgggggatgagggtagctatttacaaaagagacacatggaaaaatctgaaataagaacttgatgttaaattagggaagtattttaagtggggcagtggtattgagaatattatatagaatcatgttcttagcagatgtatgtttaagtattgtcgtgtctacgactttccttgaaatatttcatgtaaagcaaatatgccaaaatattttaaaaaaagaaaagtggttctgacagccatttccaactattcaaactaattgatattcacttactcagaacttcttcaaccattacttcttgagaacctactcaatgccagacagtattctaggcaagggataaagtgtgttgaggaaacagacatgttccctactctcatggaaattacaggtcagtgaataagactgacaatgaacccgagaggtatagaactaaaaagtttgataaattaaagagaacaacaaatggtaatgtagatgaaggtggtgactacctcagattgggaagacagaggagaaacgtttgggaaattgcatttaagggaagaaccaaaaaatacagatctttttgtaaagattgaggaaaagagtgtatttgaaaaaaagaagcatgtgtgcaaaggcagcctcacacttttctgctcagtgttcagttgacacctgcccttgttttgcttcttcgtgggttatgctatagaagaggagcatgaggcagcagtggagaagcaggtagcagatcatgcaaaaacatacaagagctcatttcttcctaaatgaaaggagaatccattgaagtttttctttttttccttttttttttttttttttttttttttgagactgagtctcactcagttgcccaggctggagtgcagtggcatgatctcggctcactgcaacctttgcctcccaggttcatgcgattctcctgcgtaagcctcctgtgtagctgggattacaggcatgccccaccacgcctggctaatttttgtatttttagtagagatggggtttcacaacattggccaggctggtctcaaactcctgacttcaagtgattcaccgacctccacctcccaaagttctgggattacaggcgtgagccaccacactcagcccaacaacgatttttaaagtagcgtgacatgtgaaagatcagtctgccattttattgagaatgaattaaagcaaggcaagatttggaaggggcagtctagtcaagaagctgcaaaatggggtgggtggggttaggaggttgaactggagtggcagagacacagaaaagtggacagattggagccagtttccaaacttctgtttacaaagctttgttaatgattgatgcagaagtgaaaggaatgtgaagaatgacttctggtttcatggtgccatgaactgtgatgagggtgagcagaggagtagcaaaattagagaataacatccaaagatatgtttgatcatattcacccagcaatgcctctgatacctctaagtgattatatcaagaagcaggtggagtgtccaagtttcaggctctcaaagtctcaactagagatacaagtttagagccttcttagagaaagctaagggctgagccctaaggatgccagaactcagagttgaggcagttaaggaggggccaggaagaaacagggatcaactcagggcaataatgtgagttcaaatacgttcatagactgagaaaacggaggttgtgaatgcctgtgagaaaaggagcttttgtggacagatgagagtggatttcaggttggagttgactgaagtgttaagagcttgcttcagtgaatctttcaaggagtttgtctatgaaagggattagggaaattaggaactggagagggttatggggccgaaagggagagttttgtcatttgttttaggtaacattaatgaccacatattgagagaagtaatgcagaagaaaagttgataattctggaaaagtgtaagttgaatgggttgacaaagccagaggagataggacacagagctcatgcccacagagacgctcctttcaaatagcggcagcaccgggagagtttcctctgttctggttgtgtaattgtgtcgagggtccaattaccttcctgaatttttttttaatgtaagtaatttgttttaattgacaagataatgaatacctttggtttaatttatttttaataatacgaaagggaatatggtcaaatataagttttccctgcacctcaggtcctctccaaggaaaccactgtaacagcatccagtgtcttcctttcagaaatattctattcacagataagaatatttatgcctatgtagatagatagatatggatataggtgattctacatttctgtggtatcagtcacattctgaagaggacagaactgatccacttaaattcgggtgcggtggttcacacctgtaatcccagcactttgggaggccaaggcgggcagatcacctgaggtcaggagtttgagaccagcctgacaaacatggagaaaccctgtctctactaaaaattcaaaatcagccgggcgtggtggcacatgcctgtaatcccagctactagggaggctgaggcaggagaattacttgaaccttggaggcggaggttgtggtgagccgagatcgcaccactgcactgcagcctgggagacaagtacgaaactccgtctctaaaaaaaaataaataaaaataaaaaataaaaaataaagttttgtttttacaaatggttgaattacaagggataaagggacctacacagataatgcaggaatccagggctggcagctatagagctcacaccaccctgggcccaaggatatgatggggttgcagagattagagagctcagatgtgtttgagaactgaaatgagccacagttttttaaaaagtgtgacattcttggccgggcacggtggctcacgcctgtaatcccaacactttgggaggccaaggtgggcagatcacctgaggtcaaggagttcaagaccagcctggccaacatggtgaaaccccgtctctacttaaaatataaaaattagttgggcatctgtaatcccagctactcaggaggctgaggcaggagaactgcttgaacccaggaggtggaggttgcagtgagctgagatcgcaccattgcactccagcctggggaacaagagtgagattttgtctgaaaaaaaaaacaagaaaaacaagtgacattcttgtgacaaccaaaaacactgaaaataaaaacaaatcattataatatagtgtagcacagagcagacaagagaagtgactttcttactgaaggctgactgaggcagtctcacaagaaagaaccaggaaaatgcataacctgacctaaatcttctccccactctaatctgctgatagggtaagctcaatcaaggagaagtttaggatctctcagtgtactctgccttatggagctgagggcagggaggggaaagctgaagagtgattcttggaggggaaaatggagatttctgaccttcatgcatcaccacaatcaattcactattcacacaacagctagaacaatcgtcatttaaaacaaatggaagcatattataaacgctgttctgtccctcttgctttcttcccctggcaatatatttttgagattgtgtcttatcagtacacatagatctgcgttgtctttttaatggctgtcaggggttacattgtacagactcccttaatttattactaagtttctaaccaataaatatttttccctagattttttggctgacacaaacaatgatgcaataaacatttttaaatatgatttggggaaagtacactagtgcgtgtataagataaattcttagacatgaaatgactaggtctcaatatatgcacatttgaaattaatagactttatcaaattgttctccagtgtgcactctgatcaaaagtgcatgagaaggcttttcccattaaatatcagagagatgttcaatgaatctcattgaaatttaatttgggctgctttgattatgaatgatgttgaacattttctatatgtttaaaagttatgtgtttttttttctgtgaactgccctgttcaaaccctttactcatatttcaattatattgtttcttattagttcctgagtattcttcataggataaagaaaatggtcctttgtctaccatattaaaatatgcttaccaatttgtctttgtatttggctatgtttggtcactcaagatttaaaaaaaaaatatgtagtcaaatttattaatggttcctggatttgtgtcttcattagaaaggccctctatattagttgtttataaaaagtattccaccataccttattatgttttattgccacatacgtttaaatctttcatctatctggaatttattttggcaaaggaagaaggaggtctcactctttttctcacatgatagctgattgtcttacatcatttactaagtaaagcactttctccactgacttaacactgttaacctaatttgtataagtctttgtatttatttctggatttttaattctattctattgatctatctatattttaatacaccaatattagtttatatttactgtgggtctagtaaatattttatctactatcgataatcttacctgttaagctttaatttcagaatataatatccccgcctctgtttatttttattttttatttttatttatttatttatttattttgagacggagtctcgctctgtcacccaggctggagtgcagtggcacgatctcggctcactgcaatctcctcctcctgggttcacaccattctcctgcctcagcctcccgagtagctgggactacaggcgcccgccaccatgcccagctacttttttgtatttttagtagagatggggtttcaccgtgttaaccaggatggtctcaatctgctgacctcatgatccgcccacctcagcctcccaaagtgctgggattacaggtgtgagccaccgcgcccacctctgtttattttttatatcaattttagatttcatcatgactttttaagtttcccgttagtagtgtttgtggttatattctcccaacatctaggtaccttggatgtctttctcgcttcctctctctatctctcatcttccttctacctacatctcactatatactctctctcctagttcatggctacccataaacttttcctagtctgcccctgcagtgtgtaatcaaagatacaccaggttggtcaggcgcggtggctcacgcctgtaatcccagcactttgggaggccaaggctggtggatcacttgaagtcaggagttcgagaccagcctggccaacatggcaaaaatctgttttctactaaaaatacaaaaattagccaggtgtggtggcaggcacctgtaatcccagctactcaggaggctgagacaggagaatcacttgaacctaggaggcggaggttgcggtgagctgagatcatcccactgctctccggcctgggtgacagagcgagactctgtcatttaaaaaaaaaaaaaaaaaaaagatacagcaggttgtggtgaaataaaatgtatctatggacgtgaagcagataactcaaacttgatacttaaaacaagtatgttacatattcctgtgcatttcagaaaatttactttggggcacaatatttcttgtatctttttgttatcgtcatcttttttcctccagtaaaagagatgagatggaaataaggctaaatatttttttggggagaaatatagtttacaattattctaaatttaacccattttgagaaaacaaattatgaatttaaatttaaaatttacttttttaagagtttctatcaaaacctatcaggtttgaaacttccttgttatataagaaaaagtataacctcaaactgaaaatgccactgattatcactggtttctacacacagaatatctgaggcatcttaattaatttacctccaagtaatcaattaataatgtaacccctttaatccttttgggtttcttgtggtctcattctactccaggtttttaagattttctacttggagcattaaaatagctgttgagtttattttgcctttagtttttccctttcctgtctatcctgcacctattactaccttaatattttaaatatgtagttatcaagtaagttcatttttgaagactttcagtgctttccatgcctagtaaaaaatgttctaaatgccaaagctagttaaaaccattcaattaggggtgaagagaatatatctccgtggtgcatctcttgatggctggctttattttgcctctggataaagttcaaaaatcccttgaacagtgaatggactgtatatcatcacacaatctcccagaaatattgtttcctgctatttaacttcttgataagaaaccataatcaaatggcagagtttacaccgtaggtactcaataaatataagtcgaatgaacaaacaaagctacattctccaagaaaatccctaatgtaataattaatacattttgcaatctgaacccaacctatggttgtacatttaacatctatcagttcagttttttcagctgcatataacgcaacacataaatgacttaaataatagcagccaccaaatgtattatgtcataataagaaggcaagatataggtccacatcaaagtagaggaactgcagtcctattttagttaggatatgtatatttgttgtttttttctttttctttctttctttttttttgggtggtgggggagggagtttcgctctgttgcccaggctggggttcaatgacatgatctcggctcactgcaacctctgcctcccgggttcaagtgattctcctgcctcaccctcccaagtagctgggactacaggcacccaccaccacagccagctaatttttgtatttttattagagacgaggtttcaccatgttggtcaggctggtcttgaactcctgacctcaggtgatccatctgcctcggcctcccaaagtgctgtgattacaggtgtgagccacagtgcctggcctatttgttgttataataaagacccaaaataacagtggcttaaaacatccagaattatatttctctgtcatgaaaacctttgggtaggtggcccggggctagtatgctacccaaagctcagattacttagatattttcctttcattcactgaatgaaagttctcactatcacaggttcatttctggaagaagattgggaaggacaaaaaaggagaaatagttcatatccttcccctttaggagcttcatccagacattgcacatggcacttccattgccttcaacttagccacagggccatgtaacttaaagaaagcctggaaaatattgtctgtaactggtggggttctatgtcaagacataaattctattgctatagaagaggactgtaaattttgcataacaatgtgcaacagcttaatgactttgttaggatgcctgactctttccttcttgatccttggagactgaaatagtatccccttctaaaaggcacaggccacgtgaaggaggctagatacttgagcaagagcagggtgacgacaggaagaaaggggaaagggctgtggcatgggcatccacaactgtctgctgtgatcctcattcctgtgtgcagactttcttctctagctaaactcactgatttattacttcacaaccacattctgtgcttaactaaacatgcaggcccttgtcttccctccacgtagaaggggattcctcctccttccaggctactcaagtctaaactttctttcaaagatttgttattccataaaacttccatacacgcataaaacaatggcctatgatcttcattctgtaccagtttttctaatatctggcatatgtatatagaactcatttgctaattatgtttgcatgaataaagacaatttctttagaatgaaactttctttattctttgtttctcagagtttgttttagagtgtcttatgtggaacaggcgactgactgatttgaaagaacttagggttgtttatttaggtttaatacagttcaacctggagacagatgaatagacagatggttttgcaggttcttttcctgtgggccagcaatctttcaaaagacattttatttacaaaacagtgagaaatatattgtaaaagtataactctaagtaaattagcaaaatgagataaagtgaactctagttcattataataaaaaagatttaaaaggcagaaaacccaagttaagttgcttatctcatcatagcaaaattaatgattaatagatgtagaccaaatatgcttgctttttttttaatgaaaagtttgggcataatgtcagaggtacagtaaatatcttagcatttaaacatttctataaataaatgcttgttgaaggagctccatcaatattacaatagtgtttctagttttaccactataatgttatgtaataacaacattttaaattagttactggaattgtgattatttttctaaataatttctatttgaataaaataaatagaaggcaggataaaataaatagaagacactccatagagaatatcctttcaactgaaatcaaaatctagttagtatagaaataaaagtactcaaatattgttgagatcaacatagaaggtaatgcagaagaaaatactatgattatggaaacagctctgagagtcacgagtatgaaaaacagtattcaaggaagcaagaattctaaatatatttcttgtcttaataagcaaaaataaaatttcatgctgagatgaagggaacaactcataaattaaggaggcaatttatactggaataataacttataaattgttttaaataatgggccaatcatttacaaaaataagctatcagtaacctagaagcagtcttttctaaagtttagaacaaggcatatttaatgtccaggtgtaaagttggcattagtctaaaagcaaattaaatatcctagcactgttatatgtatgtggtctaagcatggggaaagtcttagctgaccctgagattgagaatgctgaacttgattttatgaagaagtgaaactgcctttatagtcagtgatcactttctatgaattatatgaagtctacagtcaggtgcagaaatgatttaacttgctaaatgagattacaaagattattatatgtcactctgagtagatcagattaaaacatggcaggaggacctatggaaaagcagtcttaggagaaatgactgaacagatcgtgttagccctggctgcaggctgtcttctctccttgtgctcccttcctgggctgtttctcctcctactcagcaactgcattctcctttgagcccccgctgcagagaagtgcgatgcgctagagccttgctattccaaccgtggttctctgcccgaccacatgagcatcacctgggaccttgttaggatctcagaatcccagactccaatcctgaccgcaagaatcagaatctttaagattttcaagagattcctatgcacacaaaggtttgagaaacactacttttgagtgccaaggattcggtttatacagaacagcagttattctgatacacacggcactgttcattgcgcttggtaccaccagaacatatttccatgtggatttctggagtcatggtgctatgactatggttttcatttcaggttttacaagaccaaatatggttttaaaggtaacacaaagacattttattttaaaatgtctattttaactttaagcactgtagataaaaagccttcaacgtgcgttgatgattaccaaggcatacagttatgctgtcaggctaacattttttagatttgaaataaaagttcttccactatccctgcttaattaaacaatgtccataaactaccaagtaagctactacaaacaaacaaatctggtaccatttgcagcttcttctatttgtgattcccaaaattcccaatgctttgcaattaaaatcaagttcagaaataaaagagatgctatgggtaaaataaaagtgcaactgtcatccacagccctggattgaattgcaacatccatctaaccagccactctgtccatgttgatttattttgctttaagtaattgcagcccatttgaccttccaaaatatagctttcatttgtcttatgtattggagtctaaatgaattttatttgaataaaatgcatttgattctaaagcattttgaaagctggaactaagtatgagttcgatggagaaggcagggctgtctggagcccgagttaattggatgcatcacttcttctggagtcacttgatcacaacaaattgacacctgccaacttctcccctgtaccttcctgatcccggtcaagtcattctcaagtagaagcagtcgagtcatttttattcatttttgatgtgaaccaaactttcaagctaggacttgccatgaaacaaattacacattccttgtggctactaaaaaaattagtttattagcgcaagagtctggatttgagaataaaatcatagatacaaataatctatatttctcacagtaaaagagatatttcttctgaaattacttgtttcttggtggtgtaacattctagcattgcattcatccattctttcagtcaatgtgtcaataggcagttactgagcatgcacctagttatgtaaagaattataagataaaaacccctaattgtaggaatctcagttcagaagagacaggtgctcaacaaaccattgctaagcaatgtaataatggtgtattggacataggttactagttctgtggaaatacagaagaaataataggaaaggggtagctaggttaattagtattttgttttgcttggtaactggtcctaacttttaaaatatatatatatggcgatagggtttgcaattatatttgaacaagttggttaggaaataaaacattttccaccattaagaattagaatacctataatcatcacagggagaatgtcaattttcaaaataagaatcaggcccgtgtggtggctcacgcctgtaatcccagcactttgggagtccgaggcaggtggatcacgaggtcaggagatcgagaccatgctggctaacacagtgaaaccccgtccctacaaaaaatacaaaaaaatattagccgggcgtggtggcgggtgcctgtggtcccagctgctcgggaggctgaggcaggagaatggcgtgaacccaggaggcagagcttgcagtgagccgagatcgcgccactgcactccagcctgggcgactgagcgagattccgtctcaataaataaataaataaataaataaataaataaataaataatcggccgggggctgtggctcatgcctgtaatcccagcactctgggaggctgaggtgggtgaatcacttgaggtccggagttcggcaccagcctgaccaacatggtgaaaccctgtctctaataaaaatacacaaattagctggatgtcgtggtacacacctgtaatcccagctacttgggtggctgaggcaggggaatcatttgaacccaggaggcggaggttgcagtgagccgagatggtgccactgcactccagcctgggtgactctgtctcaaaaataaatcagtaaataaattaataaataataaaaataagaattataagaaagaaaaatattaaaattgtatctaaataaaaaatacttttaaagaaatccttaatactgaatttttgaagtacagttggacctctgtatttgtgaatccatcagtggatccaaccaatggcaaatagaaaaaaattaaaaataatacgatgataaatctaagtaatctagagatgatttaaattatgtgggaggctgtgcataggttatatgcaaatactacaccattttataacagggacttgaaaatgcgtggatttgggtatctatggggtgggtggggattggtgtggaacaatcccctcacagatagagagggatgacttgtattcattaatctcacttgatggatatatcctttttgcatgcgtgtaagaacacagtaatcttttctatcatcgagatgattttctactctgcccattatttacaccacatttagattccagcctggttttcctctgctacttagtacccttctgcactacttcccccgaattaattgatataatgagctgatgtaaattactttcaatattaggctgagctaatattaacccgcaataatttagaaagtaaatataccatacaacaccatatacgtactgaattccaaaattaagtatcaaggatgttttagtttcatgtaattttgaagtgtctagcccattgcttccttccatcatatgcagaaccacctgctctggatgtaaacaccttctgctgtgtgtgttcccacgcctcagggcctgtacagaatagtggctataggaaaggaccctcacaaccctgcacctcccactgctttcactcttccacctccttatcagtgcttttctcgcctattctgctaggaatgattttcaacattttaatcataaacatacaactcttcttttcaggcccgggtgaaatgttctgaactttatgaagcctttgtttatcatccacttgtaactcctctagtatccaaatttctatagcatttcgtgtatcttttatgactcatcaaattcttctgggtttgcatttttcatgaatcagatccccaccccacctccactcaaatttggagatgaaacatctttgtagccttgataacactgagcccaaattttataaaaaagtaagtgtctattaaatttagggtgaattttccatccctcatgataattcaacaagatgcttttgtttatattgtatttttccccaatgttcttcctctcattttcttctcttgtagtcctgtccattcattgagtctcaacctaaaagcttttaattgtgcccaaaatgtacatgattcctcatgtgaaatcccgtagtactttatttgtccctgaattatgctgtttttcatttcttccttgcactgtagttttcatacatactgtatctacttctatatgaactatgagctcttctgcaaggctgtgaatacagtcgtagtcatcttctattttccgtagtgctgtgcatatagcaggtgctcaatcaatgtttgtttcaggagtaaaagtttgtaaaaagttgtggaagaacagcaagctactcagagccaggggctccatgccaaactgagccaagcccagctacaggtggttttaggcatggctagtggtaaattgagaacaggagttggagaatgctatttctgaggccagctctatcagattttgtagcagggagctgctagggcattatgataaaggggtggctctttatctgtcctttgccagtgacccatgattatagattctgctattttaatctgggaaagttttcctgtttttgagagttccctactaaagtctagatgtcctttgtgaatactggtacatcacaatgaatacctttgttatctgtgagcatcttcagcaggattataacaaaaatcaggttgtggggtagatggagacaggaattgatgggagggatgagtggatggaaccaggagaaagggtttgtgccattgaaacaggggtgtttcaggacaaatttcagcctcacaatttctgaggtacagtaaagctgtgccctggaggctgtgtttcagaaatctaaagcttccgtttattggcccactatttcctgcctattagttgtctgttaatacttcatgaacattatcctcaaaccttaaaattatttgtaagatagaattatcctatttttcaaaggtgaaaactaaggttcagaaaggttcagttaagtagctacaattagtcatcttaataaaaagatatagatttgaacacaaaacctgtatctttccttctgtattatgcttgctgcctctttcagcaggctgctttagttatccagtgggaaataggtgtttgggagacttagaaatcttttctttctaagttagtatattttcattgctgttatcatgacgttatttcaaaaactcaaattgctatgaaaaacttgatgatacccctctttacgtcagtttttggcttgacaaagaatagaataaaacaagaaataagacagcttatcttcgatctttcaccaggagggaacttagctgctgtctttgttttggggtaaaagaaaaataaaatgaatctgtgatattcaagtaaatccctcagttgtttgttagtgtctactgtttactcaaaaatgggaagctccaggtcggtgatacatcatctttgttgcgcttggcaccttctttcatgaatcatattaatctgcttaaactaacaaggattaattgccttggtaaggcaacctggcattgaaatgatatattgcccagacagcttggaatttggccactcataaatctcatttgtttgttggtttatttctgtttgtctctctctctgacagatgtgtgcccaatcactgtgagcatggtggaaagtgctcgcaaacatgggacagcttcaaatgcacttgtgatgagacaggatacagtggggccacctgccacaactgtgagtgccaatttatctcactttaatcttgtaattgcatgagaatctcaagtcttgagctgtgctttgaagctcagcaacctgaataatccacataatacatcactcgaatctgaaaaaccaagattccaattgtcatttctccaaaaaaaaaaaaataaaatacactattctacttgttaaaatatgttctctggtggcaaaggactcaaaaagaaggaccagcatttcctctgttccataaacacatagttgagattggaagtccaaacttggattcgcctctctgtgtctaacccacatctgttgggtcgattgtttgggaaatcgtgttagtgtgatgtctctgactggaccctcatttattaattaatccgagagggagacacagggtaattggaacatttagtttctggatgatggctgcctcatgctttagcccaactatttgactacctttttttagatcaaagaaatgagtccgaaatggaatatctaaaagccaatagataaaatacataagaaggtaataaaatgaagacataagagggtaaaaatattttaaaatggcaaaaataaaaagtaacatgcaaaaatgactaggaaaacacatatgtgccttggtttatataaatagctttattccaaaaggttaaataaaaaataaatttctgtacttaaaaaatttaatgctaactcttataattataatattaattttccaataatgcatcgccatttgcagaacgcttttgaaaacaaagcacttttgaaaacatatttggcatgaatcacataattacaagaagagagtcaactgttggttagtgtgtgcatacgtatgtgcctgtgtgtgtgtgtgtgtgtgtgtgtgtagggaaggaagagcaagagaaaaagagagattcaaccttctctcaatatgcccaaacactgaaactctaatatctaaatcctccgattatacaaacagatttcactttacttttaggaaatggtgacaagcaaactatctcagagtagagccctgtgtacagtaaaaatgtcatacagctctctaagcctttccattgtgttatttgtagtaatgtgcaagaagaaatcgtgttttgaatatattgtaaaatgttgacttacaaagttgcacacatttatttgtttaggtagatattcaaaaacaagaggcaaaggaaatcttgacaaaactaacaatagaaagatgtcaagaaggtcaaaattgatactagattcattatctgtgtttacatatatgaaagtattttaatgaataaagaacaaaaatgattgatactgaaattaattcaaagagttataactaaaattgttccttaccaatcacatcaaaatattaacctccagtatgtgacatttattaaatataacgtgatgctagaattacattgatgaaactcagtgccttcactccactagcataatttttatcgtgtgttataaataccatatttaattacacgggatcttgttcctgaaatacgataatgctaaccaatggtcaagagcaagaaatcggtggtggttgcaaggattttctatctcagtgatggcttttacattgaactgaaaagcaacttattctttttttataactgtttccatccttaaaatacacagcaaaaaggcaaaaaaaaaaattaaaatgtatgctactggttgagtagctgaggtttgttttgttttttaagggtaatgactccaaggattagaaatgtcctaagtgtgtttaggtttggtgctagtggccagctccaaaggtaaaagacaaaaattgtcttttgttctgctgctccttcctacttgttccttgctccattttgttggatctttaaaagcagaatcattctttttaataataaaagcctgatcttttgttgtcttctccaaatgaagccaaaattttgaatatccaacgtgtgcataaatagaggtgaaaagaccatactacataattcaagagagggttggctggtgactttttctttcgaaaaatatacattgtagcttattgaaggccatttgcctcctaataacctgaaagacttgatacagtcttacttatccaaatggattagttaaaaatttcacacagcacaaatgtaagaagatacaatgtatgccattcagtttgacacagaatgaacaattttacatttttgcgaaatcaatgaccacattcaaagcaagaagaacgaagtgcgaaggccccagtttctgatgtgtctgacgctagctataaaaccatcaggccgtgtgcctttgtggtcaatcatttgacttttcttgcactttgttcgactgaagtctcttggtattctacaagccagtgagctgagatttgcagttgcttattctgtattctgtgggtttgaactgtgtaagtaacataaaatattttgcttcattatttcctgcagaagaccaagcattcatcttgaaaagaaatcatgctaattattttaaatagtatttttttttaaaaaaagcagctaactaagagctaaagtttaatataatagaacatttgttagagtttcaaacattacaggctacaatattttagcacaccttctacactagcccgggcttggtcaggatgagacagcagtgctatgagtgacctgtgatcatccaggctagaagctctagttcaagatggaacagagaggcctttttgcttggtcactctgccttgtgttgactttgactttaccattttcttacttgtaccctaggccatttaaattatttgagcttcagttttctcctgtaggaatagataattaacagtgctcacctcttcaagccattgtgagattaaatgaaatgatgtacggaagatgctgagaaaaactttggcttatgtggtactcaataaatttttgtcatttcatcactttcagagcaattgtccttttcctttgaacttctataccaataattgcccaaatcacacaatgtgtctcttaatttaatgtcaccatacattgtttgctatcacttttatggcagatttggactgcagtgaatgactggtttccatagtatttttctccagaagaattgaagagtatgcctcctaaacctatgtctcctgttttcatttgttagtttgtgtgtacatggggactttgtttttacgtaaattatatgtagggcttagaggactgtcatttgtgaactgctcccctgaggagccaggatgtctccctttgggatgagtagacaactcaatcccacagacaaagccaaagatcacagaagatagtcagatcacaggaaagggaaagccagtttttgtcgtttaagaacaaaagaggcaagtttgttacaaaatgcaaatacattaaattgttgaagttttaaacttgaaaaaattttctcatacaggcattccactctccataaatcctttaagatctgaatagtagcatatctgaacaccaaaccatgacaaagggactaaaatgatcatgttgaacagtttgtgtttattgtattgacttatccctgcttcagtctcccaaaagcactgtaagaatgtatcttttgcttggagatggagtcttgctctgtcacccaggcttgagtgcagtggcatgatctcggttcactgcaacctccacctcccaggttcaagcgattctgctgcctcagcctcccaagtagctgggactacaggcacgtgccaccatgcccagctaattttttgtattttcagtataaatggggattcactgcgttagccaggatggtctggatctcctgacctcatgatctgcccgccttggcctcccaaagtgctgggattacaggcatgagccaccatgcctggccaaacattcttatatatactactagttccttgtgtggaactgctctaaaaattccttagaatatcctcaataatatgaaaacttttggctaatttaatgaatgcaagaggttaaaggatagtattttagtgttcgacaaaaataagcaatgttagccttggaaatttattaaatgtcagatgtgcattctgacagaaaatatttttgcagatctttttattaaaggagagattttcatgttgcccaaatatatagacgtaatgtttccaggggaaacaggaggaataaactagatgacctatataattctcttttaattttaaaatcacgagatttaaaaattctgaaatactagtaaggaacaggtcctgacattgccaaataaagcaaaagtaaaattttttctagccaatgttagagaaaaatttaaatgtaaacggtaacaattgtacattccgtatgctggagcatttcctctgggttcataaatgtgtaaactgtaaattgtgttgcaccttattacagcacacgtgagaggcgcagtggatttcaacagcccataccatgttgttgataatccatttcacctataattgatataattcaaagaataattttcaaaataaattgaattctatttgctgtagtcatactaacatagagcataaagacctagatttattggcacgaagaaacttggtgtctctgtccatttggagtttctacaacttaggcatcaatgataacttggagtttgagcattgctacaaaaacaagcagcattgggtagaattgcgttggatatggtattagtctgttctcacactgctataaagtaataccagagactggataatttagaaagaaaaggggtttgactcacagttccatgtagccggggaggcctcaggaaacttaccatcatggtggaaggcgaaggggaagcaaggcccttcttgacatggtggcaggagagagaattgcaagcgaagggggaagaaccccttataaaaccatcatctcgtgagaactcacccgctgtcatgagaatagcatggaggaacttcgcccatgatccaatcacctccctcccttggcatgtgggaattacaggtccctccctcaacacgtggggattacagttcaaggtgagatttgggtggggacacagagccaaaccatagcaggtatctaaaataaaatttagatatttagccttagggaattggaatccatcctttggggcaagttcacctggcttgccaggtcctacgtaatatggccatgtctttaacctgatttcctcccctacatctcctcccattctccccttcaatgcactggcctcctttcagtttttgatgcatgccctgcactctcatacccttgcccctcctataccacgaccccccaccacaggacatttgcacatctacctctctgctttgtctagtacatttctactcctccctcagatttcagctcagcagtcatctcagaaaagctttccatggccctgtagttagatcaaatcctcttattctaaaacacacatatgtcttttagcactagcaatggttatgattttgcacttattattcataatgatttaataatatctttctcctccactggtctctgcatctctggcaggaggtggtgccacatttcatccaccagtttaaatctgaggctcgcccagcacagactatgcacgcagtgaatatgcactgcctccaagcattcttgaatgtcaaagagtatccagagcaacagtgttttctttaaattttattcaatgccctctttacagtaaatttatgaagatagtgaagctataaggagagagtacacttacagggcaaaaagaaaaatagaatcaagtccaataacaaaatatgggtaaatggaaggcagggtactaaaaataataccaaaaactaccacaagacattaaacattattctaagaaattatatggaggaatttaggatattagcaaaaaaaatctacatatttcaaattatctttaaggaaaatattgtgccatgttaagatgccccattcattactgaaatttgtgagaactatgacattatagtaacaatagcaaaggaagttgcaacaaagataatatcttagatcagcactctccaacgtttttggcaccaggggccaggttcataggagacagtttttctacagaccagggtgggggaagtgggtaaggggatggttccagatgaaactgttccacctcagatcaccaggcattagttgaattctcataaggagtgcacaacctcgatccctcacatgcacagttcacaataggtttcaggatcctatgagaatctattgctgccgctgatctgacagaagacggagctcaggcgggaatgcctgcctcctgctgtgaggcccagttactaacgggttggggaccccttacatcatagagtgtggtcaattactatactggctaactataggagttattctaaaatagatacagatatgtttaaatattgactagtacatgacaagaagtttattttaaactctataaaatttgaataacatgaacataaaaatcttttgatttatcatgtaatattatatgtgtatccttgctacagggaagttatggagaggggaaaacactcagggtttgaaattagatgtcctgatgtcaaaccatcagatccttaggctatgtggccaaacttacttccccatcagttggacatgtctaagttccagaaaaatgactgtctccatactttataaattctctgtttcctcaaacacgcttgctgcattaagtgtggatttcactcatacttatagaaggtgaagtcagcttttccagtccatgccacaggttactgacagcaataaaataggaatgattcagatttaatcactttcctccccatctctccgcccccgctcctctgtgctatcttggttttgtgtttttagacacgtcatttaatgtctctaaacttaagtttccttttgaaaattcaatgagatattgtttattaaagtactttttaatgtaccccagaacttaaagtataataaaaaaaagtgctttttaaattcagaaaatgtcctacttttaaagaacttatgccactaagtttcgaaaaacagctagtcaaattttactttgagtgtaagtcgcatctactgatccgtatactcttcattcggtacacaggccatattttcatatcagtgattctcaatgaaaagaccataggatatctcagtatttcaataaatgctctttgaaaagataaaggtttttattagcaagtataatagccacactagctgatttatatgcatggagtacatctactctttctaatcgagatatggtattatctagtcaggttgtgcttctgtgttatcaagtgagcaactaccaaattccttcaatttactttccatcccattcccacaccatgatctgtgtcagatgctcagtgtgtccctgttattaaggagtgactatgggatccaactgcaggaccacaggacactaaggacccatagtgctaccatcacttattcattcatcaatatattgagagctgactccattccatacatggaatagatactggagtgtgaagtagagagggcaggaatactaggatgtagccccctccaaaaatgtgtatagtttcattaaaaataaaagttcttatcaccttatttccacatctctggttcaccaggattgtgatctaggaataaattctatgtattcttacctcttagaatctagcttggcatttttcacgcttacaaaatatggatacatgtagacacataggggaaaaaaatgatttaatactttgtcacaaattatttgttttaagcaattattttaacttttcagattgtatattcagaggatttgtttgctttatttctgggtttgtttttctaaccatatggacagggagaaatcagggtgaggtgatgcaacttcagcatggtgcttggtagagaatatggttttcaatagaatatatgcaagtcaaatgttaataagcccttgctcagctgtatgtattctctagaggaaaagctcgcattctcaccaggactaaagcattgggagctaagggaaataatggcaagtgatgtcacttcctgaaatcactttttgcacaaggaaacaatcatcccagcagctcctttactctcatattcatctggcacctacacagaaaataagatggaaagagctgtgaaagtactacctgggtagaaatgttggaaggggatttaaaggccattctatcttttggccacaaccaaataaattacactggattaaaatagtacaggtcatttggagaaacacagcccaaggacctctacatttctaaggcagaccaaattttgaattaatcccttcttgcttcggaatgatgaccaagattaaatatagaaagaaaggatttaatttcaattttgcaaagactctttcaatagtttcaaaaatatgtctttctctttgagtcttggcaaaaaaaaaaaaaaaaaagttgatctgcaaatgcatattgaaaagcagtgtgctgtaaagacatgctgtgatcctatgaacttctccgaagctataaaatgccagtgctaggtcttgagggaactggcattattcattaaactccctgtagtttgaatcccagtgtatgttttatccaaggttcagagtgaagagaaaaaggaatagaaaacacccattttaacacttttgtcaggttgaattaaggaaaaaaatgatatagggaaagagtctactttaatttgaagataaggaacggagcttcaggaaggttaatatctgctcagaaaacaggaaagagaattagagtaaaaaataatatgtgtctctcctttgatactttttaacttctctgaaaccaaactgtgtttggtttccattttgacattagttaataagtttctatgacaagtctttagcttttgaaacttggtgtacaggattatctttaaatcacagtttcaactcattcaacaatattatgcatctcttttgtatgtggcacactatgtgaatacaaaagcatagacgagagccattttccttatgaagtagacaaggtagttttaaaggaaagcaggataagtaataaaagcattaatacattataagaaggtaacatgtatttatgtgtccaactagtatcaaggcaagtgtgtatgatatgagagaaaaacaatatgaaccaagatatttgggaagacgttcaagcaggaacggaactctgagctaagttcctttcagagttctgtagagaaacagaactaattgttaaatattcaaaaaattttgaattgattgtttaaccttggtaaaccttggtagcttgaagcagaactttggtgtaaaccttggtagcttgaaccagaccacagtggaagaatttatgctagggaaattgacaaaccctgtaaagcaagatacttttaatagagctggtttactagcacaccactgccctgtttcattattaataaaacaagaataatagtatgtgcctgccaatattattgtgaagggttcagatgatttgtaaaatgtctaacatgttgtctactatgtagtcaattctcaacagatgacagccatggttataaatgtaatactgtgaagagactggtcttgttaaaggagcagcagggtgcagatttgaatcatgggtgaagctggcccagaagacagtggtttttcagcaccgctgtaacaaagcataacttcagatgctattcttcataagtcatttttttaaatcgtgaaacaacttatatccattagaacaggagtccccaatccccacaataccagtttgtggccttttaggaactgggccacatagcagaaggtgagcagtggtggagtgaagcttcacctctatttacagccactccccattgctcacatttccacctgagctccacttcctgtcagatcacgggcagcatcagattctcagaggagcacgaatgctattgtgaactgtgcatgcgagggatgtaggttgcatgttccttatgagaatctaatgcctgatgatctgccactgtttcccatcacccccatatgggaccacctagttgcaggaaaacaagctcagggctcccactgattttacattatggtgagttgtatgattatttcattattcatcacaatgtcataataatagaaataaattgcaaaataaatgtatgtacttgaatcatcctgaaaccatcccctacctcctgatccatggaaaaactgtcttccatgaaaccagtctctggtgccaaaaaggttggagaatgctgctttagaagaaagaaaggtcactgaatgatatttaagttttcccataacaggttatgggctctcagttatttctgaagtaaggagaactggtaaggctgctgaaaatgcttacagtgcatttttgaaaaccatttggatgatttgatatcacttctttaactattaacatttctttactgaaagtgatacagacgcttttattttactaaattacttctcaattatttagcttatagtatgatcttaggtaacaaagctaattttatattctcttgtgattattaacctaaatctggtataatgagatgcttcctcccctcaggagcggtccagctgtgactcagctgcatcaaatttatgtcttctgaaattaagacacctggatttgtttgctaaactctatttaaaaactactcagtgaggattctcttgattttgcaccattcacaggaagaaattctgaaagttgaattattggttcccgtattttttattttttatttttttttataaaatcatgataaacagaactcttacttcatccattttgttgttgctgttgccgcattttgctttttcttcctcctttcctctccctcttggcaaaagaatgctacaaaaatataaagattgttgtaatctggggcgaaattatccatccacctaaataatctcctcctgttatctttgatgaatatgtctaacaccattaataagcaatagtttcttataaaaaatgcagccgtttccaagaaaattttgatgcttgacttttggggtattctctcatctgacttctttcaaatgtttgtgaaatcgctgatttggaaatctttagacttagccaataaaagtgaaataatgtaaatggatatggatttgaataaagaatatggttttatttttaagtaaaatgagaaaaacattcaagggctcgtagtcccttagtttcatcacccagtttcatcccaaagctgccatagaagctcctgtctgaaaaatatgcctactctactcttgaaagcccattcttggcatcacggatgccaccaccaaatgccagacaatgttggcaactacagaattgctgtcatttctcattagcaggcatcaaaatgtcctaatactctctgccactatctgggcctgttgagatattaattaaacatgtctttcttgccaagtcatgtgatcaactttcactaggctaggtagagccaagtgagcccatccaactacactggataaagaaatacctctaagaatttgtctgtgaagaggaaaatgcctcccatttgtattactgcaaaggaattcagagctctagaaaagcctgtgtgtgttttctaccatatggctatctgttgctgagttatcccacttagagaatattcaagcatttgatggaaacatatccctactcagaaaatgagctcctctagagtttgaatgacatagatagagatttcctgagataataaaacctgcattggggcaggccagactgattgtcctacaggttcctaaattacctgaagctaggtggacagcacaaactttgttaatttattgtccaaaagcactatttttcttttgtatagttctttaaattaagctgacttaattaagctctgtgtaagagcaaaataacattttctggacttccacaagggagagattctcaataataaggattcctgccttcccacagcatagcagttccaggagagaagtactgggattgcatgcgtattagatgcccttgagtaaggcaagtaggaaactccagacagcagtacttgctgcttggttgttagtataggtgtctactcctgtgtgttacagcacctgatgggaaagcccaagctatgataaaaaaaaaaaaaaaaaaaatctcctctcttctcagctgaccatgtggctgattagccacaaggccagtcatcccaaagggtgctgaagagaagtgggctgggaggggaagcccagtgatggatgatgaaagtgcagtcattgcaaaacaagtccttctcttattgttgctagatccactgcttatgacctattttccgcttttaccagataaaatgtaccatcaactctgtcttgaaacttttgctttcctgcagtgtgattgccacagttccactgaacagaggtcattttcgctaagcttcctttctacagtctaaactaggtttttgagctaacacgtattttagaagtaaaaataatactacagaatgatgcatagggcaaaaatagtatagaggagaaatttattgagaagcatttggattgctattagtaatcaagaaaaatgtttattaataagtaacatttctcctcttcctttatacatatagatgagatattgaaagaagttgaacatagcagaagcatgttagtctaaagcccaagtaatctctttgctatttaaaaattctaaaggatttgaattaggatttcagttcacattcaaagtggtagttttttttcccatttgtcatcaccctatgcttctcatgcactacctaccttaagatgaaataaatgaatatcaggtagtaaattctaccacatgtggttattatccaaggaatgggctcacattgacacttgattaacatcagtttcacatgtggtaataaaaaaaaaattaatctgtgcaaactgtaattgtcatgctgggatcatttagattccagcagtctctctgttgagcagtttaagaaaactgtgttttcattgtactttttaaatgaggaagcccagtggaaaaatcatatttgaatcttgagaaatcttttgctttctaaaagtgcagtaaatgaatataactttgatggttgggaagatgagcttgttatccacagacttaaaaaattaagaataaatatacaagttttttggaggggtaatttagtagatattttaaaatacttaccagccaggcatggtggctctcgcctgtaatcccagcactttgggaggccgaggtgggtagatcatgaggtcaggagatcaagaccatcctgtctaacacatggtgaaaccccgtctctactaaaaataaaaaaaatagctgggcgtggtggcaggcgcctgtagtcccagctactcgggaggctgaggcaagagaatggcctgaacccgggaggcagagcttgcagtgagccaagatagtgccaccgcactccagcctgggcaacagtgcaaaactctgtctcaaaaaaaaaataccgatataatgatgtattaaggttagcaactatgcctaaaaaatgagtcctctgaaatgctaccttcttacacaggtctgcaaccaccccaatttcccaaattttaccctagttctctcccccaagcatgtggctacctactagttttaaccaaagaaggaaggctttaagcaggagggagaaagaatatggagacgttaggagagtgggtggggagaaaaggaggagagagctgcactcttcatctgtatataagatcatgttacttgcaaacagagacaagttacctctgaatggcaaggctgagaacactagtgtttctagctctgtgctttctacagtgtgatttgtggacaaatagagggctttatatgcattgcaagtgaccctgaagataatataaatgcagcttagaagaagtagaaatgtatctatttttaaagtaatcttacttcttaccttagatttaaatatatacttaaggtcaaaaagtatttttaaaatcaaaagaacagtatttttttccatgtaaaaccagagcaagatttttttttaaaaaaactggtagtaagcagaagtgatttcattaatgcctctttggaaacagtttatggataaaattagcaatatgatctatcactgacatttactcttttatcctttatgcagaagggcttttcatttataacaatgagagagattataaatcagttattaaaaccttatcaaagacaaaggcatagacatttttacattaaaattatgaatgcaaaaacagaccagcctggtctcttacaaaccatgaacagtataaacacattgacagttcttatactagatagatcctaaataaaaatgaaatcaaataatactcattcctggaggtatacctcatataagtccctttatgtcatcagcaaccctattgtattgacataagctctctatccactgttcttcttaatgccaccgaccaggtgcttttcatctttgaacacaaatgcctatcccactgcttagtgcttggtaagtattaaatacaatttggggcaactaaactgtaactgtgtctgaatgcacaaacacacacacatacccccaaatatatacacatacctctcaaatgactgtaaagataggttcatcagactcggaacatacaaagcccttgctacataagagaagctttctctgtgggatacagcatcttaaattcttttcaattctcaataagagagaagaactttattttcatttggtaatgttcctgatatatagtacatgatattctttatgccaagttttgttctatcaaaaaatatctgacacttccaaactcattttatgagtccagcattaccctgatactgaatccagactaggagactacaattaaaattacaagtcagtatccctgatgagcatacatgcaaaaatcttcaagaaaatagcagcaaaccaagttctacagcatattccaagaattatacaccaagatcaactgggatttatccctggatgcaaggatggtttgatatatctaaattagcaaatgtgattacaccgtataaacaaaatgaaggataagaatcatatgatcatttcaacagacacagaagaagcatttgacaaaattcaacatcctttcataataaaaactctcagcaaactagatacagaaggaacatacctcaattcaataaaggctgtatgtgaggagcccacagctatcatcatcctcaatggtgaaaaactgaacgctttccctcaaggatcaggaaaaagacaaggatccccactcctgtcacttctattcaacaatgcactgaaagtcgtaagcagagcaattgggtaagaagaagaaaaaaacacatccaaatccaaaaggaagaagttagattttctctgtttgcagatgacatgctcttatagagagatgtccctgacttcaggtggtttgacttacaactttttcaattttatagtggtgtgaagccaatgcaatttggtgtacttcaaattttagatcttttcctgaactagcaatatgtggttcatgagataattcacactgtattaaaaaatagactttctattagatgattttgcccaactatagggtaatgtaagtgttctgagcacatttaagtttggctaggttaagctatgatgtttgctatgttagatgtattagatacattttttacttttggtattttcaacttatcagtttatcagtatgtgaccccatggtaaatccaggagcatctacatatagaaaaccctacagactccaccaaaaaactattagaattaacaagcaaattcagtaaagtggcagtatacaaaatcatacaaaaatcagttttgtttctatacactaccaatgaactatctgaaagaaaaattgaaatcttcccacttgtaatagtatcaaaaagcataaattacttaggcatatatttaaccaaagaggtgagtgaaggatccatacattgataccatgaacatggatgaaaaaaagtgaagacgacacaaatagatggaaagataacccatgttctcagattggaagagtttaacagttagtcccactaaaatatccttatcaatgcaagctatacaatcaaggaatctctatcaaatttccaatcagatgttttatagaaatagaaaaaaaaatcctaaaattcatgtggaatcacaaaagaccccaaatggacaaagcaatagcaaaagaaagctggaggaatcacatactaagtgtgagggaaatgcatatcaaagtcatttgtgacaacatggctaaacctagacagcataatgctaagtgaaataagccagacagagaaaaacaaatgctgtatctatcacttatatagggaacctaaaaaaaaatgaaatgtcaaactcacagaaacagggagtaaaataatagtaaatgcagaagctgagggtagggacaatggagaaatgttgatcaaaaggtacaaactttcaattacaagatgaataagttctggggagctaatatacaacatggtgactacagttaattatactgtattgtatacttgaaatttgctaaaagagtagatctgaagtgttctcacacaaaaaagaatatctgagttgatgggtgtgttaattaacccgattgtggtaatcatttcacaatgtgtgtgtgtgtgtgtgtgtgtgtatatatatatatatataaaacaaatcatcatgttgtacattttaaatatatacaattttatttgtcatgtgtacctccatgagactgaaattaaaaaaagaaagtagcaggaaaagtaggcttcaatatcaacacaatggatttttggacattttgaggcaaggactctattatacacatcagaagagtgtagaaaagcaatagttgagcgagaagtaccctctgtgcttttcctgacagatgattccaaggcataggatgctaagggtgtttgatttctagggctgccattaataaataaccacattcttgctggtcaaaacaacagaaatttattctctcacagatttgcagtttagaagtccataatcaaggtgctggcaagcccacgctccccttgaaatttctaggaaagacttttctttgcctttcactggcttctattgattgccagtaatttttggcataccttgacttgtacatgcctcaatctattctctgcctccttcttcacacagccacgttccctgggtgtttctgtctctgtccctgtgtcagaatctttctctcctttctcttgtaaagacaccagccattggattgagtgtccacattgatccagtacaaattaatcttgacaaattacatctgcaaagactgtattcccaaatacgatcccatcatgagtttgggtggaagtgagcttttgcaggactctctacaccccgctttgccacacctgctcctgtccagcacggagctccctgtgtcccctgtgctttcccagctccgttatgccatcccctaacctgcaccccagattactcttctccccacttttaccacactcaaaatttactttctgtaggctccagtcacattctctttttattttgtgaaatcttgtttgctcactaaaacttaaacggatttctcttttgtaaaaaaaaaaaaatatttttgacagcaattagttctgtgtaatgtctctggtatttatacactcagttaattttttttccaagtgttttacccacagttttttctcccagaaaataaattgtgtaggcctaagttaactattctgtctctctttttgcaaaacctaatagtctttgttgattaaatttttcattttgaacacactctgtgggtttaaagaaccctgaggagaagggagaggagagtatgttaggtattgaattttcattcttcaaaattgcatgtaaggaagatattttatttttcagatgaaaaagctgaggttcaaagttcatggcagagccacaatttcaaaccatttcctgttgattttgtgaaatctgtgcttgtccatactccctcccttctgccatggcatttccaactctcagagcaccaattccaaacagcctggagactgggaagtggttctgagaagttggttttctattggcagctctagtagagaagccctgtcctgtagctcctgacatgagtccccagtgcatcagcctgagagcagctgctgtgggagtaagttcagggtacctctgagaaaagagggggccctcactgacctagaggcatgtatgaaaacctagggctcccaaggggtcttggcaatcatttattctagctacctcattttatggagacagtatataatcattaaaaatgttttagtccgggcacagtggctcacttcggtaatcccagcactttgggaggccgaggcgggaggatcacttgagcccaggacttcaagaccagcctcgccaacatggtgaaacctcatctctactaaaaatacaaaaattagctgggcgtggtgttacgtgcctgtaatcccaaatactcgggaggctaaggcaggagaatcacttgaacccgggaggcagaggttgcagtgacccgagattgcaccacggcttggggtcctgggcgacagaatgagattctgtcttaaaaaaaaaaaaacaaaaaacctctgagaaagaccatatttaaattacattaaattttggagttataatcacattaatataaattatatcgagattgtattttttgtttaaaaatataatttaaaaactatattcatatatatatatatatgaatcagaaagactcatttttccaggcattttgggttagggaaaatctgtcctttgcttccccgaccattttgaatgtgattaaatatgcacacacacatgcacacacacacgcatgcacacactgatgcaaactttagcaagtgacatgagggtgtcttttcacaggataacttttttcatttgattcctcattcataaaacactagtatgatatacatccccacatagattttccccgtttctataaaggatgaagattcaaatgctgcaaagctcactccgggcccctggctcagaaacagttctctcagcactctcctgacattattaatggccctgatgtacaaacccagaataaaatagaattaaaatccaaagttaatttcaagctccattagaaattaaaggtgttgggaaagaaatcaatatttgcccagtgcaaaatgactaaattcaaagcaattaattctattattttgtaacttctaaaaactataaaagaccttcaaacaataaaatgttgccatgcgcacacacatatacaatgtgtgactaaaaataatgagaatgatatccagcagcgacatgcaaaaatctcttttattattttatagccacactatgtagtgtacacactaaagtgtgtcttaaaatagagccaattattccataaaattcgtggctatttccagcaattatcagcacttagttgtaaatctgggagaatttaagggacagaaacaatgcaaaagagcgaggagattaatttaaatggaagaaatgtatctgttttcttaattttgctttctctttttccagcttctttttatgtaatgctatcgatcaccaaacaaatggccttaaacgctgtagttcccaacaggatgaagtatttcacaacctgtagagctgtaggttataatacacataaaactggcactcggtaaaagctttttcctgtcagaatcattgccatttcttccctgtagtgccttttggagaaagtctgagttaacaaatggatcttttccaggtgcagaaagatcagagtcaaatgggtttggatcagatcttgtaacgagaatgtgtcactctttccctccccttgtcaagaaggagtctcttaagaaccggctcaagcatcacttatcattacagcagactggggtgaacagttgtaaaagataatgatagaccaaaccagttcttagctaaggagatgtcatgagccttctgatgaaacctttctctctttgtgatagagatagtcaaaatgattaaggactactagcaacagaggaaggcatggccaggcactaggaccattctaagacccatcaatatgaggaaatggagccatcgttggccaaaggctcgggtccttcaagtttctaaaattttttgtttgtttgttctgtttgttttttgttcgagatggagttttgctcttgttgctcaggttacagtgcaatggcgcgatctcggctcactgcaacctccgcctcctgggttcaagcaattctcctgcttcagcctcctgagtagctgggattacaggcatgcaccaccatgcccggctaattttatatttttagtagagacaaggtttctccatgttggtcaggctggtgtcaaaatcccgacctcaggcaatccacctgcctcggcctcccaaaatgctgggattacaggcgtgagccaccacgcctggcccaagtttctagattttgacacgtccttccagtggctgctaatcaacccctggccctttgaaaagttgtatctttttaaattgatttctttcaaaattgtactaaatgtagttagttgcccggaaggtgtgacttgtttaacctaatgaatcaaagctgggctttagcagttgagccacctgggccactaacatctacccactgtctggttttccacactagctataacaaaaacacacttgttagaccaaattgattttctgctctctttacgtctccaaattactcagctgtttcttccttcctgtgatattttaaaaggtctggggttctagccccaactctgtcacttactgtgggtgtgagctgaggctagtgatttggcctccctgatcctcactcccctctcctgtcaaatgaaaatgattgtatttaccttgtaagttgttttcttaaaagaaaaaaataaaacaatttaaaatgcatgtgaagtggatgttcatgatcagacctattgtagactctccaaagtagcagctgtggacattaccatggatctccattttcctgggtttcccaggactgcacactctctccccgctctgcttccttcagacctactctccagagagcttctggtacctaatattagtgtttgtaggtgaccataagtcaagttagcaaatatgacatataggaaagtagataagaatgcaggggtatgaaaataaggtaaaaatggggagtaacatgtgtttaaaaattgttaatctttctcaacaacatttcttatggactcagctaagtaacccaaggaggttgtctctcttcacccgctcctccccacaccagtccacccttcaacccttcaacgtggctaccatcttctctatatcactggatcgactcttgtcagttacttctatattggcaaattgatgttaacttatataaatgggacatctatattttatagaagttgctttctctttctttctttttttttttttttttttttttttggagtctcgctctgtcacccaggctggagtgcagtagggcaatctcggctcactgcaagctccgcctcccaggttcacaccattctcctgcctcagcctcccgagtagctgggactacaggtgtctgccaccacgcgcggctaattttttgtattttttagtagagacggagtttcaccatgttagccaggatggttgatctcctgacctcgtgatcggcctgcctcgtcctcccaaagtgctgagattacaggcgtgagccaccgcgcctggccactttctctttcttatagtggtttttctttgttttctgtaactcagcagctcttcatttgggttcagtgtagttcaagcctctgcttctcagtatacttcctgggctttttctttagccttgtcctccagtagtggtgctctccagctgtgtcctcaggctttccttctcaacatatgcacttacccttactgtccctaaccatggcatcaattttcatttacatagtgattccttcatccatattgccactctagaacattttgctgggcccattaaatgtcctggtggacagtgaccagcacatagtagaaatgtaataaattattattgaatgaatgatgtctctagatcctagccattatatccctgcatcaagcttggcatattgaaaatcaacttattctttctgccccctgtcccccattccaaccagacttccttttcctcctgcatttcctataaaggaaaaacggtcctttagcaacccagccactgaagccagtaatctagccacatctaattggtcaccaagttcagcatcttccatctctggaatgccatttgtatcccatcttcctcttcaggtcatacttcaacacagatactccccatttctgaataacagcaaaaaccttgcaactcttgatttaagggccttcagtttatccttcacacatctgcaaaagtgagaatttgatgccatgacttatcaggtcttatcaggttaaatccggatattctttggctgtgtccccacccaaatctcatattgaattgtagctcccataatccctgcatgtcatgggagggacctgatgggagataattaaatcataggggcagattttcccgtgctgttctcagcatagggaatacgtctcatgagatctgatgattttttaaagggcagttcccctgcacactctctcttgcctgacactatgtaagacatgcctatgactccttcgccttctgccatgattgtgaggcctccgcagccatgtggaactgtgagtccattaaacctctttttctttataaattactcagtctcggatatttcttcatagcagtatgaaaatggacgaatacaaaaccctttaataaatctccaaagttgtaaatataaaatttgaataaactaatctcacaaaatatgcataatctagttcctgtctttgtatagtttaacctttacccagttcccactcagctgcaggcattctgagcatgctataatgctttgtacacgtctttgtatggaatgcaaactccctcttttacttaattatcattggcatgttcttcattactcagctcaagtctctttgattgcaggaaacattgtatcatcccaaatctgatttagggcccccactctctgttctcccacagcatgctgtgcagaccgtgtcatagaaagagcaatacagagttgtgggatatttgctttttgatgtcaaaaaatatcttattaacttctcataccaaaaaacaggacaggactgatgcaatagttattcaacaaatgcttgtcatataatgaatggaaattccatatatccagcctgacactcccgaaattacttactggtctgacttttttgcttgaaggaaagcagctggacttgggttaaactttcactcttctctttctctgtctcttcccttcattgtgctttttctttctaacctgtatcaaatgagagagaacctgatattagtcacatatttggaaattttttggtatcactgagatttggtccctctcactgtcttagcagttacactttaagctggcttacatatagttgtaaaaagaaagactaggttccccagttaaagaaacttcagggacagaaaagctctcttctgcttgtttccttgcttgtaaagttagtctttgatataaagtttaatccttttatgctgcctggaatgtgctcagaggttttctctgcagattgtttcatctggcagttaattcctgggtacttctgggaattgaaggaaagaggtttttgagttttagttactgaacttcgataccaccagtcaatccaacagttctatgtctgtatggttttttgctttgtttcctctaaatcggtgattcttaaattgtattttatttgatgggcacatgagtaagtcaatacaagtacagactcctgggcaccatcccttctgattcataaggtctataatagagtcatggaatctgaatttcactgggcttatgagaagattccagagcagaggattcgtgccagtgtgactagggaatctgttttctctcttagcctttctatctgatcagaagatgaaacctgtctggggttctgcgtattctaattctttctcttctttgacttcaagttccccagactctgagggctaaaacccagtatttagtggccttttacagagcaaattggctggccattccaccttatccttgccatgtaagccaccagccatgcagactttccattacctcatgatcaagagtttcagtctcttcaccctcaccaggacagaggacatagtcaaggagatccctgcagaatacactgacaaaggacttcagaaataaagggagtcccagttatgaggatagcagacaaggaaatatggtagagcttatgttctgaatcaatcatttcagattctttggtttttacattgaacatgtatttgtgattactacaaatggttccaaaaaaaaaaaattcccaaaaagtaaaagtacaaccaatgccatacaaaatagattaaaaaaatctccaaaagtttaatggttcataagtacactcataaattttgaattattattaattcataattcccaagtagtatgataactagtatgcactttacaaaaggcttggtaggttaatatatgacaaatattgcttggaaattttattttattacaacactcaatttctaaattttagatttcataagtaagtgctcctgtgatgggcctacaaccatatatatatatatatatataatgcttcctcatatatatatacatgaggaagctttagttactgaacttggataccaccagtcaatccaacagttctatgtctatatggttttttgctttgtttcctctaaatcagtgattcttaaattatattttatttgatgatctcatgagtaagtcaatacaagtacagactcctgggcaccatcccttctgattcataaggtctgattcatatatatatgtgaggaagcattatttcccactgttctgaagcagccaagtaagaattaagctattgtgtcggtgcatacagacaactgcagtcctttgcagtttttcgcccctctggctacctttattatgtcagtgacaaaaggtgatacatttagtacatcgtgaataccgacctttcacactctttgagcccctctagcactttttctttttgttctgatcttcatacactatttaagagtgttatcagcaccaagaattcatagagtaatgattccactatttaattcttcatttctttaaacaagtttttttcttcctcaagccgattttcttttttaatgaaaaagctaattatcctttaaaacaacattttttttttttgcattttgcaataaagctaggaagtaatttagtaactttctaatagtaagttaatgagttttatcccagatctagtatcgtggggcatattttttatgtgtacataatgtttctaaactaagcccagttaatattttcttttacatttatcagcaagaaagagagaaaggagactaaaaacagacccatagctccccaaagtgcttaacaggagtatttaatggcatccaatcatacttagtcgctgtgtagatagaaagctctttgcaacaaaacgacaaagatcagacaaaccactatagtagccaccagagaactttgtatttcttatgtccattctgggctgattgtccctaaataagagctaacctattttctctgactttacatgagcaaagaaaatgccttcaaagtgctttctatagcaggaggtacaggtgccaacgtaaacctagataaaagctgtttgtatatttatttgtttgcttgtttttatcacactcagtggcctcgtgatgcatgtaattaccttgaccaaagcataatagtagacagcattaccttggaagagtcttagtaagatacaaactggacacatttttgagagaagaaataataggagttgggtgaaaacatatacagcatgggatcccacctaatgcactttatatcctaaaatagggagctctccacactctcaccatcgccgtgcccacacatctcatacgtgcatgcactcatgtattactaattctgtggtgtcacagtgtccacactcccatttgcagacttgtccttttgagacagttttttggaaccagggagcacttttcttgatagagagaattctaaatttttttgcacaatcaaaatcttcagtactaaatattcacattagcaacataagaaaagtgtccatataaagactaattgtccatacaacagttcctaatgttacattttagttagatgatctacagtttaggtcacagatactcagacctattccagaatctagccatattcaactttcatacatcattttttctcataactaaagatcaaagtagtaggaaaattttcatgatattgcaaagagatttttaaaaatacattagcttaaagttatttatcattaggaacctaagttttattcttatttaaagaaccataaatagaatttaaatcaacatctatcaagatctgtctatcatatcaccttccagaagtcaacactgtaaaactcaaatatgcgtggcttttggacaacaattccatttttagaattgtatagcaagcaaataataagacagagttacaaagatttatgtatgcttttcatctcagcatagttttgaatgatgaaaaatgtgaaaatattttaacatcaatagttgtatggtaaaataaatgatctgatgacatgctaagaaacaattagagttagcaagcagagctatgttgtttgacagagaaaacataagaaacctactctatactaaacagaaaataaaactaaaatgaaaatacctggttgaaaatataaagaaagaaaaaaacataaagtgatatatcaattttaacagtgatattttccaagtaataagagtaggtcatttgaatattttttcatatttttaataaattgtttcagttgaaatcaaatgaaaatctattatttgtataataaatgatacatgtattttcatttaaaaatatttggtaaagagaaactaaagaggaataaaagaccagatgtttagttttactgtattttaaatctgtactcatatttgaaatacctatttgtttgtctaaatgcccgaatggattataatcttcttaaggcaagaggccgtggattgcccttttttttttccattgtacccctacaaaatagtagttgcatgataatgtattatgaataaatgtgtaggtggccttggtaaagccactttctctctttgaggctcatttttctcatctagaaaataaatacagggttctctactcacctcgctggggattgctgtaatgctaaaaggaggcaacacatgttgattataaagccttccatgtatgtgaaggaacattatttttaaccacagtaattacactcatagaaatcagtgaagcaagtgttggattcccatccccaggcttggctcaaggccaaatacaaaatcatgaagcaagccaaaaatacaggctgcacaagctgctcatctgtgcctgccttcctcactttagagacatagcctgccctcaggttccctgcaccttcctgctctatctctacctctcatgtaaaagtgtattcccattaaaatggaaccagagacgcatgcttcaatctgcacccgggggatatgcgttttcaccagagataagaaattatcagacaagaacaggatcagacctggatttttctgttttggaagacacacctgaaatcacacacccctccttcccctcatctgaaggccaaccaccaccacatggtcctttcaccagaggtagagagcactttgacactcagatctctgctggaaatgaaaacaccataaatctactcaagcaaatttcacccctctgtaagaaaaataacacatattattaaaagttatccttgtgttacatgaaaaaattagaaaaaaatacaatgacagtaggctttgctactatatccccataatcacagtcataatgtattaggtactaagaacaatacagaacaaccatattggtttattcagctgtttaattagatcacagttttttggatagatgaaggtataaaatatatatagatatggatattataaatcaatagatgtagatagatttttacatctattttaattttttttctgtttataaataagtaaaatcatgtattttatatatttaaatgtgtatgcattttaaataggtttcaatatttaaatattaccatctactttaaaagtctattatatatttgtttcttgtttttcaagctttttaacataagagcctgaaaactattctaatgaggacaaagtaacagaataaacctaggcacatgcccaagggaatgaagtttaatggactgtttagaaaagcatgaggttaattaggttaagattcttagaaagtgagatttgaactaaaaaaaaaaaataataaggtgttttgctgttggaaatgagaagatcataaaattcactaagaacttatccacagtgagtatagagaagagaatgggccatcctacccattgctgaggccaaaacccatcctggctgcctctctacactcacaacccacgtctaccccatcaactagttctgctctcaatgactctatcaccgccattctggttcaaacaccatcgtcctctgtctgtttttgcagtagcttcctgccttagtcgacctactttcacccaggccctattcactctcatcacagcagccagtgtgattctgttaaaatatgcattctggtcatgtccaacctcatgttaaaaacaacagcctccaaggccctgaactatacctcgatgatcttggcttctactgcccttccccttgtttgctcactcagttgctcacacattttaatcatactggatgtgttgctgtcccatgaacacatcgggcaagcattagattctcagggcatggcgtgtgctgttcttccaacttacctactgcatggcaagatccatcaactccatccagtcattgcccagatgtcatcttctcttgaagacccaccttaacaaccatatttaaaatagtaacctcacttctgttttccttatctcccttatctgctttatttttcttcatagttcattatattctttttttgtttgtttgttttgagacaagtctcgctctgtcgcccaggctggagtgcagtggtgtgatctcggctcactgcaacctccacctcctgggttcaagcgatcctcctgcctcagcctcccaagtagctgggactacaggcttgtgataccatgcccagctaatttttgtatttttagtggagatggggttttaccatgttggccaggatggtctcgatctcttgacctcgtgatctgcccacctcggcctcccaaagtgctgggattacaggcgtgaaccactgtatgcagcccattatattctaatatactgcatcttttgcttatttgtgtgctatatcacctgtctcccgcaattagaatgttaattacatgagttcagggacttttacctgtctattatgtttataattgtctccccatctaaaatagtgtccagaacattagtaggtacacaataaatattttttggattaactacattcatttatttgtgctgggaacagcaacaaaactagtctgaagagaaggggctgaaattagacctacaaaagcctgattcagtagatttttcagttggaaaatattgagtgcttacattaagatagttatggtatgatatactgatactgaaatgaaaggtaaaaaccaaagtaaaatttaagtatagatcttaaaatgaatagccccaaaccatttcttactggaaaatttaagtctgactctattgctgctattatagcagagataagagacttacaaaatctagatgaattaacaaaagattaaaatcatttaaaatgttaggagaaaacttaataaaactcttataatgtgattgccaaaaaatgcacaaatatttccaggaagtgttaaaagttgtctattgctaattatatatttgtacttttttttacagctactcatgtgtagaacaaaaaaatagacaaaattactcaggctcaatgattcactatgtacagtttacaaattaattagcttctcttaattttttcaattaaaaaagtgttaaagcattagtttattgcttatttccgtgttaaaatgctggttaattgcaaaacattattaggggccaatattaaaattccacttacaagtgtcagagaagcaaaacacatttaaagttcatttgcaaatccagcttacctaaatctacttgggataaagcaatactgctgaagtacgtaaccacattctgatgatgtatgtgcaatagtttttcccattagcttactaatgtatgtgtatgagacagagagagagagaatgtgtgtgtgtgtgtgtgtgtgtgtgttactaggattagctctagtttttaacatcataacagaatatgaagcacgatgcacaaaaattcatttataatttataaacactgagcttttaatttcaggtgtttcttctttctagttctctatgtcaatcatatagctagatacaacccagaagcaactctcattcagaaaaccacaaaatgtaattaatttctttcttttcttttttttttttttttttgcgtgtgtgtgtgtgtgacataatctcgctctgtgcccaggatgcagtgcagtggcgcaatctcggctcactgcgaccactgcctcccggattcaagcgattcccctgcctcagcctcctgaatagctgggattgcaggcacccaccaccacacccagctaatttttttttttttgtatttttagtagagaccaggtttcaccatgttgggcaggctggtctccaactcctgacctcaagtgatcttccctccatgacctcccaaggtactaggattacaggcgtcagccaccatgccccaccaagatgtaatgaattcgattaagatttggaatcagtcttgctgagatattcaagaggaaaattgtgaaatgggatctgatgctattcacaaagagttcttcttaatgcttcagaggcagctctgactgttagggttagggtcttatatggcaagtacgaatactcctactcttaaatcttcaatacagcaggcagggagaacttccttgttgaatttttcaccatgtgctaaaaggatggggtgaacttggaaagaaacatccgaacgtcaacttcattacaaacagcaaattgagcagctgtgggagagaaagttcaattgggacataaaagatccattcactgatttcagaaaagctatttctgaaaatgcacaataagtatatagcactggagtagcaaaataagtgtaagtcaactatagaaagctatgataaacaagaggaacaataaacaggacctaagattcattcgcacatatgtaaataagactacagcacaaagtaagggatactctgtcagcattatttggcattggttgttgtttttgttcaaatgtttaatccatgtcccagaaacttaagatttcaagtccttaaaagggacttttaaaaagtctcaagtaacaatgaatggaattaacagttttttagccagtcattttagtgtcttaaaaatagaaaaatatttttatgaagataaaaagaataagaaccatccattgcgtcaccatctagaaataagcactgttgtttttctttttgtttcctttttcttttgagacagaaactcaatctattgtcccaggttggagtgcagtggcgtgatcatggctcactgcaacctctgcctcctgggctcgagtgatcctcccacctcaccgtgtctgttttgtttaagagtatatagttatcaatccttaaagccgaatttcattcttggtagttactgttaaaattaagcatgaacaattgaaagattttacaaagtatatctatcatatacctgcggtgtatcatccttggagaagaaatgaacatacactgaacatagaaacaactaaactttctagataaatggaactaagagactaacttctgtttcaaatgatgacgaatttcagaaagagaaaaaattaagtagaaaaaaaaggagaatgtgagagactggggagagaaaaaataaatgagagaaggtggtagaccactaggatgaagaagcagaagatgaaggagacaggcaagatgctgacctcttagctcagtcaaggtctggactttgggggcctgtcctagcatcatctcttgcagtctagcacatgtacatacagatgctatgagaacatatgtctgtcaaaggccagtgtttttctagatcagaaacattttgtagctcttccggtggacagagttggatcatgtgttctctcaagtatttttatagatttcagaaacactgaaataatcagcactgaacgaatgtagccaggcttgtttctaaccctggattctgtgctttgattttgctatcacgcccctcactgtcaaccaccctgaaaagagaccttataaaaaattatggctgggcgtggtggctcacgcctgtaatcccagcactttgggagggcaaggcgggcggatcacctgaggtcaggagttctagaccagcctggccaacatagtgaaaccccgtctctactaaaaatacaaaaattagcagggagtggtggcgggcgcctgtagttccagatactcgggaggctgaggcaggagaatcgcttgaacccgggaggcggaggttgcagtgagccgagatagcgccactgcactccagcctggcgacagactctgtctcaaaaaaaaaaaaaaaaaaaaaaattatgctgcagtttcctagggctgctctaacaaattatcacaaatgttgtagctgaaaacaacacaaatatgttatcttacagtttgggaggtcagaagtctgaaacgggtctcactaggttaaaatcaacaggaacgcattcctctgggaggctctgagacaatctggtccattctttttcagcttctggaggcctcccgcattcctgggcttagggcactggccgtcatcttcaaagccagcgatgactgatgtaatctttctcacatcgcattgctctggcactgactaccctgcctttctctttcacttgttaagatccttgtgtttctattgggcccatctaaaaaatctaaaataatctcctacctcaagatccttaacctaatcacatctgcaaaatcccttttgtcatataaagtaatttatccacaggtttaagggatagggcagcaacatcttgggaagtcattattctgcctacctcaaacctcaaattgtattctgtgattatttttcaaaggaataaacttggccaggcacagtggctcatgcctgtaatgccagcactttgggaggccaaggtgggcggattgcttgaggtcaggagttggagaccagcctggccaacggggtgcaaccccatctcaactaaacaaaaatataaaaattagctggacatggtggtgtgcctgtcatcccagctactggggaggatgaggcaggagagttgctggaacccaggagacagaggttgcagtgagccacagtcgtaccactgcactccaacctgggcaacagagtgagactccatctcaaacaaaaaagaataaattcataaaatcaaatatttttttactgtgtgatagaagcagaaattagaaagcattatgaccacccacgaatcataaaatctttagtaggaccagtaggttaacatttttcctgttggagggagcgtttctttgatatataaactttcaaggagtcattgaaagctttggaaggcttctttccaaaaataatcttttagaaaaagtctttccaaagaatccagtcgttgtattttgggcaaaatattagaagtatgagaagccagagtgtgaaaactgagttaatattcttatgaacacgaatacttggcagccaatattgaggctgaaaatgcatttagaatgttaatgtatttccatagtatttcagatcaaagatactgaagggaacttaactgcaaattaaaaatagagaatctacaggaataagttacatttcttatagcttcctgtgcaatatcaaatcaagtagagcaagaggtggttcctactttacataatttttctcagaaggatgattttgtttactaccattgccctgtaagtattatgctttcaaggaagctctaacaactggttatcgctgaggttagtgtctctcatggtactcgcttcatgctctgtccattaggtaaatgacatgcaaagatggcttcctctaagtttctgagacacaggtactcatatttaacttccgtggaggaggaacacaggagtgaaatagaaaggtctgcatttggtgtctgtcttcccatccattcctaagagaagatgacataggcctactgcttatcaagagcatttgaccctaatgagtgtcgttatagaaaagttagaacctttctataagactttgtattttactttccagaaaattccaattcactaaactgtccatttcttctcctactagtgtgttattttcagggtgttttcttcctattatagtctcagaaggcccatgctcagcttccgtagaccctgtcctctgtcagtcagtcacttcatttacccctaggttttgactcttcacagatttctggatatctccctccaaagggatagctcttctgttgctaatgactagcatgagggttggtaagtagtgacagtaaaattaacattccttgaccacatgaatgtgagcaacgctttggatcagacacctgatctctgccacaccttccagattaagtcaaaaatgcctatcttggtattcagggtccacccaatctgcctttcctggctaattttccatgtctctcctatgttaaccctgcattccaaccaaatggtctgtttcccattcctggaatccctaggataaattccattaatttgcctgcttcggtgtagttgttcatgccattctccttcctctattgatcatagttccactataattttgttgtaattatcgggaaccaaagaagcatgaccctttcttctcatacaaggtttggatcaatttagaaataagatgcctagtagaaaaaagctggccatcaaaatgtctgctttattacaataaaagcttatttgaaagcagtgcttagatctacctacagtctaggcatactgctaatattactgtctatgcaaaaactgaaatcccattccgtggaagtctcccctggcaaaggaagagcctgccccaaggtgtttcccatgtggaagatgcgagaatattgctcctaggcagcctgaaatggagaatataagctgctctgatcaggtattgtttcttcttctaaattcacaaaatagacgagtcattctctgcctgtcttcactcgccaggatcagtgattttgaaggtgggggtcagggtgggagtagaggaatatagagagaggcccaaagtcaccttggctaaagtccctctgtgtggaaacatgagaccaggcgcttttatgaggctttcttgaatatgcttatctgtgaaacataatgttttcccctttgtgctcccaggtttgtaggttatatccctcatgcagaactgagagagtggttcagctaccaaataccatctgttagtctgttccagctactgtaaccaaatgccataaactgcatggcttataaataacagaaccttatttctgacagttctagaagctgggaagtccaagatcaaggtgctggcagattctgatgagggtcccctactttctggttcatagatggcactctctcacaagtgtgctcatgtagcagaaggggcacaaggagtatctctgaggcctcttttatgagggcactaattccacctgtgagggctctgccctcatggcctaatcacctcccacagttccccacctcttaccaccagcttaggggattaggatttcaacatatgaacttggaggacacacgaatattctgaccatagcatatacttactggttttttatttctgattttaattggtgcttaaaggaatatctaggtattcctaataactattatccaaaccttccaccaatattttcaataaatgcctggggaacagaaaatgaatgaattaaagtatctaccaataatattttagaaaaaaaacctaaaatttgcaccttcctttttattcacaatatgattttcatatgtaatatttagaattattaccaaaagttgtagcagagcctataaattaaaaaaaaatttcaagggagcatattagaattaagcagtaaaatggtagaaacaaatggcttggtgggataaggagcagtaaacatttttttgcatattctccagttttacaaatttgccatcttcacattttgggggaaaaaagtttgaaagaatgcctttttaaatccattgagaaacatggatagctgatgctgtgcccatactcaaacttcaaaattttctggcccagcaaaaaaaaaacaaaaaaacaaaaaaaaaaaaacctactaaaaaataatagtttattgaagacaagaaaaaaatattactctgccttattcatatgcctgggaatacaatatatttgaaatgtattatttctaaatgaataacaaacttgtaaaccaacacaatcaaatgaattcattttcatactagttatgtgttacagagcaacaaattactccagattgtagtagcctaaagcaagaaactcattatttcacagtgtctgtgggtcaagatttcaggcacagcttagctgagtgcctgtggcctgggtctctcacagtcaagatgcaatcaagatgctgatgtcagtgagggccgcactgatcataaggcccaagagggtaaagatccacttccaaaatcattcaaatgctgctggcaagtctcagctctttgctagtcatcgactgggcacatctgttctttctcatggagcctcgtcatggggctgaccacatggcatcccggttcaccaagagggagagttctgacacagagagaggagacagcgagagagagaatgaatgcacaaaacagaagccacagtcttgtaatagtctaatcatggaaatgacatttcatcacttcaccgtattgtattctttggaagcaagtcactaggtccagcgagtctcagagggaggggattatacaaaggcatgaataccaggagttggggatcctttgggatcaccgtagaagctttcctacatatccttctttcctaccttgtctggataagttctgtctgttcctggagacagctgaagaatttcctcttccaggaagctccctccacacagctgagcctcctcctctctgcttctgcagcagcttgggccccctgtatcagggcatcctgaactgcacaggtgccttgtgagcacctgtctccttgcgtgtctccctcttcgggctcttattcctcaacagccaggttcctgtcttactcaattcccatgcctagttcacagcacagaccgtgtgctatgtacagatgtctcgtatggagctataaattataattgaacataacagaatttcattcacgttacctgcagaaaataaatactgcggtgaatctcactcacttgcccctaatactcctctgcaatatttaagcacggaggtcaaacagtttcctccgtttgggaacttgatatttaatgaaacattttatgagtccgttgacattgcttacctcagctgcagttccacagatgacttcggaatgtgtgaaatagatctcttattcttcactgataaaacttcgggtcagactctcacacaactgcacacatggtagctttgctccactcacaccttgtctacagcctagatgtttgcaaatagtgctttggtttttctttaaaatatccttttgctattactatatatgcccactgctttgttcagttgaaaaatagcgtggctagccgggcatggtggtgcctgcctgtaatcccagctactcgggtggctgaggcaggacaattgcttgaacccgggaggcggaggttgcggtgagccgagatcacaccattgcactccagcctgggcaacaagagtgaaactccatctcaacaacaacaacaaaaaagcgtggctctgttatgccctggcactgtgctaggtccccaacattcacagaagactaaaatataatttctaatgtgggagacaaaggtttataagccaaagagacacaactcatcagctggattttgcactgtgacaagaactgacttagaggagcgtggctgtcttctaattcagggactctggagggatgtgtaactaaggttcaggtcagcacacccaatgcaacatgcatactctgtgcagaaagtaaattgaaaactctgcttgagggtctcagtggacctcaaagcagccctgacattttcttgtaagttagtgcagcataggagttccaattctgcgttcatcctccacagtgagtccccaggagagggaccagagaatggagtaaaaacaaagggaagggagagaaaccacagctctagtggtcacaatgacaccaggaccagtagaagcctgagtcatacaataatttctactggttcagtttctactgaataatttccaccattaaaaatgactccaagcacttacacatgggtgaaacctagaaagtgaaacaattgcttgttatatcttgttagcaggcaaagaaaggatggtgaaatcagctgttggtgaaattctgacagcagggaaagtcgggggctggcatttctggcaggcatgagagccacaaacgggtgacagaatatctcaagagacaatctagccttattcttaatttttgcttaacatatttgttttgacataacattctcatacatctttaagttgagaatcagaaacatgtctttgttataataatattgttgatgtcaaagaaacacagagcatatgctgtcttaggaattctaaatggcaaatgacatgtgtgtctgtataacaaagacaaggagagatagagacaaatataaggagagaaatgcaaaccaactctcaaagtccttaaatcatattataagtgggcaaagacaaggaaagacagaaatagagacaaatataaggaaagcaatgcaaaccaacactccaagcccttaaatcatattctaagtggataaaatgtcacatgtgaaagaagtgagataccagatacttgtgggaactaaaaatggttgggcgtgtccagagcatataaagaatgggcagcagatatagttggatgggtaggcagaagctagtgataaaatattggatatcttaaaccaagtccttgaactttattctggaagattgtgatttaatggatttaatggggctgtacgtcttaacataagaagggaagattatgttaagaagccatacatagggaaaaaataaattctctcggatcaagttacttcagtaaacatatttactaactgtattaatattatgactctttcatattccgatatgttgtttcctaaatttattttccaacagaaactttttcttggggagcatgggtttcaggatctcaaggagccagtagtccaattgttttagaaaatattgttaggctgggtgcagtggctcacatctgtaatcccagcacttcggaaggttgaggcaggcagatcacttgaggtcaggagtttgacaccagcctgtccaacatggtgaaaccccatctgtactaaaatacaaaaattagccaggtgtggtggtgtgtgcctgtaatcccagctactcgagaggctgaggcaggagcattgcttgaacatgggaggaggaggttgaagtgagccgagatcaccccactgcactccagcctgggagacagagtgagactccatctcaaaaaaaaaaaaaaaaaggaaaagaaaatattgttgtggaaaaacattgcaggaatgcttgaatctttggcatttttaaaaaatctaattcacagtgtgactttgggacaaataagttcatttgtttgggctttctcttgtggactaaggaggtagaagaaaattaagcagtttctgggatcccttctggcagtatattctcctagtctatggaaaatatgctataatcagcctgtctggaatatagatatcaagctcgaggtaaagttttactcgtgaggattaaatcagtgagaagtagcatatttaagaaaaaaatatacaatcaacttgagcactctaataatggtttagtgctcattgcttgaaggaataatttttgacaaggtcctgattttaaaggctaatgttcattttttgcctcgaccataagtaagagctagaacctgtagtatataggtcaacagattctaaaatatatttcagtatgtgctcaccaaatcaattagattttttaagtgaaaatgaaaacctctttgagttcagtcctaggctagctggtaaagatggaggaatcatgtgctcatgactagtcctcttccaccggtatgtcaagtattaagagaaagaagaaagacgtttccaaataacttgggatttggggactttggcttaatttgtacttgtatttgtttccttagactataagccacggattaagtttttctgtcattaaggcaccattaactattagaacaggttaacattaaccaatagaacaggtatacctttgatttccatgaattatggaagacaggcatttctttttttttttttttttttttttttttgatggagtctttctctgtcacctgggctggagtgcagtggtgtgatctcggctcactgcaagctccatctcctgggttcacaccattcttctgcctcagcctcccaagtagctgggactacaggtgcccaccaccatgtatggctaattttcttgtatttttagtagagacagggtttcactgtgttagccaggatggtctcgatctcctgaccttgtgatccgcccacctcggcctcccacagtgctgggattacaggcgtgagcaactgtgcccggccaagacaggtatttcttttcatattttataaattagaaaaccaaggtttagaaatcttagagagcatacccaaggtcctaaaaagtgaaaagctgcaaaattggaaatgcagcttaagtcctctcagtatgcgcagcgttatacctcattttctaaaagatagcatttctcaagaaaatgtatacatactgtatgaaagtccctgtaaataatgcaaatgcttgttgaatttttaaaatgtattctgaaactcttgtcaaaataatagttagtttttaccaagtagcatcagtagccacattacatagcagaatttaaattataatggcttgaatcttcttactctttggcacaggtgagaccaggcaggcacactagggaggggcagatgtgagccgtgtaactatctcattcccttaggaagccctttttacaaaagcaaagttggcttctgtcatagttttgattcttctcaagtcagattctgagattaagacccaggctggcctgagactaggagaaggattatttgggaggttatcctggaaagcccaagtgaaggagtggagataataagacaggagagggaggaaagcaaacaaacaaaaaaagtgcattgatagggagaaactgctgctattaattgagctcaatcccactggagagtctctgagaaaccttttggtacgtggggatgctgggacgttattcactgactcctgtcctgtgttggttcagggtggactctaaggatattgactttcacacacttccaggttgcacctatatgtggccaagcaggctccctttgagcccaaggaagtccatgaagagacataagtttctgaggtgggaagctgtttactctaaatagtcaaactcaattgtggctgaactcagaagaatatttaggggagaaaaatacatgaagttctatttcctcattcacagggatcgtggcataaggcagactgcatgggttagggtagtttgggctgccagtaagtgtaacattctctgtgcgaaggccacattggttggttttctaaggatgcaggtgtgtctcatggcacaggaggccagagaagggctcagaaaggctgcagagcatgaacagaaccttactcattctgtctctcacttggtctccctcagtgtgctagctttccctctctcctttacacacaacactcacagacacacatgcacacacatacatgtacacacatgcattcacgcatgtgtgctcacacacagactagctttttctgtttttcttgtacatcttacatgttcctggtttaatcataagacaaatggcctctctcttctggtaacaattttatattcctggtcaagggagctaggttggcccacacatgagagggaacagtggaagtaggatgtgtaatgcccagaagaacaggcatcggaggagagcccaggagttgattctatatgtaaatctgttataataccaatccgaacaagctagtattctatcaaatagccaaatgcagaggtaagcaggaagtaagtaatatcttttgtgattttttaaaatgacacacagtagatgagctcagaacatatacagtacagtagccactgggcaaccattagataaacaagaaaagagccagaccatggggatgaaaccatctttaatcatggcaagtggaataatgtgtaaaaaagttatgctaatcataaaatggaaacgatacatgtccattttagaatcaaatggcacagaaaatatgtgagcatatcagcaccatctatctacattatacccttgagagcttgtagattctgagtttaacagcaccatatcatgaaaaatgacactggacaatttggattgtttttataccatgggtctcagtgagaaagtcagctttctctttcccaatgcaaataaagattagcaaatatatttaatatttatacctgttctggtgattcattttggcttttgaaagtgaactccaccataaaaagataaaaaccaatcttccttttctcattccttccattattcattcatttattgatattactatattataggcactgtgccactctctctgtagaagcgcctgacagtagaaacaagggcttcatcctcctggctatgatcatgaggctacaacataacactgtggctttttgagaattatttcacagcctatttccagagcaaagtaacaatgctgttttttttttggtttctattttcttgtttgtttgtttgtttatgaagtcaaactattatggtgatgttaccaacttctttcaaagcagaggccagggaatcaaggacgttgaggcttaataaaataaaagcaaagtatgtttgtatatttttcatgtgttaggactacaggtttccagaaaataaacctttagtgcataggcaattttatcattagagatttcaaaggggatatgcatttatcgctatcaacagagccggataaaaagatttttttctgactatttccataatgttccattatgtttttaaacatgaaaaatttattccaaaggccaggaaatcacaggactccaccaggtgtgataaggtcccaatctaataaaagtttaactatctctctggctattagtgtttatttattcaagaaaggtccagaatgttattttgaatattcagtgtattatcaataatcgtggggattgtgatgacagtagtggcaatgacaaaaataacatctgtattagtctgttttcacactgctgataaggacatacctgagactgctaagaaaaagaagtttaattggacttatagttccacatgtgtgaggaggcctcagaatcatggtggaaggcaaaaggcactttttttttttttttttgagacagagtcttgctttgctgcccaggctggagtgcagtggcacgatctcagctcaccacaacctccacctcctgggttcaagtgattcatcagccttccaagtagctgggactataggcgtgtgcctccgtgcctggctaatttttgtatttttagtggagatggggtttcactgtgttggccaggctggtctcgaacttctgaccttgtgatctgcctgcctcaggctcccaaagtgctgggattacaggggtgagccaccgcacccagctgaaaggcatttcttacatggcagtggcaagaaaaaatgaagaagaagcaaaagcagaaacccctaatagacccattagatctcatgagacttattgactaccacaaaaatagcacaggaaagactggcaccctggattcagttacctccccctcagtccctcctacaacacatgggaattctgggagatacaattcaagttgagatttgggtgaggacacagtcaaaccatatcattccgccactgactcctccaaatctcatgtcctcacatttcaaaaccaatcatgccttcccaatagtcccccaaagtcttaactcatttcgacattaactcaaaagtccacagtccaaagtctcatctgagacaaggcaagtcctttccacctatgagcctgtaaaatcaaaagcaagctagttgctttctagatacaataggattacaggttttggacaaatacagcggttccaaaggggagaaattggccgaaacaaaggagctacagggaccatgcaagtctgaaatccagtggggcagtcaaattttaaagctccaaaatgatctcctttgaccccagatctgacatccaggtcacgctgatgcaaggggtgggttcccatggtcttgggcaactcctcccctatggctttacagggtacagcctccttcccagatgtttcatgggctggagttgagtgtctgtggcttttccaagttcaaggtgcaagctgtcagtggatctaacattttggggtctggaggatggtggccctcttcttacagctccactaggcagtgccccagttaggactctgtgtggggactccaaccccacatttcccttcctcactgccctagcagaggttctccatgagggccccatccctgcagcaaatttctgccttagcatctaggcgcttccatacatcctctgaaatctaggcagaggttcccaaacctcaattcctgacttctgtgtacctgcaggctcaacaccacatggaatctaccaaggcttagggcttacaccctctgaaaccacagcccaagctgtacattggcccctttcagccatggctggagaggctggtacacaggacaccaagtccctaggctgcacgtagcacggggaacctgggcctggcccatgaaaccactttttcctcatgggcctccaggcctgtgatgggaggggctgctgtgaaggtctttgacatgacctggagacattttccccatggtcttggggataacattaggctccttgctggttatgcaaatttctgcagccggcttgaatttctccccagaaaatgggtttttcttttcttttttttttttttttccgagacaaagtctcactctgtcacccaggctggaatgcagtggtgtgatctcagctcactgcaagcttcaactcctgggttcacgccattctcctgcctcagcctcccgagtagctgggactacaggtgcctgccaccatgtccgactaatttttttgtatttttagtagagacagggtttcaccatgttagccaggatggtctcgatctcctgaccttgtgatctgcccgcctcggcctcccaaagtgctgggattacaggcatgagccaccatgcccggccaggtttttcttttctatcacatagtcaggctgcaaattttccaaacctttatactctgcttcctttctaaaactgaatgcctttaacagtacctaagttacctcttgaatgttttgctgcttagaaatttattccgccagatgccgtaaatcaactctctcaagttcaaagttccacacatctctagggcaggggcaaaatgccaccagtctctttgctaaacataacaaaacttacctttgatcctgttcccaataatttcctcatctccatctgagaccacctcagcctggattttattgttcatgtcactatcagcattttggacaaagccattcaacaagtctctaggaggttccaaactttcccacattttctgatcttctcagccctccaaactgttccagcctctgcctgttacccagttccaaagttgcttcacacattttcgggtatcttttcagcagcgccccactctactgctaccaatttactgtattagtctgttttcatgctgctgatgaagacatacctgacactgggaagaaaaaggaagtttaattggacttacagtttcacatgactgaggaggcctcagaatcatggtggaaggtgaaagacacttcttacgtggcagcagcaagagaaaatgaggaagaagtaaaagcagaaacccctgataaacccatcagatctcatgagacttatttactatcacaagaatagagtgggaaagaccagcccccatgattcaattacctccccctgagttcctcccacaacatgtgggaattctgggagatacaactcaagttgagatttgggcagggacacagccaaaccatatcaatatcttacttttgtattaaataatatgattcctgaagtagttactcatatactgccccatttatttctcataagaactctgggagaaaaaatctatcacctctgttttactgatgagtaaatgtagactgaaagaattcagatgatgtgtaagagaacacatagattataatgacaaagctatagctggaattcagtttctgtttggggatgttgttttgttttattttgatcttagaaaaaactaaaagttatcataaaagactttattctaactgcaaattcaaagataatgtttattcatgcctaggacaaaatttctattaacaatcaaatattacagaaggttgtgaatttttgatgacctgattatgtttacataagtctctaccttttctaaacctcataaatatgaaacctttgggtgaactcttcccagaactgatttccataaacttactgaaaatgagtaggaagaaagagctcaagggacaagtacttattgtgtatactctttagtgatacagaaataaaagaaaagttaaatacctatatttataaaattgaatcttttaaagtcagctgacaggtcaaaatgcaggtaacatttttaagcttcatgcttaaaaaaataagctttatttaaaaaaaaaaaaatacttacttggagccaggcacaatggctcatatgtgtaatcccagctactcaggaggctgaggcaagaggatcacttgagcccaggagatcccatctcaaaaaaaaaaaaagcaccttactttttacttcattgcctcagtgatagcagaccaacagggcattggtaagaatagttttaactatactcacaatcatatactggcttcagttgtactagcaacagttaaaattgaagacacattaagcatgtaataaatgtgaactatcaataagtgaaaccattagaactagtattaaaccgtttcattcttaacatcctttacagataaagaatcagagactgagagagcttaataataccactattcagttagcaagctattctgtggtttaaagagatcagtattgcctttaactttctggcttttagaatttacgcaattctctatcaacatggaggctcaacctgattttggggcattgtgtaagccagtagttttcaacctggagtgattttgacccccaggtgacatttggcaatgcctagagacatttgtgattgtcccatttggttggggttgctatggtatctaatgggagaggccagtaacgctggtgaacatcctacaaagcactgcagagcccctggcaaagaattttccagcccaaaacgtcagtggtgctgaggttgagaaaccttgatatagccctctaagactgaatattaatgaaaatgtttatttaaatcagtttgtatggtcccagtgccacttagaattatatttcttaacaagttagagctcaatttcctctgcccaggcctccttaggatacagaagaataagccagtagtacccttacacggaacaggatagggcaatcatatgattctgaatgccaaggggactttcagattgatggtttcgtaaagtgactgacaccttggacggttcccaagaaaattactaaaacttgagtcttttgcaggtatgcaaaacccatgaatttcataaaaaataaatctttatttcaaagatgggacttttaaagtttaaagtggccttcgggtggagaaagaactaggaatcaaaatttcaatgggcaataaaaacaagtgataatttcctttgattctcacaatcaagatgaagcaggattgtgataagagcttagcatttctatccactcgttgaaatttatcaaatgcctctccctgacttctcgcccttacactgaagtagatatccaaagacttcagatatatacactatggacaagtatttcccctcacttgcagaaattcaagtggcaccagcagtttggagacagaagtctcagtgggcgcaaggaagctggggtctggggcctgactcttccctgccattttggtgccccttcccgcctacccacgccctaccccaatgtgtggcattatccagggggttattaaatattgaaatacagcttgacaaacatctgataacaataggtggccaaggccgggcgcggtggttcatgcctataatcccagcactttgagaggccgaggcggatggatcacctgaggtcaggagtttgagaccagcctggacaacatggtgaaaccccgtctctactaaaaatacaaaattatctgggcctgatggcgggcccctgtaatcccagctactcaggaggctgaggcaggagaattgcttgaacccaggaggcggagcttgcagtgagtcaagatcgcgccactgcactgcagcctgagcgaaagagtgagactctgtctcagaaaaataaaaataaataaataaataaataaaaaggtggccaccagctgtgtcaaaatcaactagttaaaaggtggaaattaaatatgacagtggaaaaagatttctagttggagaatgaaaacttcctaaaatctaagatggctgccattaaatgatattcagattcttcccgggttcttgcttttggatgaataaatggctttttcttcctccaaagttctaatctgatgaatgtgtaatggagataaatgttttggaaatatctccatttgcctggctcctcggtgtctctgtgtaggactttctccccactcaggccaagcttccatctgtgagtggaagatggggaggaggcgaggaccgcgaaggtcacaataagaatgcaaatacagcagtaaaaacagtttaatattcaccctctgtcagcaaaaataggctttcctagtctgcagcaatgtactggaacagacgtaaaagacaggcgttgccaggaaatagggatttactaaattcctttatattcccatttaatatatcaagaggcagtcctggtatccttgatcatatagcatttcccaacaaggaggttagaaccagacaggaagaggagagaaatccacacatactcaccccagtaggggaagaaacaaatctctgaagctctgagcacttacatgactcaccgtggcaggaactaagctacccaagacaacttttaaaattattgcatccacagagtttaccaaatgagtctgaaatttaacatgtttcttttcccagcattttaaaatcaattcctcctttgaaactcctctccaattactcttcatctgtataaattcaaatatattttcattcatttactcattcaacaaatatttattgagcatctatcacgcacagggtgctgcgaatgtgccagtgagtaggtacagataaagtccctgccctcttgaaacttactttttagttggagagaaaaagaaaagtaaatatcatttctggctgtgataaatttcatgaagaaaaacaaacaagaacttcctggtcctcgtgctcactcccttccaacagttttgggggacaccaaagggacagagaggagtcaagccccagaccccagctgccttgtgcccactgggacttctgtctccaaaatgctggtgccacttgagtttttgcgagtgaggggaaatatctgtccatggtgtatgtgtccgaaatctttggacatctacttcagtgggagggagaggagtcctggagagggctcagtacatttcaaggtggtgagagcagtgctaacacgcagcgttctctgacttcctaatgtacctccctctctgccatcagactaaaatttttcaatagctgcttgatgcaatcactttctttttcaagacccgcaactgctcatactgcctgatgctacctcccaggccttgaacatagcttcaaataatgtgtttaacctatgcctggccgtaaagcctcccctctcaccacgccacctcttctaaagtcacataaaaatcccagttctctgtccacacatctaagaatggacactcctctgtcttctcttccctatctttctaaatctgacccttttattaagattcaaccagtttcctgcctgctctattccattcaacacccagaccacagtgatacctcctttgtctaatctttcacaatacactttagcacgttacagattcccaaatgtggaaagaaccatgctggtcttttagtctagcattaaatacaatgtgagtaacacagttataacctttctaataggtagtctcagactttcacactctttcctaatgtttttcaaataagtacatttttaaaaatgcaaatacacagtggtaaattaaattattttgattattaagcattcataatcataaagctatgaataaatctgtatgcttggaactcttatataatcgtaaaagaaaacaaacttaaaaattatattcaaactgaataacaaaattcattcattccaaatgatcaacattaatttaatgtgacatgtaatattttgctaaagtaaagtacctattctcaatgtaaatgtggtattggctactatcaaatgcaatatgtaatagtggggccttacttacctacaaaggccatctctgtcattttttcttaaagaaccttaaaaaaaaaaagttgtagcttcttactaaagaaatctccaatgctaacacaatataagcgtgacttaattacagggtgataatctagatcatgtggacttttcagcccattaaaaattaaaatgaaaaatctaaccattttcaaagaaacgcacatcttttatcatatgccttcatataacaagggtccagaaatccatgttataaaggtttgtactgattcaggtgtttatattttgactctgaaaatggatctatgtaaaatgtgctgacaaaaagggctatttttaagttttgtgcatttttccttatagtacctaaaaatgcatgtagcacatgctggatgttaactaaagattccttgaatatattatctctatttattttatttcttctgatgtgaatttgaaaaaacatttatttacagaccactaaaaatctcccaggaagctgagttagtggtgactgtttgattctaaccttctgaacaaatgttttcatgaactccatgaagctttttaataaacttactcctcacagtgatgcaagtcaaatttaagacagaagaaactaaacgttcatcggtataagaaaatctaagtcaaggtggccaaaaaatcaagcaatcttttaagaatgttgaatcaaatgtggttgttggtgaatgaaaatttcttctattgcagacaattatttgaagggtacatctttttaatactatttccaactgtctcctagagtgatagtagccctgttaaacaattagtaaaacaaacaacaacaaaaaacacattaggccaagtgcagtgactcacgcctgtaattccaactctttggaaggccaaggaggaaggatcacttgaagccaggagttcaagaccagtctgggaaacatagtgagacccccttctacaaaaaaataaaaacttagcccatgaggtggcacgcatctatagtcccaactactcgggaggctgaggcaggaggatcgcttgagcccaggaggtcaaggctgcaatgagctgtgatcatgccactgtactccagcctgggaaacagagtgagattatatatataaaaaaaaatccctcctatctttgaaattttcatagagccacctgtagtttggatgtttcccagggaacacaataaaaacaaattcaataatcctcaactaaaaggcctgatatcatgtttatgccagttttttttcctgagtattttaactttttttctctacttagtttcatcaattaaaggcttattgttaagggagaaaagcattaggacccctagtaagatgctccagggagtgtgttttcagctcaatgtaagaaaaaaatttttgaaccgtcagtactctttgaaactctgtttattccaagatagtgaggtgtctcttaatataacagcttatacaggggctgaatgatgccagctttgggcttaatgttgtttttaggttatctagacagttctgattttagaatgttcataagttaggtctgaattaataagccaataggttcttatttcaaaagaatatatatatacacacatatatatacatatatcaaaaatgtgagctaaattcccatttatctttagtattctccatatctctttcatttccagagtaatggtccttgggaagataatagctagcataatgagacctggtacttacacagcactcaataagtacaagactctctaaatgttcattcctcacaaaactctatgagatacattatagtgctattccccttctacagataatggaactgggacactaaaggttaagtgatgtgctgatacttccaaagctcataaacagaagagtcatccagagccaaactattttggcttcaaagtccaggcacttagacagtgacgctatccactcactagtaccttctggagaagccactaggatagtctgagaatattactggactactaaacaaattgagattcttgaaagctgaattgtgttgtgtttttaccccatcatcacaaacctttacatttgttcagaccaggaaaataaatgtcagatgccaatgtagtgacactatcaactcccaggtgtaatcaagtagagactgagatccctacaccaagtcaaaaacttttatttctttgcatactatggaccatggtgtcaggaataatcacaacccaaagaatcagggaatacagaattttagagctggaagcatttttaggaattgttcattctttctttgttattacagaaatgaggatactgacttctactgagaggatcgtatttcaagaccatgtgatggctttataactgctctttctgactctactgttaactctctcatgtccaggctcataccagccaaaggaaattcgtaataaaatttgatcctctctataattgctattcctgattccactgttaactctctcatgtctaggctgataccagacaaaggaaattagtaataaaatttgatcatctcattctgcttctttacactccttcaaatgttctgcattactttgagacttaatcaaagtccttcagttaaagcatcagttctttgaagacctggtccctgattgtctgcagtctcatcagctcctacttgctcctcttgaaatctggactccagtcactctgagtgtcactccagaccccccagaacatcacactcttacctccatcctttacacatctctttccttctactttcacagcacttcccctggactcttctgtctgcctccacttcatttttcagaatgcagcttaatacctccaaagaaagtcacctctaacccagaggtcacatttgttctgtttagttattcaaactcccaatttaaacaagtctgcctatattgtttcctaacctatgacagatataaagagtaagttatatttctgtgcattaggatacaagaagagcaattagaatttgcacaatgcaacatgacatctccagtaacaatatattgcaaggattcactacttataaaaagggaaacaaggagggcagatcacaaggtcaggagatcgagagcatcctggccaacatggtgaaactccatctctactaaaaatgtaaaaataagctgggcatggtggcacgtgcctgtaatcccagctacttggcaggctgaggcaaaagaatcgcttgaaccggggagttggaggtcgcaatgagccgagatggtgccactgcaatccagcctggtgacagagcaagactctgtctcaaaaaaaaaagaaacaagttaatgaaacaaaattttctgagatcatttggtaaaggtgtcagattggtgcagcgtaatccagtgattgatgtaggtaattttgaaacctgagtcagcaagaaatagcaattatatttaatgtaatatgatgaaggaggcagaaaactgcaataacttagaatgatttccactaaagatacttaaaataaaatgagttttagtgcttatagcaaggaaaactccatttatgtttaacatctacttcttttaaaaatgtatacgatatagggggaagatggtaacagttagaacacccaaattctggtctggtaattgacactaaattagtgagtgactttgagtgagtaagccatatgatatctttgactcttagtataatgcagtggctaggaacaggggctataggctcaaatctcattctattccattactttcaagctccatagccttctgttactttaattgctctaagcctcactttcctcctttgaaaatggaaagaataataccttcctcataggattactgtgacaaacagaaggcacaacacttacaaaacactcagcatagaatatgacacataggaagagctcaaacagctgttgttgttgttgtcgtaatataagtagttacagtgagggagatagatcacatgctctccgaggtcttctcaaattctaaaattctgtggttctatgaacaactcgctcccaaatgatgtcagataaatgagatctcactgtatactgggcaataaaatcaatgtggtcaattttaaatcgtaccctgtaaggtaaggttgagcaggtcatgaattattcaaaactttggttacactcaatatatttctatttgatcatggaatgcatagaactatttaaaagagcatttttaaccttctcatattatgtttaatgattaaaatgagtttgatctttccgtgttcactaagggaaaagaaatggagcaatgctggatagtttatatatgtgccccacttaatcattagcgatttaggtgaaatcatcgagcaactttttgggtaataaaaaatgcaagcaggatatacagttttggcccagataacagacatgcctataaatgagagccagtggcacatcatctccttatgaagctttttcagaatttcaggtagttcaggtccatatgtgctttgaaattctaagggtgagaagatgactatcacgtgtttttccaattatatcttaattttcaaaataggcttattgcagcattgatgtctaattagagttgccggacacagtggctacagtccaatgctataataatctaattaactaaactctccacttatcatgtaagtgcctcctcacctaccacacacttcaccatttaaagtgatatccttttcctttcttcttttttaaatgaagaatttgttcagggagacatttggattgttcagtggtaaaaaaaaaaaagctccaaaaaaaaagcaaataagaaagtaagagtttgtactggacagcagaagtgacatcacctgggcaggcagagcacctgttgaaatccaagacttcatttacggactagctgtgtgactttggcaaattactaaatctccctgagacttagcatctttatttgcaagctgggaataatcggaggaagttaactgagaagctattgggacttaagcttcagggccttttatttgtgtagggcatatatgttcacatagtcatatgcttatgttaagtttacaatgttaagataccttaactgtgactagctaagagctctgtctctttcagtatgactttcttccatcacatggtgaagatctttggagaaaccttgaacaggtttggtgtcatgctaagggaaagttgagatccataaatttgtgtttagtgacaatatttatgtgctctgaagttatttctctatattgtcacatattgctaggcatctagtgtaggaataattttcaagtgcactcccagtgcccatgttcagacctacatatgtatttgtatttaaatatttcaatcttttcttaaagagagattccaaaatgacattaaattcaagctccagaaaacctagattttcctttggggataatgatatgctgagaccagctcagctggggagaccctaacccagcagtgctagaggaattaaagacacacacacagaaatatagaggtgtgaagtgggaaatcaggggtctcacagccttcagagctgagagccccgaacagggatttacccacatatttattaacagcaaaccagtcattagcattgtttctatagatattaaattaactaaaagtatccctcatgggaaacaaagggatgggttgaattaaaggaataggatgggctagttaactgcagcaggaacttatccttaaggcacagatagctcatgctattgtttgtgacttaagaatgcctttaagcggttttctgccctgggcgggctaagtgttccttgccttcattctggtaaacccacaaccttccagcatgggtgttagggccattatgaacatgttacagtgctgcagagattttatttatggccagttttggggccagtttatggccagattttgaggggcctgctcccaaaaatgacacctaccttatactatttctatgaagattaatgtgaaagttttttcctactttcctttgtttgttctgttttgcattctcattcttattctgaacaactctataataaggacatgaagattatctaattcagagtttttatgttttattcccaagcacttctaccccctcaaataaaaccataggcgtgatcttgatgcatgtaataagccagtaattgacagaatttatatgaagcttaaccctcactgtttgggtatatccatctctcatttctgtaaatctccaaagaaccatggcgagcctcaggattccatacgctccatttgaaaacccatgatttaactcaattccctctttttataatggaaactaatttcagagaggctaagtaacctcttgtcttcccattctatgttcaattcaccatatcttttctgtaggtttatgatagcaaacaattgttattatttattagttttaaacacaaagctacctgttttaaacaaaacaatttataaatattcttcatgtcatggaatatttattctagaggaattaaatctttaaatataagtgtttccaaactggaagaaaatacagaagactacatgtacaaatgaggctttgaggtaacctattaccaaagccatcagagatctgtaaaaatctgaaacttttgtgtgtaaatgtacaacatataatgttgttctccacatactaaattggcaaattatgtttgcaacagttatggcacatacaaactgctcttagaaatataaattatgcaaagaatgatgactcagaagcccacagaagagcacatttcaatggccccagacttccaaaaaaaaatttcaggctcctggtaatgagagaaatgcaaattaagtagcaatgaagctctcacttcacatccatcagagtggcaaaaaattaaaagtgataataactactgttggtggggatgagttaaaagggtactttcatttatttctggcaaaaatgaaaattgttataggctttcagaaaacaattttgaaatatctattccaataaaaaaaaaatgcaagtcctctttccagggccacagcatgactttcatgggccctagaaacttgtgcctgtgttgtcttctttctctattaatattatatatatatgtgataagatttggctgtgtgcccacccaaatctcatcttgaattgtaactcccataattcccatgtgttgtgggagggacctggtgggagacaattgaatcatgggggcagttcccccatactgttctcgtggtagtgaataagtctcacgagatctgatggttttataaggggtgtccggttttgcttggctctcattctctcttgcctgccaccatgtaagatgtctctttgctcttcctttatctttccccatgattgtgagcctccctagccatgtggaactgtgagtccattaaacctctttcctttataaattactcagtctcgagtttgtctttattagcagcatgagaatgaactgataatacacacacacacatacacgtactcatagacatatatatgtatgtatacatatacagacagaaaatatattttatgattgtgttggtgtaaagaggaatataagtcaaactgaatttattattactggatttactttttcttaaatttttaagataaaaatattccctgaatccctaacatcttgtgggccctgggcacgatgccttttgtgctcaacaatacaagccctaactcctcactcagaaatttgtctactgaaaccagaactttagtgatgtttactttcagcattttggtagtagcaaaaactagacacaaagtgaaaaccttcagtgggcaataattgagtaaatttggttagtatgataccattttagaaaaaaaatgtaagccaacacaactgtgtgtatgtgagttgtctgtgttagttatctattgcaatctaacaagcctccctaaaaattaagtgcttaaaacaacaatcactttatttacccatgattcgaataggttatcagtctgagataggctcttctgaataattctttgctagtcttccatagggtaattcatgcagctgtagtcaaatgacagcttgcctggggctgggcagtctgtgatgtccatgtccttccacacaagtctgatggttagtctgttcctcagctgggccatatgctgccagcaagccagcccagctttcttcacataggtttgaaaagcaacttttaaaacctaaggttgcatcactgatatgatttgactgtgtccccacccaaatctcaccttaaattgtagctcccataattcccacgtgttgtagagggacccagtgggaaataattgaatcatgggagacaatttcccctatactattctcgtggtagtgaataagtctccaagatctgatggttttataaggggtttcccctttcacttgggtctcattctctcttgcctgccgccatgtaagatgtgactttcaccttccgccatgattgtgaagcctccccagccatgtggaacagtgagtcaattaaacctccttcttttataaattacccagtctcaggtatatctttattaacatcatgagaacagactaatcaaatcacatttgctaatgtctctttaatcaaaacaagccatatgatcagacccagaatcatggtgggagggccctgacaagagcacagatgagaggaggtatgattcattaaagaacactactgtaaaattctgtcaatgtgtgcaattgcatatttatgtacacattatcatgttggtatggtaaagatcagcaggaaaaaaagaaaatggaactattaataattttattcagatagagtgaagttacttactgtttaataacagtttatattacttatatattaattcattaaaagctgtttatcaagtgcctactctatgctagatgagtgctgagtatagaacaatcttctggaaaagtgaacatcaagggacatgcccacaactaagaccgtttacttagttattgtaacaccatcttttgaggattaaaaaaagtagatatgtacttgtgcatcataatttcttagcctaggacaaatgctttattacagttaaatactcaatatgatttgtgtgaccccttggagcttgggtgaagccagtgtacagggaaaggagaaaagccaatacaacagtgcattgtcaagttgactgtggtcagttgagtcaggttttcagtcccagggcagctccctgaggaaacctctgaaacacatcgcagatctttctgcccaggagtacacatggatgaaactgattctcatcccctttgttcgagtgactccaagggcattgactttaccagatttttggcatatgcatgcatgaggccacatcaatttctgagactaaccctgctctgcagtatcaatgaaaccctcagggcaagaagcaagaggaacagggcagatgctgtatctgtgattagctaatcaaaacctaggagacattggttaccacagcagtggctgcagtaagaggtggggccaaaaggatataaattagtatacaagaagtgtctgatacagcccaccccttgcagaactgagacttgctcatgtcttctctcaagtctaatctgtcataaagtcatcttcaatctctgcaaagtttcaatacaaaagattggcagaataagtgataatccctgtattacagctgaatccaaggcaataattgatattatttatcctttccttcaactcatcctaagccagtatttcagctggttgcttgactgatgcagtgacccagactttcatctcctggagatctaggtccttagttaccttgctcttcaccagccactaatgctgcggttgcttaatcaccattaacactgagcacagaagcagcaacaggtattacattcaatcccctgggctccagacattcttctccctgcctgctagggggcagcagcgctgtctcctcagctcattcagataagctacctttgccagaacagtagtaactcctttctttgcttgatggtccactggcatgaggagctttgtttttgtttttatttttgtttttttgttttgtctttatttcttctaaacacacacacacacacacacaacaacaacgggatacatgtgcagaacatgcaggtttgttacataggtctacgtgtgccatggtggtttgctgtacctattgacctatcctctaagttccctccctgcaccccacacaccccaacaggccctggtgtgtgttgttcccctctccgtgtccatgtgttctcaatattcaactctcacttatgagtgagaacatgcggtgttgggttttcttttcctgtgttagtttgctaaggatgatggcttccagcttcatctatgtccctgaaaaggacataatctcattcctttttatggctgtgtagtattccatggtgtatagtgccacattttctttatccagtctatcactgatgggcattttggttggttctatgtctttgctattgtaaatagtgctgcagtaaacatgtgtgcatgtgtctttataatagaatgatttataatactttgggtatgtacccagtaatgggactgctgagtcaaatggtgtttctggttctagatccttgaggaattgccacactgtcttccacaagggttgaactaattttcattcctaccaacagtgtgaaagtgttcctatttctccacagcctcaccagcatctattgttttctgactttttaataatcgccattctgactggtgtgagatggtgtctcattgtggtttagatttgcatttctctgacgatcagtgaatttgagctttttttcatatgtttgttgggagcctaaatgtcttcttttgaaaagtgtctgttcatattatttgcccactttttgatggggttgtttgattttttcttataaatatgtttaagttccttgtaaattctggatattagacctttgtcagatgggtagattccaaaaattttctcccattctgtaggttgcctgttcactctgatgatagttccttttgctgtgcagacgctcttcagtttaattagatcccatttgtcaactttggcttttgttgcaattgcttttgacatttttgtcatgaagtctctgcccatgcctatgtcctgaatggtattgcataggttttcttctagggtttttatgattttgggttttaaatttaagtctttagtccatcttgagataattctgtataaggtgtaaggaaggggtccagtttcagttttctgcatatggctagccaattttcccaggaccatttactgaataggagatcgtttccccattgcttgtttttgtcgcatttgtcaaagagcagatgcttgtagatgtatggtgttatttctgaggtctctgttctgttccattggtctatatgtctgtttcggtaccagtacatgctcttttggttactgtagccttgtagtatagtttgaagtcagatagcatgatgcctccacctttgttctttttacttaggattgtcttggctatttggggtcttctttgattccatatgaaattttaaacatttataattctgtgaagaatgtcaatggtagtttgatgggaatagtattgaatctataaattactttgggcagtatggccattttcatgataatgattcttcctctccgtgaggatgaaatgtttttccatttgttgatgtcctgtcttattttcttgagcaatggtttgtagttctccttgaagaggtccttcacgtcccttgtaagttgtattcctaggtttttattctctttgtagtaattgtgagtgggagttcattcatgatttggctctctgcttacctattgttggtgtaaaggaattcttgtgatttttgcacattgattttgtatcctgagattttgctgaagttgcttatcagttcaagatgttttggggctgagatgatggggttttctaaatataaaatcatgtcatctgcaaacagagacaactggacttctaacctgcggagctttaagtgaccaggtcacagccattctttgaagtaaaggggaacccatatacttgacagatatggtaagaccaatgcctcccatggcaaatcctgctgaggtctataaaaagtagtcaccacagcagttctggtataagggatgagtcaagggatttgaagcagtgggctcgatgtgtctgatatagtaatatgtaatctacatagaggagttaattatccacaccatgtcttcttttcttcccccatttcttatcacatacaccctggaatcagagctatttatttaaataacacacgcattatatttgaattatttggttgcacatgctgtataaagcaatacattatttttattagaatgtcaatgatcatataattgtttgataaaaatttttcttttatggaaattttctctgaggggggaatatcacaattttcatagaaggatttagaagttgcactatataatgagaaatgagtactgcagatccttagcaaatatgactttattcttccacttttaacaacataaatgccttggaaaaaatcactcaatttgatcatgattgaaattcccggtggaaaaatatatttgggatttgttaattatttttcagtggggttctcttttttgagagagctgagtgatatggtttgactgtgtccccacccaaatctcaccttaaattgtaataatccccatatgtcaagggcagggccaggtggaaatgattgaatcatggggtggtttccaccatgctgttcttgtggtagtgaataagtctcatgagatctgattgttttataaataggagttcccctgcacaatctctcttgcctgccaccatgtaagatatgcctttgctcttccttcatcttccaccatgattgtgaggcctccccagctatgtggaactgggagtccattaaactatttcctttataaattacccagtctcatatgtctttattagcagcatgagaatggactaaatacactgagcatgagtggaagaaagtctcaaactgaagtgaagaaaaagggaaggggctgatgtggggagaggagcagtccctcagcagcaatgtcaagttcatttgctttgcctctggccactgaggaaagacaatgccaggcaactgtagagctgggccagcaccttctgaaacgatcttgttccccaaataaccacaacagatattatatagcaggtaaactaacaagtaaaggcagaagtgaaaaaaattgttctgtgaaaatatatgtactatatgtacatatagatatagtatatacgtttgtgtgtgtacttaaaccacaatgctgtaagaaatcataaatttatctgaaaatactgggtaaggagatagtatccataaaaaatactattcccatagaatttaaatattcagtgagctttcactgactaacttgcatacaccaggcactgtgctatcaggtatggatgtagcaaaaattatgatatggttcttatgtgcattaaggtaaacattatccagaaatatgtaggctttcttgttttcttaaattagaagacaaacagtataggtttctcctgttagctcaggtatatcattatcaggttcaactattctagcaggtggtaataaattgtttttcttctcatgctgtctgctgtaaataggatcaataaagtcagaataaagatcacaaaaactttcattacagtgcgaatagtttaatgcagcagtttctatgtgcctagattttggcagatgctttaagattctggaatatttgaaaatattattacttctctggtccttgattgtgtaaggaatgctgaagttattgactccttaatctctactgaaggggcttactttgaagactagcaatttcattatttgattctgattctgagatgactttaacagaatctcaagcaatgtaagccacatttagcaatcatagcaatagtctgatatttttgaaacctgtcctattataaaacaagcctacatttatataatcctcatatctcaaaagaagttggagaaagccactgcctgggaagttccttatcctgaacctaaatcagatgctaatatcttgttgctgcattggttttaacagtagactctcaaggatgctaatatcttgttgctgtttcggtttgaaaaaagactctcaacttgtattcatcgatgggtgttctctatttcttaacaggattatctatatttgaatcttcttttaactctgactgaagagctctgaaatcaccaataatgtcttcattactacatcaatacttaaataatggacaagaaattataaaggcttagcaaagacattcagattattatggccttttgaaatatgcaccataaactattaacttagagtgcttggccaaagtaaaacttgaatatcccatcaaattcctcatttttatgagaaaatttatactcagaaaatttaagtggcaaataatccaagtcatatggactgtaagttacagaaccaagtcacaaaaaggagttctgattcttgatctaaaagtcttcccactgtgtccttctatggccttcagttttgggcggtgtattttgtttgttttttatttgagttatatgcgagtttaaacacaattctttctgctatgggaaacggcctgtttcattttcaaattttgaagctcacattttttaatggtttattttttcattaaatttaaaaggctttatttaacaattaaaaatcagtcctattgcctcattcattgaattccataaattacagtaaaacattttaaagctgtaaattagtatacaaacgtagctatctttttattatttgaatcatagaatgactttaaatgactaaagtttgcatttagaattaacactttttaatttaaaaatctgatttttcatttaactgtgatttgtttagctaaaaacaaatggagaatttgaatttctttactccattttactttcctcaacacacacacacacacacacacacacacacacacacagagatataaataagaaaaatctacacttccaagagtcatttccttagtgaatcacatccctcacttttctccacactgtccttcaacaatgagaataaaatacgccttcttcctccataatatcagtagaaacaattcagcacaatgtttaaacaagtgttaggaccctgtagccagaattcctgtgttcaaatcctggctctgcctttttctaggtgagcaatcctagacaagttaactattaaataattgctttgagcagatggcagtgacagagcccttgaagaatagctctctctccaggccagcagaagaaaaatgacagtgcaagacacaggataggacagtcaagaggcaaaaagaaatacaagctaagggcacagaaatgaagagaagaatgtttccatgaggagtcagccaacaatgacaatgtctactaaactcctagagaatgagaacgtagtgaaagcccagggtaggtatcagtgacattcttgaaggtgagacagcagtgataacattctgacttgaggggctaaggtgtaagtggtgaagaagcaggagttcccctagattggacagggaaacgggactagcatgtagcacgtgtctacctgcccttgaatctaagatcgcagagaccagtgcagatgaatagagaagatgcagccaatggaaaaaagagaggaggtaaatggagaaaaccattaaatgatctcaggacaagcatggaatcacatggttctggggaggaagtgtaaggaaagtccttctcttgtcttccttgcaacctcctattcatcctataagacttagcataaaaccacttcacaaataaagtatttccaaactgtcctaaatcaacttatccagtttatttttctaaagtctctgagtactttgttttataatcttttataacatctaacaaattatatatattatttagttaacatgcctgccccatgtattacatagcaaattccccagagctaggatttatgacttttttacttttttcttcctagggcaaggtatagtgttagatactactaccacattagtaggtgttcctaaaataattagcaataagaaaggggctgaggtggtggtttgcgcctgtaatcccagcactttgggagggccaaggtcaggtgtaagagaccagtctggccaacatggtgaaaccctgtctctactaaaagcacaaaaattagccaggcatgctggcgcgtgcctgtaatcccagctaccaaggcaggagaatcgcttgaacccgggaggtggaggtttcagtgagccgagatcgcgtcattgcactccagcctaggcgacgagcaaaactctatctcaaaagaaaagaaaaaaaaggaaatgagagagagaaggttagagatgggaatggagactcaggagatgcagcaacataagcaacctctataggatctgagcaagatgaactggatgctaagcttcttcgtccagacccattaaattgaggaagcgtgtttgtagcatgcctgttggattttgtaggctttctctccttcttagagttttctataacctaatagtaaccctgaataaaatacaagtagagttgtttaggtttagtcatgtaatacaggaaaatttgatatattgtggagtgcaggtcaaagaataccaagaatggatattgaagtctccaggaaatatggcaatcacagtgatacaggggcaaagagtcctggttttgtgactggcattgcaatagtatggattatttttttttttctttgaaacagtgccttgaagccaatttatagagggatttgggaaggatcaaacaaaagaaaaaatgggctgggtatggggaagggagagagtagaaatgaaataataaatgtagatatactctggctttcagaaactttttgaaggacttatcaagtaaaagaactacaagctattgtaatttcaacaagaaattgaaactttgtcttttttaaaaaaatcctaatttcctccctccccttgaggcttggacaggtaaataaacccattagggggctataatgaataacatctcatacagaaattatatgcagggaaagatcatgacacaatattagcatacagaatatctgtttttaaatccacattctctctaccatcttcatttgctgtgtgctgataatgagacaatggttcctaagggaaataatgtagtttactcagggtattcattcaagctctaaaaaaaaaaaatccaaacagacagagaacatatgaggttaatattcaagtgttaatgaggacttaggtattgtgaagcttatattgtactaattaaaaataattgcatggtcctagaattagagagctttcactgaggagggtctcaaggtcattgccgcctctctggatttccaacttggctgtgcacaaacctcagtggttaccttaacaggaataattaggttctgggcaaacacattcctgcaaccaaattcactagagtctgttgagataaaaaagtcagtttcatggtttctaatgagaattacctctttccaatatagaaacttatttttgaaagcaagattaggatcagaaggtggtttcatggttaaaaagggagcagaataaggagggccccagagaccatcctacactgaacaataccaacccagataagccccatataaactatatcgccgctatgcctacgttttacatgaaaaggcttctttatccattcaagggtagaaattcccagaaaaccaatccctcattttagcatcttataacctggtccctacagcaagtatgtacaagtatatagtaagcatgtgatcgcctccagtataaaagagcagaaaggtgagggcattcataagcgattgatggatacgcaaaatgttatattacagcatttcttatcaaaattagatttaaaattatttcatgctttttcccagtttcatatcaaatcattaaaagtgaatatttttccctcttctgtacagtcaggaagactgcttatgatgttccaaagataacctttatgtatgtgctcagctttgacttatgagtaagtttctcacatgggttaatacccggccacttctagtgatcctcatgcttttcaaggtcacaacaggaaggatgtatatttcaagtttaattgtttctctcaaagcacgaggagtagacaggtgtggagagagtcttcctcagctcatcagcgtcatggaactctagctcttctcctagggaatagggcctccttcatgtttctccccctaccctatccattctttaatcgatgctttatttcccagcaattcatgcctgttacttgtctttactcttaaaccttttgcttttctctttctgccagcattttggcaatcctgtataggcctgcggccacgtctgcatgtaagcagagagcagaatttctgctttaacagaatttctctgtcacatcgtctgcttgggccatggtgtttcgtattctactggtagacataaccttcaaggctatgtggacctttaaagtcagtatgaaaatttgacttcattcttccgtctttctttattattctgcttaatataccttgtgttcatccacaacactggaagcacattagttgcttaataaaagttattctttaaatagagtcatcatttttatatagttgtgatattatttccatacattatttatataaaatcatattattttatatagtttttatatatctgtgataaaaataatgctccccaccagaggttcatgtcctaattcatggaaccagtgaatatgtaactttatatggcaaagggactttgtgcttgttaagagccttgatttgaggagattatcctggattatctgggtggctttgtgtaatgacagagctccttaaaatagtcagagaaagagactatgaaagcagagagttgcagtgatgcagcaggagggaaattccacctaattcctagctttgaagatgggggactgagatgatgagcccaggaatgtgtgtggcctctataatctggaaaaggcaagtatatagatttcccccctagaatttgcaggagaaacacagtgctaccaacactttgaatttagcccagtgaaccccatttcaaacttctaaccagaactgtatcattattattaacagaatcatcatctccagaactgtaagataaattggtgttgttttaagtcactaagtgtctgtcatttgttagagcagcaagaggaaactcatacaatagtacttcatcattttccatgataggtaatacacagacaacattcattcattgtttaatgaaaatgaataagacatttagtggctgggcacagtggctcacacctgtaatcccagcactttgggaggctgaggcaggcgggggtcgggaggctgaggcaggcgggggtcaggattttgagaccagcttggccaacatggtgaaaccccatctctactgaaaatacaaaaattagccagacatgttggcaggcacctgtaatcccagctgcttgggaagctaacgcaagaggatcgcttgaacccgggaggcaaagattgcagtgagccgagattgcaccactgcactccagcctgggcaacagagccagactccatctcaaaagaaaaaaaaaagacatttaggacttgtcactgtctaaatttttgcatgctatgaaattcaatctgatatgttcagtagtaatatttctgaatagctgatattatgaatatatagcatgagaacttttacttgggacttggagttgcaacagagaaaaattactttacaaataaatcaatagacttgatgagtctatttattttgccatcaacccaattacctttctgttcttcagcagtctactggcaaaactcaattatcgacaatggttcagacccttctgtttcttcagtggctgctgccttagctcctgtgttctgtcatctcctagggcttaatgtgcaaaaattgtgcaacccagctaggactccactgggtgcagagctaactggctgaggcatgcagggtaaatactgtcattagctcattctctgcataaaaaaatgaaatatactcaataacttctagtttttgaagtatctgattttatttaatcttcacaacaacttggtgaagaaggtattactattaggttgctacaaaagtatttgcagtttttgccatgacttttcatagcaaagccgcaattacttttgcaccaacttaatacctcaattttacagttgaaaaaaccacgttagggagagtatccaggcggtaaatgacagaaaggagatatgatctaaaatttcttaattctttattcagatgataaaactaatgtgactttgctctatcacagctattcttgtcattttactgcagtgtcaaaattctagatacatatttttaaatgtattttaaagacaaaataacataacatatgcacattataaagtgatgtaggaaatttaaaaatctgtgaacagttttaaatcacccacaatattactgctgaaaaataacacctcttactatttttatgtatttataaacatttttctgtgtatttatatatttcttttgacattatggttttgcatcccattccattttatcatatttccagtgaagtgaggtggcattctaaccttatcatatgtacaattttactgtattgtctttcagtaacctacttttgctggatatttaaatataaataaaaattagtctaccttgaatttaccttttttcaggatgaaatctatgcttctccaaatgcagtctgaggacagtagtgccagcgtcatttgggagcttgtcataactgcaaattctctactgagtccaagtctttggggtgaaatccaggaatttctgttttaataagctctccaggtgtttcacacatgcagaattttggactgaagtgtttggttttctgtaagcgttgatgaggcaaagcagcttaggcctattgtaggtgaaaggcaagcacaataattgttatactttgaagaaaaagaaaacttttttccttcgttcgttctttccttccttccttccttccttccttccttccttccttccttcctttcttccttcctttctttgagatggagtcttactctgtcacccaggctggagtgcggtggcacaatcttatctcactgcatccttcgcctcctgggttcaagcgattctcctgccttagcctcctgaatagctgggacaacaggcatgtgccaccatgcccagctaatttttgtatttttagaaaagaccaggtttcaccatgttggccaggatgctcttaatctcttgaccttcagcccacgttggcctcccaaagtgctgggattacaggcgtgagccaccatgcccggcctaatattttttaaaaatgtctgtagagatggggtctcacaatgttgcccaggctggtctccaactcctggctccaagcattcctcccacctaagtctcccaaagtgttgggattacaggcatgagccaccgtgcccggcctaattgttaactctgactgagaacttttgtagattgagaaagtggctggtagtatattgtagataaaggccacaccagaaagggtgagtgtgaggtaagcgagctcctgtggggaatttgcctgaccagagcacaacattcacattggcaagcagctgaagccaagaaagacctgttaggataacccaagttcttgtacacatagatgaagatctgtgatataatttatagatattgaggaaacattacacattatttaacataaaagtgatgtttcataactagaagaacattggttaaaaagcacactttagtgagaagtgaggagatatttgggtagaacaaccaatgaataaggtgagtgttgtaaacaagataccaaatgaaagacaatgataaggagttttggcagaagaaaaagacaatgatttattactaaatattataatggaaaagaaggggaatggtttcaatggcagattggacaaagggactaagaggaaaactagaatttgaacctgacatcctggtttctcttgagctatacataccaattttaataatctggagagaggtgtaaaaaattaacaaaacagttttattttcaaagattgtgagtttagtttactcttaactcctctgtattcctaatcacctacatccagttggattctatgtcttgccgatcttaaaaaaaaaaaaaaaacatttgaggccaggtgcagtggctcacgcctataatcccagcactttgagaggccgaggcgcagatcacctgaggtcgggaattcgagaccagcctgaccaacatggagaaaccccgtctccactaaaaatactaaattagccgggcatggtggcggatgcctgtaatcccagctacttgggaggctgaggcaggagaatcgcttgaatctgggaggcagaagttgtggtgagccgagatcgcgccattgcattccagcctgggcaacaagaacgaaactccgtctcaaaaaaaaaaaaaaaaaaaaaaattgaatcagtcctatttactctattctttgtcatattgctttagtttaagtactggtaatctttcaactggcagcctatagttgaaacagcctaaatactctttttaccttttgaattacttccctaaaacctattgcattgctgcacagagttttcattctgtataagttgatataaaacctatattgacttatggcatcttcctgctaaaagtttaaaaatacttttcctctgctttttattgtactgttttacttggtatgacattctgaattagagcagccgtgtagtttatcatctgaatgagacccttgggacattgaaagtgggcatattaataattacactgggacaaaagttgtctgggctttgccgagctttctagccccatcctcttctaagagcagtttacaaatgagcaataccaaaataattagtgaacaaacacggtttcgaaggtcttctatccgtgttgttcacagctgtatctgcaatgcctaacgcactgctcagtgcagcatagttcctcaataactatgtgcaaagggaggaaatgagggagggaggcatggaagaagaaatgggtagatcaaagaattttagaaagcttgaatctagtatgctgttgtttaaatgacatagagttgaaggtctaacatccttggaaagaggaaggcatagaaagccaaaggaggcacagagaacttggtagaggaaggttaaaaaagggaggtcccagaatcagaccacccatgaaactgactttctgattccaaccaggctctagtgaatttgactggagaaacaagtttttccagaacctaattattcctgttagagtaactactgaggtttgtgcatagccaggctggaaatccagagaggtggcaatgaccttgagaccctcctcagtgaaagctctctaattctaggaccatgcaattatttttaattagtacaatataagcttaacaatgttttgtaatttattttgtactattttatagtttaacacacaacaacccctaaggagtgtaattcaagtgcaacttacccaaagacttcactgcttttgtatcaggttgacatatttttaccgaaaacatatcttagttttgtgaagaaaactttcacattcttcattaattcctgggcagagctgtttaaaagaaagttttgtcagtagcattttagatgttctaactacaaaggagatatgtaaatgtccgttttgtacttctgaaaacaggtgcagtctcagtgagaaaaagaaaatttgtcatgagcactggaataaaaagggaaataatgaataagaacataatttaattacatgaatgtcagccgtctacacaaactagatttgatgtaattaaagcacctggaacaaataaaatgaatcaaggaaatctctttcctttttttgagaaaggaagattcaaaattacatactatttatggacaacttgtacaaactatgcaaaaaataagtgtgcatgtgagtgtatgtgtgtgtgtgcacaagagagaggcagagagagtgaagggtaatttttcctggcctcttagttcataaccaacaaagcagccaatataagttttttatagtaaggggataatatctataaataagtagaaattaaatattgttttcaatgatcatgagccccagtaaaataaaaattacatttatttaaggattgattattttagtcttttccccaacataaagtcataccaggagcttgctgtctttggtaggtcaggaatgcttatagagaaagaaacaaatcatgaatttaaatttagagacaaagaacgctctttccaggaagaactactcctaactagtggtttgctagcattgcaatatgccactgggacatttatctggggagccatttgttctgtgctgtgcttatgtaggatattttgtttgttctagctatctacgagccttcctgtgaagcctacaaacacctaggacagacatcaaattattactggatagatcctgatggcagcggacctctggggcctctgaaagtttactgcaacatgacaggtaactgtgtcatatttatgttttatgaagatgcttttctatatgtcacgaataagtagttccaccaatggtttgtttctttggtgctatgtttttatcacaacatctaatcagcaacatattgctggatttgttagataagatgatgaaatgtattattagagcaataaaacattttgacactgtgcttttcaaaaagttcatgtttgatgtgaacaattaagcatcatttttttaaaatcagcatgtagggggaaaaaaacagaaagtaaagttgcaaagttcagcccaaagaaagaactagtaacctagattagggaaatttagcatcactgctccaatattctcactgtgcatgctagaggaagcttttagatcgtgacagaccttcctcgattctccataatgatagaagaaatctttctaagtcctgaaatcccattctgataatagcaaaaattacctgaagcttttatgaaatatatttgggcttttcttcttgggaagaggacctagtttttctccacttccatgtgaaatgagattatgggttcttgtcaacttccacaacaatgtgtaaaatgtgcagatctctaagataagaacagattttccatcagacacttggcaatatcttacgcttcaaaaatccagaggaaggtgtgaggtatgcattatttactggctccagcaaaagaccagcatttgatgtgaactcctgggcataatatgataagggtaatgataataagatgctactgatggtagttactgagtgtgactgtttaccatctgtcaagtatcatgacaaatcctttggacagacacttgagtttacatcctggcttcattaatcaccacatgtgtaatattgggcactttagtaactttgctaaattcagtaaacctcagaatctttatctgtaaatgaattaatgagaatacccacctcatagcattattgtatgaatacaataaggtaatctgcatatggttcttagcttattgtctaacacacggtaaaccttcaataaaagttattggatgaaaaaatttaaaggctttagtagttaaataacttgcccatattagaccaggtgtggtggttcacgcctgtaatcccagcatcttgggagactgaggtaggtggatcatgaggtcaagaggtcgagaccattctggccaacatgaggaaaccctgtctctactaaaaatccaaaaattagctgggcttcgtggcacacacatgtagtcccagctactcaggaggctaaggcaggagaatcacttgatccctggaggaggaggttgtagtgagccgagatcaagccactgcactccagcttggtgacagagcaagactccatctcaataaataaataaataaataaataaataaaacttgcccatattattcaggcaaattcaaactgaattatatgcagcccatggatcttctggctatagttcagaaccacttatagagttttattttgtctttggttttgttttctatacaaacttcttggctccacccctgcagactctgattcattatgtgtgaagtggaaatcagattgtaaaactagaactgaaaaccatgaatggtactctaggcaagcagacaccagcgaggaactctcagcagtatcaggaagccaggcatggtacagaatgaaagggaaaatgatgagggcatcagtgtagtatggaagacatgtggagaagataataaaatggaagctgaccagcctgggcaacatagtgagaccacatctctatttagaaaatgtcccagctacttgggtggctcatgtggaaggattccttgagccccggaggttcgaggctgcagtgagttgtgatcacactactgcactccagtctaaaagagtgagacctgtctcaatttttttttcaaaatagaaataaaaaaataaaatgggaactagcgtccccctaaatttctaaatttcccctagaaatatgcaagatgctagctcccagtttaatttttttttctattttgaaaaagaactttaggcatgtctcagagaaggaacacacttaccagagagattaatctaagagttcactgacagctggacttgtcaatgcacttgaattcttttttatataccttcatttttatctttttagcactaaaatattaacctatgataacttgacttaatttataagaatctcgattctggtttctcctaatatatgaaaatatataatacaattaaagtctattcttaacctcaagggaaatcagggcatcgtggcttggactggacaattaagaatttattttagttattttcttaaattcatctcaaaggaaattagaaaagaaaacaaaactataatatacataattctcatatcaaggacacacacaacacacaggactagtctactctcaggagagcttctcctgtgcattgaaccctttgctcagaaacatatgtcttatcttcatcaatatctcccttaaacagcatggctgcaatttaactcagcacttcaaatgacttctgagctctaaggagcagaatacaactttttgcaagtagaattttttttctattcattcaagatagttacaaacatcagtgtgttcaaggacccttgaagaatcttgccttacaggccagcaggcacctttcagttctttgccactaaccaacccttccttttcctggaaagaatgtggatttaacatcataaagagagcatgatgccacaaagcttggcttgggctattccattttcaagagatacatgttaaagaagaggagggagtaacagcatgaagtagtctataaagtcttgatatgtaactctatgtcatgaaaaattataaatgctcccctaaatccgaagtataaaaggaggcaagcactcaaaaaggtgaagaagagaaatgagccatataaatcaatcccccagggcacaagagagattggcttattccaaagaactgaaatcccagtggctggaacatagtgagcgtaagagagtgactcaaaataaagcaggggaaaggtgggtgggggcaggccagagcagaccagccataaggagtgtagggcagaaaaaagtgcgcttttttttattattatttttcaattgcagtgggtggtcgtctatggaaagattttaagcaggaaaataagatcttgattgcattcatacatctaccacttgggcttctataagagacagcatgaaaacattgggaccagctctgaagctattattgcaaaagtccaatgaagagatgatgctcccttgaactagggtagggatggtttaaagtgatgagaaattgatacatttttagatctgttttgaaggtagaattgacaggattggtaaaagtttggatgagaatgtttaaagagagacagttatcaatactaacttctcaacatatggactgagtagctggatgaactttagtgccatttaggagaagtggacaattaagggtaaaacagttttaaaggaagctcaagaacttacttttgacctaattaaatgtgaagtgccatgtgccatctaaactgagatgcaaattttacagttgggtgagccccaaaagcctgattgggttagagatataaatgtgccaattattagcatattaatatatgagaattgataatatcatttgggggttgatgtaacagagaaacagcatctcaggaatgagctcttagaaactcaataggcgggacacgatgactcacgcctgtaatcccagcactttgggaggccaagacaggtggatcgcttgagcccaggagttcaagaccagccttggcaacatggtgagaccctatctctaccaaaaaaaaaaaaaaagcaaaaacaaaaactagctgggcatggtggtgcaaacctgtggtcccagctacttaggaggctgaggtgggaggatcacttgagcctgggatgtcaaggctgcaatgagccatgatcacactactgaattccagcctgagtgccagaaaccctgccaagaagaagaaggaggaggagtaagaggaggaggaggggtagagggagggggaggggaaaggaagggggagggggaaggggagaaggggggtggggggatgaggaattagtccgttctcacgctgctataaagaacttccctgagttcgttctcacactgctatgaagaacttccctgagattgagtaatttataaaggaaagaggtttaattgactcacagttgctcatggctggggaagcctctggaaatttacaatcatggcagaaggggaagcagatgccttcttcacaaggcggcaggagagagcatgtgaaggcagaattgtcaaacacttataaaaccattagatctcatgagaactcactattatgagaagtacatggaggaaactgtccccataatccaatcacctctcaccaggtccttccctcaacacttgggaattgtggggattacaattcaagatgagattcggacagggattcagagccaaactatattactcaataattcaatagagagagattagggttctcgtgttaaaatatttaataagtgtttggaaaaatatacataattgagggtaagtagagaaaaagtgtctgagagcatttggggggcaaacagatcatctgtgtggaggttaaaatgactgcttggatcctagagaatgacagaaagacttggagaatgaagagcaacttggcatccatgcacacatatacagtggatgtggtggtgccacagacgtatggcaaataatagccactagaatgcggggaacatggtatggccaggaataatgaaccttctaaggatgctgcatagacagcataggggagccatggattgagctacatcctaggcaattagggggtgttctaaatgacagagcatttcaagcactgcataggacaccagcaaaatcttccccaaaacggctgactcatgagctgagtgttgaagaacaagtgggtgttatgcggctgagaaatcaggagaaggaaaaataggtcaacttacaaaatgctttgtgtaggatgcaaagcagttgaaagtttgtcctgaggtgaaagcaagcaatggatggtttcaagcaaaagagtaatttaatcaggcattgtatattaaaaacatcactttgacagctgtgaataatattctccaaaggacacccagagataagacagggaaacaagttcgaaagcccccgtagtaatgcagaggttgaaaatggagacttaaagtagtggcaataaagtaaaagaggaggagattgatttgatgggtatttaagaagaggagttggccagaccgttcctgatgagacagagaaagttgaaaatggtaaccacatgacatggagcacagaggagcagaggaaaactaggaaaagggtaagattctatgttgctttgggtccctgtaattcaaccaggtaaagttgtcctacaggcagatgctacgcaaagtcactgtaggaccttgaacacattaaaaaaaaaatctttggccgggcacggcggctcatgcctgtaatcccagcactttgggaggccaaggtgggtggatcacctgaggtcaggagttggagaccagcctgaccaacatggcgaaaccccgtctctactaaaaatacaaaaattaactgggtgtggtggcgcacacctgtagtcccagctacacaggaggctgagacaggagagtcacttgaacccggggggcagaggttccagtgagccgagattgtgccactgcactgcagcctgggcaacacagcgagactccgtctcaaaaaataaataaatataaaataaaaaaatctttgtctcgggtttcttgtaaataaagttcagtaattggaataagttgatatcttcactgcctttccttcaaaaaaaaaaaggaaaatatttccattgttaccatgagacatgaaaaaaatcactgcttgcagtcaaataatttagacagaggcttcttatctcaaacaagcttgaatttactatttcttgctaagtttgacataaattgactcttcattttttatcgtaaggcagtagttctactatgtaattcttctgactgtctgcagctcagagctacatctcttggaaatttagaaattagggggtgtcctaaattatagagcatttcaagtgctgcacagttgatgacattgaggagagaagatttttcacagaatcctttgtagaaaaatttatcatcctgtgaaagccaaagcctggtttctttttttagatcttagggtacatgataaaatgtgatcattgttagcctcgccttccttctccatttttatgctccctctgaaaatttggtgttaaaacttttgtgaatataaactatcttatattttcagtatcaacctcttttaattgtatatttctaacatttcagcttttcatttccattttcttcaggtgttaccagcatcctctccctagataccctgaacctttgtatttaaaaggttctttctgctttcacttagttctttctgctagatgattaatagtaacaatagtaaataatgctcgatccagccattattcttgaaactttactgtctatccttaaacctaagacaatatttttcttcatcttctatcctctaactcattttctccataactccctttgcattcatttttttcttaatttaagcaagcatctgtgctctagtgcgtgaagtttaaagtccaaataaagtactcctcttgcattcttcctagccctggttttgtagttttatcaaaaagccattaagcttgtttacataatttgtgctttataaagccccaggatttagctgatcaaattctattatcctctctaatagtgaaagctgttcgtgtctttttaatctaatatttatagagagcttgtaacggaagtttctaagcgcttgcactcagtattagtatcgtatttagtattatgtttctcacaagttttacaagtacagtgtgggcaggaggaaatgggtcactgaggtggtggacttgggctccagtggagagtatcataaacccacccacctccacctccccctccccgtgtccacaaagcaaaacagtttctatcctatagtacagtcatgcaccacatagtatttcagtcaacaacagactacatctagaatggtggtcctataagattataatggtgtatgtttactgcaccttttctatgtgtagataggttatatacacagacaccattctgttacaattgtccacagtattcagtacagtaatatgctgtacaggtttgtagcctaggagcaataggctttaccgtacagcccaggtgtgtaatgggttatgccactgagatttgtgtaagtacactctatgaggtttacacaatgaccaaatcacctaatgacacatttctcagaacctatgcctgttattaagtgacacatgactgtactattttccttagcagtttacagtaatacaaatttagtatccacagtttctgtgtgtcaaggcacaggtgacctgggtcaactgctcagagtcttgccaggctgagaccaaggtgtcacccagggcttgggttttaccagagacttgggatcttcttggaagtttattcaagtgttgatagattcatttccttatggtttaaagactgacgtctcctattcttattgtctattggccccagattgctctcagctcccagaagctgctcccagctccctgccttgtggctctgcctgtccaggaggagctctctgactcgctttccagcgctgacctgacttggtcgtcactcaggataattacccatttgattaactcaaacccaccagtttacagcccttaattacacctgcaaaatctcttcatcttttccatgtaaagaagcccggtcccattagtgacaccccatcatatttgatggccccacccccagtctaggagagggtattatgcctggtgtacccaccaggtggctagaatcttgaagaccattttagaattctgtttagcatgcttacctatgtgcctctgtaaattattcataattccagcaacctttatttctaccttttgagtaacaacagtgccatatttagattataaaatcttaggctttactgttaatgctcttataattgtaacatattgttctgtaaaaactttgacaataaagataagcaaaaataaaaattgcttgtcaaccagaaatgacaattactaacacattagtcactgtgcaataaagattgtatattttatacaggtacctgcatacataattgagggcaaactaaatgccaggcacatttttaaaatatcacatgcattaactcatccaataactcatgacgacctcacaaggtgggtaatactattgttctcccattttttgatgatgaaactagagctcagagaacttaagtactgggccacacatgtagtaaataataaagcttgacttttcagccaggcttgtgtgttcagagctggtttgtagttaccgtgtgtatgtgtatgtgcacacacaagttcacacatatataggaacagcactcctcattttagattctgtagtacgatttgcaatatgattgctgaaatgagcattttttattcaaatctcttcattatcattgaaactttcttacacagctctgattcattatctgtggtttggacagcatttttgttataaacaatttacttcttaattatctaactaatgccttggggtttttaatcagaggacacattttaaatgaaatcgatatataaaccattataggcaattagtatgatttttagttcttttttttattattattatactttaagttttagggtacatgtgcacaatgtgcaggttagttacatatgtatacatgtgccatgttggtgtgctgcacccattaactcctcatttagcattaggtatatctcctaatgctatccctcccccctccccccaccccacaacagtccccagaagtgtgatgttccccttcctgtgtccatgtgttctcattgttcaattcccatctgatgagttcatttttaattcttaattcaactacaagtattttctctaatataattttctaagagctttacataatttgtatatttcctgtctacctaggtttatcatcccttaaggtttgagcccagctttcagaataacttaaactctatccccaacatctagttaatttttcaatgtaaagtcttaaactgaatctaacaaaatcttgtttgaatatgcaacaggattgaatggaattgtactggatatcatcggtaacaatgatcgtagtgtctcattcttccccttttagagaggaaatcatgtagaaatgaggacacacagagctctcctattctatattagggcttattaacattcataagttgggcgctactaagcttctaaccccttcattttcctttatatcataactatttctctgatgtgtatactggcttcctccattatattccctctactcatttttatttctttctcatcaaagccattttctctcctctttctgtctcctaacctagtttacctcctctatggttaacccactcagagaatagctgtcctttatgtcttctttcagacacatcttctcctctttgtcgacctctcacaggctgtctttgttataaacctttgtaatcactcagcaagtcctgcttcacgcattcagctatttcagttcttcacaatcagtataaatctttgaattcaattctgctcatacagcttcaattgaaaatctcggaaccaactcactgatcaaacacagcctgtaaagaactcttctccgtaacggattacccactcccaaagactcccttctggattcagcctcattccagagcttctgcctgccaggctttctttgcaatctcatcttcattgtgtgtcagccatagtgataggttaatactatagaagttctcaaatggttttcaaacttcaaattaaaaaaaaaaaagagaggaaaaccatgagatccagtgaggcctacaccacaggagaggacccagaaagggggtacaagaccccaggtgaaatcaagatgaagtggctttaggtatatcacaggtcactcagcccttctgaggtttccaaaatcgtactctctatgcaaatgctcttccttcaaatgttttcatgtaacctgacaaaacaatatcttatagacactgcttgattttgtgcttttaaaagcactgcctttcttatgcaatttctctgctcaaaatccgagaaagacttcacagtgtggatggctagggactgttgtttgattacctctggcacttggaatctgaaactcttgcctagtctacagtaatcaactattcaaacaggatgggaaacacacacacacacacacacacacacacacacatgttgggaaattcaattaagatcaactcatttctttgcaatcaaaaatcaaaaaccacaggaataatctcatacttttttttaactaggaatttctctcttccggctaaacttaaagccaataataactgtttctgtttctccaaactttaggtttttccaatttgtggatcaccttttatttcttctgaggatgtcaagtttcatatcagaatgtccctggaaattttagaaagaaaatctcatatagcagctaatctctctttttatcttgtgtctttgtccaatcaccacaaccaagaaagttaaatagtaaattgcaccaatattatatgttgcccaaactggaaaatatttaaagttttatttcctggacctgacttaaactagaggccctaaaacttttcagtgccccacataaatgattgctgcataaaagtacttgtctcattaatgaagaatgaaaatacaactttgggaaaaaatatccctgtggatgaagttgtcaaaaaatctgtttgctgcatttacgtacagacaatttcattagcattgaactcttcacataattattaatctcatgttcggtttttactcagatttctgaacaaaatcagcattaaaaagtgagattaggcaaaaacttgctgtatcattcacttcatcatcattactgttgttattcatgttttgcttttatgtgcatccatgttattctatcttcactggacccctatttgtccttctgtttctaagctcacttggtgtagctctaggtttcagggctaggacaaggcagcataattttgagagatgaaatgaatgcctttgctgctccaggcagcagggcatggaggacagagcgggaagtttgttagtacattgtagaatctgatatctttttgctctcaggttttaaaagactataaaataatattgagcatcttgctgacatttcactttgttctaacatgaagtgtttgctctctatatctggggtataccatcatcatggacttcatcttcaccatgtctgtgtttatttatccaagaatgtcttcatcccccctatattggaatgcatgatttttatataatgtcttcttcattttaattttaccctctaatgtggatatagcacatcccctggtagcttcttgatcctttagtacaacctacttcttctctgaaagttagaagaatcttgtttttgttccagatgttctgaaatttcaaaacaacgtgacttggaataggtcagttttcatgtatttgctgggtgttcactttaacattggcaactcatgttcttacatttctttttatttatctgtttgtgattctgtctcttatgatttatctattgtctctttctagaatgcttttcattgtggttttaaatcagagttcttttttcttcttgaaaatttccttttctaatggcgttctattactgctttatgaatgcaataccttttttgtatcccaaggataataaaacatctttttttcccttctttcttagttttctccaagttacttgattctgttcatttttttctgaccttcacagctttcctcatattcgtgattattattagctgtgtgtttattattacgagtgggagggtcttgttgacttggagctttactgtgggttagagtaacaattatgtcctggcttgctcagtacagtcccattttactcccattgccctgatgtccttgtgaatagctcttccttttattctcagtagtgtccttgtttggatgataaattatttgatcacctcactgcagaggaagctgagtgttcccgttttaggactctctcatctgttgtcagcattatttttttcattttctctttattagtcaggttctctaaggatacgttttaaaattctttcctggaggtttctgatctggttgccaacaatcttggaaccatttggggaaagaggtctaacagcatgaacattcagtatttggtacaagtgtaggcaatctccattttctgtgtagtttccacattctttgtaatacttggttcttctcaatgcagggattcttttagaaaataaacctccagttatctcccagagtgagagaggagtagtcaatcagccacaaggcttaggagacctagggatctactatctgtcaaacagccttaatgcagttctccttactttattaattactgaatcttttatggattcatggtcgaaagttgggttggttctcatctttccagactttcaagttaagattcagcattctactaagtcagtgagcacatattcatttactttccatcctccaaaattgtattgctagtattgattcatattctcccggtctttgtgggaaatgtgtgtgtgtgtgtgtgtgtgtgtgtgtgtgtgtgtgtgtgtgtattccctagctttaggagtatgcatatgtgtatgtgtgtgtgtgtgtgtgtattccctagctttaggagtatgcatatgtgtgtgtttgtgtgtgtgtgtgtgtattccctagctttaggagtacgcatatgtgtgtgtgtattccctagctttaggggtatatatatgtgtgtgtgtgtgtgtgtgagagactgtgtgtgtattccctagctttaggggtgtgtgtgtgtgtgtgtgtgtgtgtgtgtgtgtattccctagctttaggggtatatgtgtgtgtgtgagtgtgtgtattccctagctttaggggtgtatatatgtgtgtgtgtattccctagctttaggggtatacaactgtgtgtgtgtgtgtgtgtgtgtgtatgtgtgtgtgaattccctagctttaggggatttagaaggcatataagttaattgtcagtgtgccagtgtttactcaccatcctaaccaaggtgcagcttctttatttttaattctgtaatttaatgtcataaaaccaaatagttcaaatacatgtttcaaaacacgtattttaaaatgtatgaaaatctccaaattttaatgtaaattaataaattttcctttttggttaaggagtgtcataattcttaaagtgtttattattgattatctgctgtatgagaggtaatatgataaattctttcatctattgtgtttcatttattcttcacaataaccctgagaagtattagggtcccaattttgagatatggaaactgaaacacaaacagatattaacattctctgtaacacaatttacaaaaggctgtttacacaaagaatatagatttggatgacatcctgtatcatttagtggcataagtgtgtcactttcactttttaataggttgaaacattcgaagaaaccctcagttcttataataatataaattactattattattatttgaaaatttttttcttctctctatgatttctggttaactggattctagactgatcaagggccatgtctgtcttgtttactactgaacccagcagagtgtctggtatatgtcagcactactactgctgtgaatagacctcaccactgtgtctttttcagtagagctaagtagccaccaccaatctcagtgctaaataagaaaacaagtttgagataggtaagagtgtgcatcacttataattagaagacatgcgtttattagcaatatgctaaaaaaatcattcccacaatctgtcctataaacttgaaaaagtccaagtgctctatccttttaggtgctccaacttgtccttgtatggctgtttttacagtaaatatgaaaatattctagaagcaggattgagtttgccttatactgggatcaggtaactagagtcctctaatttaatgactgaaaaagatctatttaagaatcaggcctcagtcagcattatgaaaagtaaaaggtaaagagttcactagattctttcatcattttgatgcaagagtgaagagttactaaaatgttttagctaagcaacataggtgaacatcagtaatttcttccaccagtgaaaagtcaacttccataatgcaactaacaattaaatttatgtaacaaaatagcaggttttgagctatgataaatgcaacttatacgtttggggtagtatctacctctaaaatctgttcttttaatgaaatgctagccaacccccctatgaagtgtgggttttgttctcgcttagggtgactgaccagccttacaccaacccttggatatagagccatattgtctaatacacatgcaattatatctaaccatccttgggatgtattttaaaagtaaattacaaaccacatagcctatgagttgactatccaggtagttttaccaactgtttataaaagaaactatgtcaacataaagcagtcagtttggaaaacacgtgcaagagatggttactttcacgtgaccagcatgttgcttagttgtaacatgctataaagggttgtgttttactaacagtgtcactgatgatcctcggttcattcatcatacttctgcgtcactgctgctacttactaactacaatcccaggccagcttaagcattagttttctttacattttgctttgctcattgcttctttaatatatccttattaccatagtcttccctctgtgttctccagtagatagaagaagaggatttgacatgacgctaagcacattaatataatagtttcttctcccagtggtatttgcatttcaaagagaataacaacaagatgaaccaaaatatggaagcaatattttcagacaggataccttccattgctctctaaatcactcctatctgtagcccccattctacttgtgtatacaaaggcttgtagcccatgtaacgtttaaagtctctcccatgtagagtttcttctattggggtggcaggagggggctgaaatggcaagccactatttctattaactgctctgtcttttgcttcaatatctgtttcataacaagttttttttttctcaatagctaccccattttataggcaaaggctcagaggaaaatgagatcagagaaaaaaaatgagttaaatatcatctgcaaacaaatataaagcaacacaccatgcaagaaaggctcaccccctctggatagagaattctctcttggtatcgtgttggtgtcattgttctcaccacctctactctcctcaagtttatcttttctttgggagttccagattctatttattaagtatccagtatttccatacacagtattcatttttaatattgaaatcctaatctccattcctattgatatttgatagcaaaatgttccaacttctatacaacatttgagtacttccttcattgtggccgctttagaatctatctgtatgtaactatgggtaggcaaggaccaaacttgctcagaaagtttcatagatgctgcggttttatcattacattgcctatctgcatggtgatttttttaatcagttattataagcatgtttgatacttttgattgataatggaaagtaaaggaatgaaagttcagctaattaaaagagatgattagaaagaagttggctttgcaggagattggttgataaaacaactgatattttctttttcttgtttcaagccttgggcagaactcttatgaaagcatttagaatttagagggcttgtcatggccacactaagcatctgactcatctggttgctgcaatgtcattaaaatgaatttttggtgccggttcaatttgtctttggctctacagacatgaccttattcacattgattgctctcccattaacggtagtgtagtaaaggaaacgaaataagaatatagtgttcaaaagcaggtctacatgcaaagggtttctttaacagtattattatatcatgatgttttcagagatgtgaagtatatttattaagtatattcctagattataagaatgttgctttaaatgatatattaattttctaccatagtggaaaattatttagtatacagtataaatcattcctaaaataaaaaattatgggatttatataagcatgtcaatatcaacttttcatttagaaaactacaaaagaaaccatttatttaaacactttaaaaccctgtgtattacgaaattaaagtatcattttcaacagagatacaacttttccgtcttttgccttctctaagcttagaaaactcacaaagtttatgaactttaaatcaaaatcaatgtttcttagtttctcatcaatattattttaaaatattgaatatctttaataaatatggagaaaaaattaattcagaaatattcttgcaaattggtctcttttaacataatctttaagtcattgcttacacttcccagtcactttagtaaattcttaattgacgtggttccaaatctcttcctaattctggtcattatgttcttttttaaatgtaatgaactgtgtggtgtgattaacagcaagcttcatgccaagtacaatacagtggggttttatcagatagcagagagagggtgtgaatcgtttcccagacttatgaaatatctatgtttatcattctttgttatctcccaggtacagtttttagaattttaatgtgtttaaataagcttgcataattgttaatgtatttacttaaccaatatttatgagtgcatcttatgtttcaggcataggtacacagtgacaaacacacataaaatctgattgtgtggaacttataatgttataagtatgtataaaattatttcaaataatctgttataatatgccagtgatacagttgttgctgtcagagacattgaattattgaaaaatgagaaaagtttacattattaatatgccatttatagccaatttctgatagatagttaattaccttaagaaagcaattctcaaactttagtgatttgtgcattgtcttcagaagtttcaccaagccccagaccacctatttaattatttaataaatatgtttttaatggactccctttttaaaatcttattctcattctaagcaacaatttccatgaaaggttgtgtttagttcacttgacattgcttcctactgtgctgtcagaacatcatattgtttagatatatcataatgcaatatcatatgaaatgatatttcacaaaccatcaatggtacatacacttgggaaattctggcttaactaaatccttgtacctaatttaataggtacttttctccaaaactattaacttgtatgaccttagaccaagaattgtgactagtacaattcacaaattgtcaaaattgaataccttatctaaatgcaaagaagtcttcagcataactttattttaaaacacagatgttgtgatttgatagtaaattattcaactggattctaatgagttatttgctgactgttcatgcatgttgacccaagtactcttcattcccacatctgtcctttagacagtctcctttttctgtccttccaactataactctgatttaatatttaatgaacaattactatgttttatattccttccctcaaagaagacaagctgtcccaagacattctaaaatgaccactcctcccacccctgtgagttctctgtgcaaccctgccgtccctggcctctccttctgtctctcaccttaccaagctcttagtcctaagtttcaggtaatggctattacaccctcactgaattttgagctgaagagaatattaattacctagtcacatctagttttacagatgaaaaaattgagacttatgttttgacagtccatacttaaatgctgaaattttttttaattgggttcagcatcttcacagaattaaccccaatcatgacagttcgaacatttcctgaaaacaccttgtattgctgtctatttccatcggtttgcaaaatgatgttgatcttgttttttacattatcattttttttttttttgagacggaatcttgctctgttgcccaggctgaagtgcaatggcacgatctctgctcactgcaaccttcgcctcccaggttcaagcgattctcctgcttcagcctcctgagtagctaggactacaggcatgtgccaccgtgcccagctaatttttgtatttttagcagaggcagggtttcagcatgttgaccaggctggtctcgaacttctgacctcagatgatccgcccgtctcagcctcccaaagtgctgggattacaggcgtgagccagtgcgctcagcccattatttgtttatctaatagcttaatcattcatcactgacattttgagcatttaaacaacatcatcctcaataaagttctagaatttctccaacgctgtgttctagacatggcacttcatgtgaacaattccacaggaagtaggtggtactattactattcgcttttatatgtgaggcagccaaatcataggtagataactggcctagagtcaaccattattaagcaggagagtggaaactagctttgtgtgatgttggagatcaccatttttgtcacttcattataatatccactttattccaggtgccattctagaggtataagatactgtataaatttataagacacaaattatatttttaacagatctttggtctagtttaaaagacagaagtaaaagtatttattcaccagatttacatacaagtaattttgggctattgtcacaattcaaatctaccttcataggagaaacattcatgattatggatatacatggaaccatgctgtatagacaattccaatcaaaatgctccacattgctttggacaatgtcaggatcactggaataagtacatagcatggcaaaatgagttttgtgttgtttttcctcctggaaataaagccaatataagacccctggtcaaccaagagaaaagcccataaaggcaggttccagtagctcagagtaagtgtataggatttcttgtgacaaaagcattgtgacatattatcagtgaatttcccttctcccatccaaatctggtgattagtcattaactccagcttaacagcaactcagcagtaacaacatgtactcggtttagttatctgaaataaaacaacaacaaaatgtttctagtggtatgactgttgtaaaaatatacattatatacaaagcagagaacttatacatagtaggagtttgctaaataaatatttctaattgattaaagaaaatacaatagtaagggcctgcctatttatacatataaataatttgagttatggaatgtaatgtgagattatataattttttctccttgtgctgtaagatatgaacaaagagattttagaagaaaaagatataaagaattgtatcacttattaaaaacttagtttattgaagttctttaagagacattgtacttttaaagaattttcataatagcctcaagtttcaaacaagtgaatgtctgtaattgacagccaactctaatgagagttgtggtgttggaaattagcttagtatcttcaattctttaccctgaactggtttacactggcacttgtagattgcatgttcttattggaggtgacattgagagattacattaagttggttatcgatcatactgtataggttcactttactaaaatgtaatctctgtttcaacaaatctaaatctgacaaaatatgccatttttatgccttatggactcagaggttataagggggatgagaggcaggttgcagccccaaactctgggcatttcaaatctagcccagagtgttatttattaaatcaaatgatacatatgaaaatgtttcctatatttaatatgcagatatgaaactatagtactttaaaaagtacaaaacaagtgtcattgaatactttctatctacaaaacattctggagagtatttgaatgaataaatcaattccctccagatatttagtagtaaagaaattctttatgccaatagtgatttatctatcctaattatcataacagaagtaaaacaaaatagtgaatatatttattttattatttctagcttatcttattaattgtgtcagcttcttttcctatttttcctcgtatgagttaatctggtcttattctttctgaactaaccatatcctaccctgactttaccaaacatacaaaagtaactatagccaaagctactaatattaatctggacttccttatgcaaaacaatgttcacattcatttaactgcggactctaatccccagagcctatttaatcattattgtgatatcgtttttgttacttcaaacatttggcatgcaggcagaaacatgtatatgtgtattcctgggaaatctatcaagcagattcccaggaagtctcctaaggtgatattgattacattcataatattattattgttcagagaccttgttgaaaaccaagaggtggtgaaagcctaagcgaatgacccattaaataaaactcagtagactgatgtatacaactaaaaagccaattaatttaatttatgagaaataattatctagaaaccctgaaactcaaaattataactactgcatcctctctctatggcagttccacataatcagctccatttgggggcttagaatcagcatgaaaggaattacataaatcacatgaattgatgacatacggctaagcctgtttgttgcattattttgctacttcagtctgctggataaaattcctctccattggatagtgctttgacaatcaccaaccacttctgctcctacaactctattttttttccaaacttttaaaatggaacaaataccattctgctcatttcttatatatatatataaaagacatgacatatatatatatatatatatatatatataatgtcaaacagattaaaattagttctttctgacttacaaatcaatccatctcatataggttagtttacatttttctattctgatccatgtaccaattttaaagtttaactctttgcagataattgtattcctcacatgtccacattgtggggacaccaaagtactcacagcatattctctaaggggagatgtctataagtcaacattataaaatatgaacattatgtttactgtcagtgtctcagttaacaaaataattcattgattctcagatccatatgatttttcacaatttcaacatctctgaaatcagcatgtgtcttactatcggtagcatctcacaatctctattggccaagccgagacggtggcatgggtgtctcttcctgtggacatgtggcacttgtatcaaaacttgaagaataggcctcagtgccttagaggaaagttctggagacaatagaggctcaacctttttaagaactctgtcaccaatgcttttgtagacagagagaaccattcagagggcacatcagtgattcaagccgcaaagtgtttcaagagcgttagactatgaaagagaagaaatttggggaatggctcaaccaagtcatgtcacttatgttttccttttcaagtatgcacaaaagtgatataatttttaaaagattagaagagctcttttgagatgcttcattttctctttcttaggggttcacgatagagtggtgtatcttacaatccatggcctcctaattatgaaatataacaatgcatactttcaagtaatattccatctgtatacatttattagacattttagaaatactaggagcagaaatcaacatctttttcaaggcgggcaaatctttatttactcctttgtaaaggatcattttagaaagtcatttccttattctgaaatatgtagtggataaatttaagtaatattttcaaattctgtcctaatagcaaatggaaaaattaaagctgttgattcatgaagtatgatgatctattctattaccacagagtcaaagccattacatggtttgcctgtgaaaaaatagtagagaatacaaatttgtgtagataagatatgggaagaaaatgtcatgtttaaatctgtaaatggaattccctggaaaagggttagcagcaccactattaccgatgtgaaaaattcagagcttcttgcctcttcctctctgatccagagatgctgctgagaaagaaacagctctgttttgaagaggctacagcaggcaggcatcttcatgcttacacaggcctctctctgctgaggtggcctcttggggaagcctcacaaaaactccctatcctcagctcccaggatcaggggagaaggatgcccttgatggcctgcggagatcttgagacaaggcatgcggccaggacagacgttgattggcatgaccctcagtgagaatctcagtgaccttcctaggacctcctgggtctgctagggcacatcagtctctgagtctctgtgttgcccacagccttctgtctgcactttcctatttgacagaaacagcttcataaaagcagttcccataaattgaattcccgtggcttgacctaatttactatctccatatgtcggttccaaatcagcagcaggcatatttacagacctgggttggttggcttacccaattaaagatgttaagtaattaaagtgtattactttttcaagtatggagtattatttttcaaataatgcagtatatccttatatactgcactatttaatatgctgttctaatttaaaaaacaataaatatcattactatgagttaggaataaaataactggtgagttatatatatacaaatttatatgtatatttgatataaaattatatataaatataaatacatttacattgtatacaattatatatgtgtaaataatatttattatctcattatagatatatagatctattaatatatagatagatgatatatatagatctatatatatgatatcaatatatgtgtatagctatagatgatattaatgtggaatcacaactagaaataaatagtaggcaaaggtaattttgaggccaaaaatataaatacttataatctctcacctttaattaattcagattttaaataattgaccaacttattttaaattattttctatggaatttctgtggtgttttacctctctaaaagtgtgtgtgtgtctgtttgtgtgtatatatatgtgtgtgtgtgtgtatatatgtgtgtgtgtatatatatctacatatgtatgtgtttatatataatactttataggctatatgtcagtaaaatatttgaaaagttttattctgagccaaatatgagtgaccaatggcccatgcatgatacggcccttgggagatcctgagaatatgtgcccaacttggttttacacattttagggagatttaaaacttcaatcaatacatgtaagatgtacattggttcagtctggaaaggtgaaactgaagcaggaaggagttagggggcaggggcttccaggttataggtaaattaaaagattttctgattggcaattgattgaaagagtttaattatggtctaaagacatagaatcaagagaaagcaatgtctgggttacgttaaggggttgtggagacaaaggttttattatgcagatgaagcctccaggtaacaggcttcagagaaaagtttgcaaatgtttcttaacaggcttaaagaatccattctatcagtcttaaggtctgtgttgatgttaatgctggtcagctgggcctgaatttcaaaagaaaggagggtataaggaggcttatctgactcttcctttctatcagggtctgaactagcttttcaggttaactttaaaatgcccttggccaagaggtggggtccattcagttggctgaggggcttagaagtttatttttagtttacatagatacacacacacccacagagagagaagaggaaggaaggaaggaaggaagggagggagggagggagggagggagggagggagggaaagaggaaaggagggagaaaaggagggaatgggagggtaaagaatgaggcagaaacaaaacggaaatacccttcacagctaacctgtgcatttgtgctgccattgggcttgtcattagttgtgttggttgttccttgcacaagggcagccagactagtgagtcagggctgaaatcagttcctgttccacttggaaaccacatgctctggcacccatctgcatttgtggggaaagtgacacctttttctaattcatgcaaagacaccatatgggctacctgtggcctggcaacagagtctaccacttatacccacagaagattaagcatttgtgctcatcattaccctttccagccactgtcttttaaaatctagtgacacttcagtgcaaagttgtttaactgataccttgtttttggtgaattgagtagatactggcaacctaacaaaccacgagaatttggacagaggcatccccaaaaaagcagtgaggaaaggaagtgtttgcagctaaaatacatttaattacatcctgggaccacttcaacatcttaagcatgtggaccacagctacctcttcattaggtgttgctctctatttgatttacagaatgcagggtcagcacttgtgaattagcgtcgtgaataagacattcataaaaccttatcagttcagaaccgatgctaagacaagacgcaggtctagagctcataagactggtgacaatttcacttatttatgtcagagaaatgttacacctgtgtttttatagcataaagttggtgagccttcctctgtgcaaacctcataagccagacaacacatgcaattaattgacagagacaagagaatccccatttctgttttctgcatggctgctttgcttacatttcagcatactttacctcagttttatttttgaacttgatctagtttggattttgtacacccctaaaaattacctaaactcaattgtaacactagactgctgctgaacgtcatgcttatagagttggaagtgttctgttgaaggatcatttatccaaaagcaacagcaaagatttatcgatacctagtaaaattctgccattccatccttcactgtccagctcccttctgaagatcggatattcttttaaaggcaaataagacgcatagtggtattttacttggaaccttatgagagagaactcaatatatttgaagaccctggcatttgtttttaaaaatactttattgtgtgtgttttttctttccccatcatagcattgttaggggagaaaattgcattatttaaaagtatattatgttagaagccagaagtcttgagctatatttctctgctgtctgtataaccctgagtccatggacaaataaatttgctttcctgagcctttgttttcctgtttagaaaatgagacaattgatctagataaaatttaagctcccatccaatcataaatgttccataatactaatgtagaaaaagcaggttactcagaactatttctgaatccaaaaagatagatagatagataaagctactttataaattatgaattttttttgtagagtctgagactttatgtaaaagagaaagagagatggacatacagagagagagaaaaaacaaaacaaaacgaaacaaaaaacagagaaagaggtgctggatatatttggaccctcctttgtgagaagggaaaagatgatcccaggagaagatgggatcatctcatccaagaaaagatgatcagctagaaccagattgctggggtagtctagaacaaacatttcaaaagaggttcactactttatgaggagacagttctcaaacaagaggatactctgtgaatagatgtattagaatttatcaacagaagcactctttcttcaccccttccagctatagtaccctgaatattttgatattttaatgcaaaagaagacatatttccctaggttttaatttttgactacccaagaaaattatcaacctgtaaattgcttttttctctatattgatataataattagaaccaagctaatcagatgtgccattatgttctttccttcacatcatagtgccaggcaacattgaggggacagctggccagcctgatgccaaaagagaggcatctaagcctcttcaggcaactgacatttataggaattatggtatagcatcaataattcacacaacctcacaacaagtgctggtaagcagctggtctgtagacaggggcctcatcacttactcatgtttgagacatttatactggttcattgccttaccttaaggcttctttaattgtagggaccacgaaaagaatgcagcaactagcaattaaagcaaaagtgctgctctgcattataagggtatatgttgattacttcatggagagggtgattggcttttgaaaccctaagtgaatgtttggtcacaaaaatctaacattttaaatgatcaatttatttctgtttatcatttccttgagctgtgaattgaaaagaaaaaaactctaccacttattttatagaatcttagacatttagtattgaatgtttccttagaaatgatccaattctttattttgtttaaaaaacaaagatctagagaactaaagtaactttcctcaaatcagacagctggttagtaaaagttttaagactagaactcaagtttggtgaaaatgtttcccctaactgacctttgcatgcacaaagttcgactgattataatccttggcttgggacagactgtcattattcatcaataacttatcaacttttattttacaataatataataaaggcttatggacccagcagccctccaaacagcaaggagcatgtcaataatatgctgaacttatggtccttctcattcccctttccttctccctttgctacctagaagtaaccagcaacctgaatcctgcattttcttgatgtactttgcatagttttatggcatgtaaatgtatgtcttaaaaatatatttttaatttataaaatgtgtatcatgctgtatataacatgacataatattgccaagactcatccatattgttgtatatgcctgtatcatagtgtatttttcactctcccattaataagcttttggattctctctaagttttttccattgtgaacagtgctgctatgaatattcttgtaaatgtcacctattccaaaggtgcatgagtatcccaggggtatatacttagcaagaatttcttggtataacactatacagttattcagtttcagaaattagtgacaaactatgtcccaaaggggtggcaccaatatggactttcaccagcagcgtggaagatcctgtagattgtatctatctggcttttactgtagagggccatacagtcattattgttggctctatgggcctcatatggtttctttggcagctactgaactctgtcattgtaggtaaaagtagccacaggtaacacataaatgagtttcataaattttcacagtataaaatattgttcttctgcttctttccaaccatttaaaagtgtaaaaaacataatttgtgagtcacacaaaaacaggtggcagactgattactttttctttcctcatcctatcttcttttatttattttttatttatttaaaaaaattattgatagcctgttacatgccataacccgttccaaattgatatggtttggctctgtgtccccacccaaatctcatgttgaattgtaataatcccaatgcatcaagggcggaagcaggtggagataattgaatcatgggggcagtttcccccatgctgttcttgtgacagtgagttctcacaagatctgatggtctttataaggagcttcccccttcgcttagcactcattctctctcctgctgccctgtgaagaggtgccttccgccatgattataagtttcctgaggcctccctggccatgcggaatggtgagtcaattaagcctcttttcttcataaattacccagtctgttatttctttacagcagcatgagaacggactaatatacaaatactgaggattctgtccgtgaacaacttataactttcctgctctcacagagtttgaactctaatcagaagaggcagaacatagacaaatgtatatattctaagcaagtcatgataggtattttaaaggcagattcagagaagtagatgctggtggtaggaggtaatagtttacatagaatgatgaggaaagccctgtttgatagaacaacacaagttgagttcatttttaaatgagggattggaacatccaagtatctgaggagaaactactgagtgagagagagcagcaaacctctacacctcctcccctgagcttttatggttctaatagcatgctgatatctcttcccaaatattccacaagctcctttaagtcttcatttgccaatctaaatttatcatctactacagccttggatttcctaacttggtgaagggcacctgtgtgaactcatcactcaaaccaaaacccttcaaattttcctgcatcttaggttgccttttactccaagcatcaatttactaaacaagtaatttcattttttcccttagtatctgtattagtttcctagggctgccataacaaaataccatggactgggtagcttaaacaatagaaatgtattttctcaacttctggagtctaggatcaaggtgtctgtaggtttatttttttgtctgtggcctttctccttggcagatgacagctttctctttgtgttttcaaatggtctttcctcatttcctcttcttgtgaagacatcagttggattagatgaaggctcaccttcctggcctcattttagctttatgtcctctttaaaggtcctatctccaaatatcgtcaaattctaaagcactggggattaagacttccacatataaattttgagaggacacaattcagcacatgagtatcttctaatctaatacctttcctctgcttttattgctaccaccttaccatttccttcccttttttatttatgtttattggttttctgattctagattatactcttaatgatcaattgtccccaaaaccagcagaatagtcctacaaaaataaaaatgtgatcttattttattctgcttgaatctttgatttgttccccagtagccttcaggataatgtccactggcatactgtatcctcaaagaactgcaccatctgcatccctgttcttcctctcaccaggtaaactctcatgctgtcagctacaacaatagtaaactatttgcagttcagggcctttacaaattttctttgcctgaaatttcatctctgccttaatccagtctttttaagtgacagattaatatattccaagaagcatggctcaatgtcatctatgaaaaacattagcataccatcattttcaccattgtctgagttagctgttcttcctctgtctcccaggtcatgatatctttcatatcactgacattgtataggataattatttctgccttggactaagtgcctgtgaacagggactgtgtcctgatttattcttacatctttagtgcctagcaaagggctgctcctcttaggcacttagtaaatatttgttacatgagtgaatgaataaatatataaaggaataaaaatgattagatagaagaaacatttttgtatattattttgatactctaaagctaatattctaatggtaatcaatatagtttaaaaataaaccattcaattttactaaacaaaatggtgaactataattggattacatggtataattatgacaatatgcatataaaaattaaaagcctacatagcaaattaatacaccaataattactaaaaataatacactaataattaaaagtggttgtttctggttttttttttttgcaaatgattaagctgtacacaatttattctttttttatacttttctgtatttttcaaataaacttgattctatgaaatatcccatgacccaattcatgttaagcaaatttactacccttttctcaacatcttcaaactgttttctttacatttcactgtttagaaaatataaaatgatatctgcaacaaattacattctgctacaaatccacattttcacgacaagaacaaaaaaatgcataacaaggcatagaggataaatttctctccaacccactgtgaaattttcattaagcccctcatatcttctccaggtctaggccctaaggacaaatgaagagtctaatctttgatcaaggcttacttcaagccaaaattatctattgctctagagaaactcttccaaatggtcataccctgctgctatgaaggtgacagtcctccccactgctcacatattgcatagctgcaggatgcgaggcaaagacttgaaaaacaagattaaaccttactcaaaacattatttccattaaaattacatcacaccgaatatcattacctaaatatttttatctttctgtaactcttacaaaacaaacattacccttgaggcaaccttgcagaataactttcacttaggagaaatgaaaaaggaacagacattataattgtagggaaagaataaaacaataatggtgcactttcttaagaccttcccttatttttttttttttcatttgctgattatccctttggccaaatagtagaactgtggaggttcagagatggaaggaaccttactgatcatctagtatgtatagcataatttacagttgtggaaatttaaagcccagataagccaaggaacttggttaatgtactgattcttcttcctctgggaaacctaggaaatgaattggatgataagtgacatggctctgttattaatttcagccatgtgattgatttcacaggttcttcagttaaaaagacttgggttctgtcccccttttaccacttaccatctgtttaaccttgggtagattatttaggcctttaaaaacctccatttcctcagttgtaaaatatcaattttagaggacctatcatgtaaagaggtgttaggattaaatgacaaattgcttagaactgtacttgggatcatagttggctactactattgttgttgtcatttatcctacaggtaatcctactgtttgagataaggcattctgggagacaagatttaagagcttttgaagaagacaactttatcacatttgcttcagactgtttagtgtgtgtccagcttcaatatctctctgtttcttagacattttaaagactgttaaaggaggagaaaggccagattacaacaattgttgacatttagtgaaggcttagtataaaacaggctctctcctaagtgaattttgtgtagtaacccatttattcctgaaaacagcttcacgaagtaggcaggcactgttctaatatctgctttgaagatgaagagacagacgcaggggttggtttcaacatgtgaaagtatattttattatcacctcccacattcacttctgcaattccaacatttgcaaggcaagagaggatttgccaccctctggtgtctctttttttttttttttttttgagatggagtctcgctccagtcaccaggctggagtacagtggcccagtctcggctcactgcaatctccacttcccgggttaagcgactaccctgcatcagcctccccagtagctgggaccacaggcgcgcaccaccatgcccagctaccctctggtatcttgggtttgatcttctgcttcgggctgtggcttcaggagctggcagtggcttgcgtggtggcaggagaagttcccaccagtcctctggctgtcataacatgcatttcatagctctcaccatatgtaacagtgagcaagtttttatttatcaaaaaggtagcctttgatgaggggcttgactacctgcttatgaattaacaaatagcagatataaagatttctaagtcatgctcttagggcaagaaaatgctttgaaatactatctgatctgcttattttctgggttttcgccttctccaccccttccaagtcaaggtctgagtctgagttctattggatattcactacaactgagagttattattgttctcagctttgagccttaaactaggcttttagaaactctaagcaagatagcagttttaaagggaagaatttttcctgaatgactaaattaggttttatcatagtcaaaagcatagattaaccaaggcaagctctaaagtaagaagcaatatggtaaaaagagagcatggtaaaaacaaagttcttatcacatcttaaatagaaaggcctttctattaatggtatacaagagagaaagcggaaggagagagagaagagatgggagaggagataggaagagaaaggggtagaatgaaggaaaaaaagaagaaataaaattgctgtgaaaggagagcaaaggatagcagagagaggaacaaagcaaaaccagacttccctcctcccctcactttctgcttggtgcccaaatccagagcagaggcagaatgcagagatacccagattgttttcagggaactaagatagggagacacataaggatcatctccttcaataaaaagagcgttgatgtcctcataaattttctctattcttaatgtgtcactctcctctaacagccatagtcagtaaactttttatgaattcccttcttagctttgtgactcatgtctagatttagtagccctgatctctgtttatcatcccttaaccttagcattcaaatgattcaccaatttatgcatgcaattgtattgtgatgccttattttccaatctccaaagaagtgtcatttgggaaatattgtacaggtctggatataaatgttactctatccaacatgtaactcatatttacaaattgaaaaagtttcagaatttttatggggacatttaaaaacgttaggtggcttaaaatattccctactgatgtacatcatctcatttgaaataatgtattcgatggaagcaaatgatctagtgaagagtattcttcatcttgctttccataataacttacggccgtatctcagttctcaaaatgcttttccaattacagctagcacttgatcatttgcgtgcacagcactttacctgaacgattgttgtggcacttttacctttctaccttgccacctgtcctgagaccctcctcagaaatcgtagttgctgagtctggagtagagaggttggtgactatgcagtaaggatacactgtgtctaacttagaatcttacaagatgtcactgacctccatctcctttgaagactctccgtgacctctaaaagttggagttcctgaggccttaccctgggctttcttctctttgcttgacgtataaatgttttgtttttgtttttgattttttgttttttttggcagtcatctcttccatttccatggcactaaatgccgtcttcatgctgcagctccaacatctgttaagctccagatgtttatatcttgttgtttaccaggcgtcagcatttaactgtctctcaggcatccccaatctgacttgttaaaaatgaaacttttgatccctccaccaggaaaatgtgttctttcattattcatttagacaaaaaactggcagtcatcatacacactcgtctctctttctctccttttctttttctcactctcttttactacctgccatatccaacccaccaataacttctattttttaaatttctgtcaaatatatgttaaacttattgaccttacatccactgccatcaccctgattgtagctactgtcacctccattcagggctacaagatcttctacccctacctaccccaatccattctccatgtaacagacagagtgatcttttaaaaacagaaattcgattgttttgcttccctgcttaaaacctgtcggtgcttcctatcattctttgtgttaggtatccacactccttctcggggtctcaaaccttgtgcagaatggcttcttgctaacctcagcctgagccccatctcattcattcagccttttgttttttctggaactcaccaagttgtttctcctcttacaacctttgtgtcagaggcattcaaaccagagcaactccatcttgaataagagctgggtgaaataaggctgagacctactgagctgcattcctggacatccttaggcattctaagtcacaggatggaataggaggttggcacaagatacaggtcataaagactttgctgataaaacaggttgcagtaaagaagctggccaagacccaccaaaaccaagatgcaatgggagtgacctctagtcgtcttcattgctacgctccctccagagtcatgacaatttacaaatgccatggcaatgtcaggaagttaccctatatggtctaaagaagggaggagtcctcagttccagggaattgcccacccctttcccagaaaactcatgaatagtctaccccttgtttagcatataatcaagaaataaccataaaaatgggcaaccatcagccctcagggctgctctccctatggagtagccatttttttatgcctttactttcttaataaaattgctttcactttactccatggacttgctctgagttctttcttgtgcgagatccaagaatcctctcttggggtctggattgggatccctttccagtaacatttgtaccatctcttccttctatctagaactttcccctgtcccacctacccatgcccctcactcccaacccagccttatcctccatcacttactttttgatcttttaggaccagttcaaatatcaattgttttgacacggtccatgttcaccctaaggagatccttcctgttggtattttttactaaaatctatttatttcctgaaaattacccatcctattgaattcttatttagtctctttccctgtttcatcttttaagatattctttgaaggtcaagtccatgtctgttttattcaccactaacaagccccattacctgggcccatggtaagcagcttattgaatgaatgaatgaatgaatttcccaccaataacatgtgagttagataggaactacctcaagctcatctcagagaagtgctttttcacatgtctaaatcccccatccttcagccccttcatcacttttcttaaaaagcacttggggctggttgcgagtaagagtgggaaattcaaatttgcaaagttagttcctgatagttcggaaacgtgtgtcctggggatccaatcatatgatcatttgttctgcttcaggttctttgctagccacccatatcctgctccagtcaattcgcaccctttagttcccaagggcgtaggtcagaaacaatgctcagtactttcaatcctggcattgccagcagcaataggtcaggcaaacactggggttgctgggaccacttagaatgtggaatgggaaggagcagttctaagatcattaatggtttcagcatagaaaaacaaaagtccagagacctgccaaacccctgtggggtaattgtggttctgtaagaacttggcctctgagttcggcattgcctgtaattacagcctttctttctttctttttttttttttctactttaagttctggaatacatgtgcagaacgtgcaggtttgctacataggtatacatgtgccatggtggtttgttgtacctatcaactcgtcatctaggttttaaatcccgcatgtattaggtatttgtcctaatgctgtctctccccttgcccccgaccccgcaacaggccctggtgtgtgatgttcccttccctgtgtccatgtgttctcattgttcaactcccacttacgagtgagaacatacagtgtttggttttctgttcctgtgttagtttgctgagaatgatggtttccagcttcatccatgtccctgcaaaggacatgaactcattcttttttatggctgcatagtattctatggtgaaattacagcctttctattcagcatcctcatttgtaagcctctgaaatgtctgagattatgattatcagtgcataagccctacactgtgagcttactaagaatattttcttatgtctgctatcattgggtgatatggtttggctgtgtccccacccaaatctcatcttgaattgtagttcccataatctccacatgtcatgggaggtacctagtgggagttaattgaatcatgggggcggttaccctcatgctattcttgtgatagtgagtgagttctcatgagagctgatggttttataaggggcttttccccctttgcttggcactgctccctcctgccaccatgtggagaaggacatgtttgcttccccttctgtgatgattataagtttcctgaggcctccccagccatgctgaactgtgagtcagttaaacctctttccttataaattacccagactcaggtaagtcttcattagcagctcgagaatgaactaatacattgggctaaaataaactgtcccaatatataaggaccacgttgtaaaaacttctccactgcttccgtcttttgcctagaacatagaacaggggttaaacgcttccatggtgtgtaaagttgagtgatagattaaaatgtaccattggtcaagagcagtagctcacacctgtaatcctagcagtttgggaggccaaggtgggtcaatcctctgagatcaggagttcgtgaccagcgtgaccaacatggagaaaccctgtctctactaaaaaaataaaataaaaattaaaaaaaaaaattagccggcatggtgtaatcccagctactcgggaggctgaggcaggagaatcactttaacccaggaggtggaggttgcggtaagccaagatggcaccattgcactccagcctgggcaacgagtgaaactctgtctcaaaaaaaaaaaaaaaaaaaaaaaataccatgaactaggtgacaaaataacagaaatttatcctctcatagttctggggagccagaattctgaaataatgatgtccacagggccatgctctttctgaagtttctggggaaaaaaatctttccttgcctcttccagcttctggtggttgcaatccttgagttctttggcatgtcactgcatccctcccgtctctgtcttgtcatcacatggtattctccatgtgtgtgtccatgttcagatccccttttcctatgaggataccagtcattggattaaggctcattcttactctaacatgttatcttaatttgattacatctgcaaagacgctatttccaaataagatcacattcacagtttccaggtggacatgatttggggatgatactattcaatgcagtgtatgagggttcacttgtattcagttatatcaggtaataccattaagtgtttcttaagcttttaatatttgaaaacaaccttattcacaataattgataaaataactacatttcagaatttaaatatacctgaacaagaaatgacaaatggttgtcaagtacttttatgcttagaataccatgctttcctcatgcaggaaattggaacagaccctggtcatgggcgtgttaaatcctcctctttcatccaccactgatctgtctcataacttgatcactcctatggaactgactgtcatttctcagtttcattctaggaggcttaaaagttctacagagcaaaagtatttttcttcctctttttgcttttttgcttgttacttttgttgaggggtcagcaaatgtcctctgaagagccagatggtaaataatattagtaacattaggctttgtgggcctcacggtctctaccacaactattcaactctgcctttgtagtgcaatggcagccagagataacctgtaaacaaatcagcatgcccaagttccaataaaactttatggacactgacatgtgcattttatataattttcatgtattgtgaaatattattcttcctttgatttcccatccatttaaacctgtgaaaagcattcttagctggaagactgggccaagaagaggtgggccagaatttgttttctgatttctgccaagtcttgttccctctctcttgttggttgtctgcctttgctccaccttttctggcatagaggacattctgcagggtactgtgtttcatatcctttttttcctttcccttctcctcctgcctttgaccttccctttccttttcttccttccccctcctactactatgtccctaaaataaatattcactacccctaaactatatttgatcattgcacattgattactgtaatcatttcctattttctaaaaatttgatgagtgtgatgtaggtcatggtgataacatgagggtagtcattctcttatttagaggtagaaattagatttaaatttctggcataatataagtatgaattgtaataatcccctgaacattattagaaatgtagattttttctcttctgagtgatcagcctccaaacatatccaaaattggagagagcactgtaaaagtcctgtgtccccgttactcagcctcaacaggtttccattcacagccaatgttgttttatttgtacctctgtctcctccctcctgtgaaattattttgaagcaaattccagacatcagtattttcactggcgtccctgtgaagagaccaccaaacaggctttgtgtgagcagcaaggctgtttatttcacccgggtgcaggcgggctgagtctgaaaagagccagcaaagggagatggggtggggccgttttataggatttgggtaggtagtggaaaattacagtcaaagggggttgttctctggcgggcaggggtgggggacacaaggtgctcagtgggggagcttttgagccaggatgagctaggagaaggaatttcacaaggtaatgtcatcagttaaggaatgaacaggccattttcacgtcttttgtgattcttcagttacttcaggccatctggatgtatacgtgcaggtcacaggtgatatgatggcttagcttgggctcagaggcctgacaagtatattttagtatgtatctcttaaagacattgactcttaaaaaaaaatatatatatatatatatatatatatatatacacaccatcatagtaacatatctagaaacaattaatacaaatttcttaatgtctttaaatatccagtgtttacatttccctaattgtcctgtaatttttttatgtacaatcggattgaattgtaacctacaaactgattagttgatctacttcttaagtctcttaatttttagattcaatctttttctgtctctctttctttctctgtttctcttccccctattttaagtttatttgtaaaagaaagtaagtcttccgcctgtggtgtttcctacagtcttgttaactgatatcttcccagtggtatggtctagagatttgaggaaatttatgttgtatttgtttgttaataatattttataattgttgcagtatccttccatcaagaggtccaaatgtctacttgtcgttcttttgtggtgttagcagccatggatgaccattagtgtaattattagcagttgcaaaatcatgatgttcttcatacagttggggtatttatcccttaaaaaaaaatgctacctgttgaactagatgattatcctgcatttttataggaattataggacaagtgtttatttttttctttaataagatttcaaaataaatttgttttctagtattctccaaaggcaatcaatgaaacctaatgtttgtttattaggcattatgtacttcagtctattttttttttttttttactttaagaacatattttatttaacccaatatatccaaaatattaccacatcaatgggcaattaatataaaagtttattaatgggatattttacattcatcagttcatcctacatcttttttttttttaatactttaagttttagggtacatgtgcataatgtgcaggttagttacatatgtatacatgtgccatgctggtgtgctgcacccattaactcgtcatttaacattaggtatatctcctaatgctatccctccccactccccccaccccacaacaggccccagagtgtgatgttccccttcctgtgtccatgtattctcattgttcaattcccacctatgagtgagaatgcgcagtgcttggttttttgtctttgtgatagtttactgagaatgatgatttccaatttcatccatgcccctacaaaggacatgaactcatcattttttatggctgcatagtattccatggtgtatatgtgccacattttcttaatccagtctatcattgttggacatttgggttggttccaagtctttgctattgtgaatagtgctgcaataaacgtacatgtgcatgtatgtagcagcatgatttatagtcctttgggtatatacccagtaatgggatggcagggtcaaatggtatttctagttctagatccctgaggaatcgccacactgacttccacaatggttgaactagtttacagtcccaccaacagtgtaaaagtgtttctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgtttatatcctttgcccacttgttgatggggttgtttgtttttttcttgtaaatttgtttgagttcagcaaagtctcaggatacaaaatcaatgtacaaaaatcacaagcattcttatacaccaataacagacaaacagagagccaaatcatgagtgaactcccattcacaattgcttcaaagagaataaaatacctgggaatccaacttacaagggaagtgaaggacctcttcaaggagaactacaaaccactgctcaatgaaataaaagaagatacaaacaaatggaagaacattccatgctcatgggtaggaagaatcaatatcgtgaaaatggccatactgcccaagctaatttatagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcatgctacctgacttcaaactatactacaaggctacagtaaccaaaacagcatggtactggtactaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtaggaagctgaaattggatcccttccttacaccttatacaaaaattaattcaagatggattaaagacttaaacgttagacctaaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactaccatgagagtgaacaggcaacctacaaaatgggagaaaattttcacaacctactcatctgacaaagggctaatatccagaatctacaaagaactcaaacaaatttacaagaaaaaaacagtctattgcaattgttactcttattcatgatcacattgtcccatgttcagccagtgggtgtaccttccagttggtttttaaatatttatgacatgaccttcgttgtctgctgtttcttcctttgggataaaacaggttgttctcagctaatctcttgccccacatctggagcctgctacttctctgccccacccactttgcttctctgctcttcatttggaataggaagcataattcatttacctctgtggaaactctgttgttttagaaggggagatgccactctagcagtactatcagagggtaaataatggaaccaaccaatccagcaactctggcacttctgaaatttagacaagggggtcatgttgtgtacttggaatgcacctgcattatgttgtggagagcaacacaggcaaactctgaaaaccaccctcatgtgtggctcactctgaggccttcaataatgtgttctttggaattcagatctgctcactgcacataggttgcaatagacatcatattattcccataatagtcttcaataaatgcttctgaaacaaatatcaatgaataaatgacattttcagcttttagagatgaaaatgacctagcccattttgtctgatactccatttttacctcaggaaactaaggccttgatatttcaagtgatttgtccaagttcatagtgcaaagtagcagatttaatccccaaatcatctgacctcaagtgcatcgtttcctactatacctactgcctctagactgtattagatcatttagcattaattattttgatcattgtccatttcttttttttccttccttctatagggatgaaaaaactttctaccctctgaatttttgataattgagcctatgaaatcaactgacagtagacacattaacatgaaacagaaattttaattactgcaaatgcatggagtcccacaaaatatgggactggaaaatgtgttcgatgactgaagcttatataacatcctgagctacagaaaggaataggggcctgaggcttctaagggtggtggtgacacaaattatgtgaggtgaggaaaggaaatgcatgtcgagcaaaggttaccttgtcatgcagataaagtctctctggtaataaaagttgtcttcaagcagccctcagaagaataggtgcgagtctgagtcacaatctgggcatggtgtccgcccttcttgtgatataaatccatcttccctagttgatgagattcccagagagacaattcatgacaaatgtgtttctttcagaggacctgcccttcattagaaagggaaagttcagaaaaaggttctccctgcgcttttgggggagaaagaggggcaagaaacggaacagaagagcagagagaacttggttctccttcagttcaaggcactcaggatatcaaagcatcatattttggggtattgttttgtggaccccagcacctcctttatttctctttctctctgtccctcttcccttctctctctctctctttctctctctctgtgtgtgtgtgtgtttgtgtgtctcttctttctaatgtaaataacatgagcctcctgtgattgttgttcccataatagtgagtagcaagtctaacaacggttcaggtaacccccaggcaagcaaaccaaaaaaaacagcctgttcaccgttcactaagctgttcgtacagtacatccctatgcccatttccaagtcttagatgactttttctagcacaattcaaaaagtactttatttcacaataataataatagaaactcagaagctttactttctcacttacctaagtaagggtggtaatgttttaggctacagaaataatcatcacttaccataaatgaatcaccttagtgttgccagcatactgaaaaagcaaatgacaaacaagataattttgatagtcactttattgccttcctgtgaagtgctaaggaacggatttattttcttgaacgtttccccttggaggatctgctgaaatctttttaattccgaaatcagagatttgctagcttagcatttggcaaaaatgatgatttatcctatttaagcattaaactatctatgtctatttgggtttcaggtgaccagatggctgagcagggcacctttacatcttttattcttaattttatttcattaactcagcaagtatttattgaccactagagtaccaataccagataacctgtaagggaataaggattaaacagtgaaaatggcacccatagggaccttaacagagtagtggctacaacaaatatgttacagagacactgtgataaatgcaaacacagacataaacataggttgttagggaagcatacggaaatggacagctgatctgcgcttggccttgcattgcggttttgggaagtgattggtattttctgacaagtgctttgaagctgagacctaagggactaagcaaaagcagagtggcagtgtcctgcatgggggcagaatttgctggatttagaggcacttgaatattttgataagcctcacagagaattttttttttaatgagtgaaatcaccaaatgcatttgtacttttgttaaaattaaagttgagaacaccaattttagtccctttgaatatgttaactgtgctatcttcaaggttttctttctccaaaaagctatttctagctaattatcctcactaaggaaagtgatctgtcggactgtgttgctaaggctcctcacaatgggggctgctgcagtgactagagactgagtcaatgaggaaaattaaatacttccagggactgattatttgggaattttcttccaagggaagttcagagaaagcccctccctgcccttctgggagaaggggtcaagaaacgggacagaagatcagagagactttggttcacctttagttcaaggcactcagcatcccaaggcaccacactgtggggtattgttttgtgaggcccaacatttccttcctttctctttctctttctctctgtctctcttcctttctctctctctctctctctcttctttctaatgtaaataatatcttttgtctcatcaaagagtctttaattaagtctttttcctgggttggaagcaatgagaaagggtcacaaccccgtcaagggaaagtcacatataacacagcccgcagtgcccccaaggatgtaaattgcttggatgtgtttaatcttcccatgtttgaagacacagactgtgatgtgaactagggtcaacatgaaaggcagcgccatcttaggtgactttagcctgttaatagggaatcctcctgtccttttcaattgtatattttctgctgcatcaaagcttttcaggtaacggtgtcagaaagagcataatctctcaggttagcctggtacaacttaagtttaaactaactgctaactgaaaataaaattccccaacaataataaaaattttacaaagttaaacactaaagaattttttaaaatattgcataaataatttgttgtaggttataaatgtgtttattatttatatgctgcctctcattatttagatgaccctagcaggtgcctgaaaatgaacgtttacatttttaggttggaccataattacttattttgtgtatcttcttcccactagctttggtggcataaaatttgttattcatcttcacgtgcttaaggcctagaacagtgcttggaataaagcacattgttcaataaatggaagctcccatgctcacgactctgcttgccctataaggagacagtgtgtacacttaccatagaataattattatcttactgttcatctcagaaaaaaaaaaaaacacaatggttttaagaagtaccttgcaccttacacatacttttatgttgctctgtgaaaagtctttgcagtttagtatcttataaatattgtaagtaaaggtcaaattccacaggggtctataatttcaaatattacttttattgttttacctgtaaaaattttctaagtgttttttttaaacttactgttacagagctatctggtaggatctataaccccatgaactacattttattatttattttattttactttttggaaagacagagtctcaccgtgtttcccaggctggtctcaagctcctgggttcaagcaatcctcctgcctcagcctcccaaagagctgggataataggtatcagccaccacacctggccatcaactacatttcaaatggatgttttataggaatcatcattgatgataatgagagatatctgttggaaaacaaaatgaagaaagggttaaggagtattatcagcactgtcacgcgtgtctgtgtgaagagaccaccaaacaggctttgtgtgagcagcaaggctgtttatttcacccgggtgcaggcgggctgagtccgaaaagagagtcagcaaagggagataggggtggggccgttttataggatttgggtaggtagtggaaaattacagtcaaagggggttgttctctggcaggcaggggcgggggtcaaaaggtgctcagtcggggagcttctgagccaggagaaggaatttcacaaggtaatggcatcggttaaggcaggaaccggccattttcacttcttttgtgattcttcagttacttcaggccatctggatgtatacgtgcaggtcacaggtgatatgatggcttagcttgtgctcagaggcctgacaggcataatatttattgaacttctgtagactaatgggcactgttctgggtagcagagattcatcaatatataaaatctgcaaaagttaaaacaaacaaacaaacaaacttctctgacatcctggagtttattgccctttaagaaggtggtgggccgggcgcggtggctcacgcctgtaatcccagcactttgggaggccgaggtgggcggaccacgaggtcaggagattgagagcatcctggctaacatggtgaaaccccgtctccactaaaaatacaaaaaattagccaggcatggtggcgggtgcctgtagtcccagctactcaggaggctgaggcgggagaatggtgtgaacctgggaggcggaacttgcagtgagccaagatcacaccactgcactccagcctgggtgacagagcgagactctgtctcaattaattaattaattaattaattaaggttgtgggggagacagacaatacaaaataaacatcacaaaggaggaaattgttgactgtcagaaggtgatgtgtgctataggaaaaaatagaggtgatgtaggggtgggaagactttcctttatcctctgagggtttgatgagtgagtgtacgaaataatctgaagggaggcagatgaacaggagaaaagacacacaaatttgttacctacaggaggacatcactggagagaaacctgaacacccaaaaggccagtgagattttgaagcttatataccttcttcccagggaagaaggtagagtggatatagtcaaaatttaggggagagtaaataaattcggggaaagacaaatggcccagagcataggggatagtctgagtgcagggttcacctccaggctcccctcttgttttttgttgtcgtggtggtggtactggtgtgaagggtgaggacaatcagtgtgtttttcccctcagagcaaattgtaaagctaaattagtcattatttaaatttactatagttgcctttataaaaactttaaatttacattatacatgttgaaattgaagctatgcaattgtaatataaacacggatttacaactaaagcatgttataatgtaaataattgattttctgtatgaaatcctaggcaatattgtaaaattgtacagacccgtcaactttttccacttaaatattctgagtaaagtttaagggtgttgtagttttcaagtggttttttttctttgtttgtttgtttctttttgtctcttgtgatccaagttttcttctctggttggtgagattactggggcaaagatttcttgacaattgagttccttttgaaggatccttcctaaggccggtaatgggagctcagaaaaagctcctcactgcatttgctgttctccaggtgccctcagtttgaagcaaccagcatgccacagtggcacattttggggtggtattttcttagttccctcaaaggtaaaatgcagagtgggttatatgtttaaacaggacagttgggtgggcctcagtgaggacgtgccctgtgaatagaggccaaacagagatgagagagctagcccaggggagttttaggggaagcatcttctagtcagaggaaacagcccaggcaaacgtcctaaaacaggagcatctggcatgtttgtttgttggttggtttgttttgagatagagtctagctctgttgcctgggctggagtgcagtggcatgatcttggttcactgcagcctctacttcctgggctcaagcgattctcccacctcagcctcccaagtagctaggatcacaggtgcacgtcatcatgcccagctaattttttgtatttttggtggagacagagttttgccgtgttgcccaggctggtctcaaactcctgagctcaagtgatctgcccacctcagcctcccagagtgctgggattacaagcatgagccaccacgcctggcccatttagcatatttgaaccacagttaggtcagtgtggtgtagtagatattaggagtgattttttttttaatgaagagcaagcaatacgttatgaagtatccttaaataacagggagcgttctctttaaggttcctcaggaatggtcagtcatggatccaagatgacatttacttagcctccaagtttgaattcaagatcaaaatctaattactgttacaagcaacaagaatcaaagagtaacatctccttgctacacaggttagaagactccttattgccacacagatgaattcttgactagcaaatgcacataaaccacatccctacccagtgtgagtgaaaaaggaaagggaagattagcttgtctaagtatcgatgtaaatgtagtcagtaactctagctgtattttaaaaggattttaacatctctacaatggaataaaaacattaacggatatccttcttcctagaaaatggctaatgctttcctacaaaaaaagacacatatgagctccaaattgttcttcatgtgggtgagaatggtctgtcattatttatacttgttcacagtgcttcatctgtcatccatctttgggctgtaattgtgagcttaaaaataatcactattttccaccacctgcagaacataatctgcactttgagctcatttcctcagtgttccctacagagttccatctgctttacataccttatttctctacacatgattaaagctgctgatgctacctgaactgcatacatagctggcattatggaatgcctcaaactaccacagcgtgctgtggtgagatgcctttcctatcagagtctaggcttacaaaaatgcatgaagtgtttctcatatattgcatatttggggtgaaaaaagacaatgacagccaatttttaataagttatgtcagggagatcataattattgatcttctaaacaaaactatctataaatatatggtcttcaacttatccaccgggaagacagatgaaagtttcaaatggatcctcttacaaatgactaaaaaacactgcatcataatctaacattatgttgagtctttttgcctgaatgttttctaaacaattttgtagaagttagttaatactttaaataactagacattgtaactaagaaattattttgtaagttattcaggaaagtacacatagctcttataaaatgaccagtatttgttagtttcttttataaatctgaatgtttatataaagtttacctgaaataagatacatcttgctttcatatggaatatttcatgtttgtttccaatagccaaattaagaaatataatttcaaatataaaattaaagcttatgtaattttctttctttttttttttttttttctgagacggagtctttctgttgcccaggctagagtgcagtggcctgatctcggctcaccacaacctctgcctcccaggtccaagcgattctcctgcctcagcctcttaagtagctgggattacaggcatgcaccaccatgcctggctaatttttgtatttttagtagaggctgagtttcactatgttggccaggctggtctcaaattcctgagctcaggcaatctgcccgccttggcctcccaaagtgcaggaattacaggcgtgatccaccacacccagtcaagcttatgtcattttctaattctactctcctttctcaactcttagaatattttattgatatctgtgttcttaaactttacaaaagtgacatcatgcattaaatgctcctcttacttgcattttctactcaatgttctgattttgaaattcactcatgtttcataaatatacttctaattgttttattttcaaatattttataacaattgtataaccatagctcaacttattttccactcttgtcggctggccttttatgttgtttttatttactattgcaaacaatatttacaaaatatttaatgttcaagaattcctttaggatatataactagaaataattattattatgggatattctcatcttcatatttactttttattccaaattattttccaaaatagctccaagaatcagggtataggtgttcatatcctcaagaactctggatacagccacatttttaagtatttgccaacctgacaaacataaaataaaacctcattgtagttcttctttgtatttccctggttactgtgaagatgtgcatctccctgagttgattaaccatgtggtttacccatttgtaaattactggtctatgtttcttgcctatttttcttttgcgttatttccgtttctgttaactacttgtagaagttctttatgtagctggatactaatatttgttagacatatatcttacaattatctcttctactcagtggcctaaaatttcacattctttatggcatgtcgatgaagaagagagctgaattttaacaaaaccatatgtacccatttctcccattagagtgcttttcttacactttctttaagaaataatagaaaaagccggatgcagtggctcatgtctataatcccagcactttgggaggccgaggtgggcactttgggaatctgaggtcaggagttcgagaccagcctggccaacatgatgaaaccccgtctctactaaaaatacaaaaaattagccaggcatggtggtgggcacccataatcccagctacttgggaggcagagacaggagaatcgcttgaacccaggaggcagaggttgcaatgagccaaaatctcgctactacactccagcctgggcaacagagtgagactccgtttccaataaaaaaagaaataatagaaatgttattttgtgctttcctctatggattttgaaggtctgtgtttcattaggccttgaatccatctggaacaatttttatgtagggttaaagacagggatctaattttattttttcaatatgaataaacaattttaaatttctcataaatatctgacaacaggttgcatttatgtcaagtttacatatatacacagactttgctttaagtttttaaaaatttgttgcattattttaattggctgtgcctgtaccaaacctgctttaatcatgattcttgataggccaattgtctctgcattgttcttcaacaatgtcttggctattcttagaccttggctcttaaatacaaattttttccaccagttgctcaattacatttatatacacacacaaattattgggattatgattgaaaatggaattaatttatatactaagttattgattcttccagtctttgaatatggaatattcctttatgtgattcttctttaatattattcattaaagttttaaatttctcccaataagttcttgcatatattttgtgagattttgttttattacatcataaattctatttttaaaatattgtattttctcattagttattattggaaatataattgatttttgtatattgttcttatattgaataatcttttttaagctgtagacttttctaacaggtttgaaaatttatcagctccccatcttctctacaattcttaggataatgataatgattattattattatgttttactttctttttctaatgactaagaccccaacataatgttgactagaaacagtgattataagcatttctctttctgatgaaaaaaaaagattctaatattttgtgactaattctttgaaccttctattataatgaagttcttttactcttttacacatatataggggaattacaatttattcctatatagctcattttattgaaattattctttattatttctggtgccttttcttaatgtactatgttgcattaatttttaacattaaactatcttagtctaaacactccaagtataaaccaaacttgaataactcaagtttctaaaattaagaattcaagccacatgtgatggcttataactgtagtctcagtaacttgggaggccaaggtataaggattgcttgaacctaggaattcaagagcagcctaggcaacatagggagacacccatctttatcaaaaaaaaaaaaaagaaaagaaaaaagcctgatttagtagtgcacacctgcagtcttagctacttgggaggctgaagtggaaggatcacttgagcctgggaggttgatgctgcagtgagctataatcatgccactgcactccagccactccagcttgggtgacggagaggagcgagaccctgtctcaaaaaaaaaaaaaaaaaaaaaaaaaaaaaaaaagactacatctccaccaaaaaattggccaggcattgtggttcatgcctgtaatcccagcacgttgggtggctgaggcaggaggagttcaaaaccagcctaggcaacatagtgagaacctgtctcaaaaaaaactgttaaaaaaaaagaatgcaagaagatataatttgtatattacgataatcagaatatataatataactgaggcagtacaatgtaaattcaacaaaccataggcacagttctcttgtgaagccataattgacaaatattattggcaaatccatctttattggatcattcttatcagcatacaaatacattgtaatgattgcccttttaaaaatagaaaacgccatcacttttgatgaaagaaaatggcttgaaagaaaaatcgtttttttttcttcctactctcccttcgagactgatataatcagtctttctttcacatcagaccatggaaaccctcttggaaagatcatattacccatactttcgataaattcaataattaatttagtcctcattttacttaacattgaaataccacttaagtccgttgatgactctctttctgttgaaactgatcatgtggctttctctgattttcctcccgcctcctggtctacctagtcttggtctctttattggctcttctatttcccacaatttctcccacctcagtaaatggtaccatcatttgcctggataaatattcagtccaaaattctcacaataatccttgtttcatttttttttccccctgataggtctcatccaaaacatgaccagatctttctggctgtatctttacatgatagatttaaagtctattttaaaatatttaaaacaaattatattttttaatgtatttccacttctctgtcacctccactgccaccatccaaagtctaagtgaccatctcccattagctaaagtagtagtttacaagtcatctctgtgcttccactcttgccctgctactaattattgaccacacatgagccacaattacaactaaaagcataaatcattcaagtcacactactgcttaaatctctgctgtggctttccataacatgtaagataaaatctgaagactttaatatgccttacaagaaactacaatatctgttccctgcctttttgtcttatatcatttcctactcttttctctctttattgtattctggcaaaataatctgccagattattcctgcttcatggcctttccatttgccattagttcatcttagattactcttcccattgatcttcatatcattccgaaatttgctcaaatattaggatctcccttaccaatctgcctgaaatggtctctctcactcctcaatcattctccttccacttaccaagctttttttcacagaagatataagtaagtaaaataaacgtgttagatatttgtttgttttctgcttcccatgtttgaaactagactgtaagttgcctgagatgatggattttatatcgtgctcattgccgtacctctagaactcagataaatggtaagcatattatgagcaactagatatatcttttcaataaatgcatattgaagatgttcttgagtttgaagaaatgatttttaaaatatgaagtaatcttttatctccacaagttttctacacccacgcctacgatcgtgtgctagacctttcaacctatgctgcaatcttatagcccactattccagacctttccatttctgactcatccagatcctttatttccatttacagaatccctcttgtctccagggtgtgtgttctgagcaataagaaggataaaattgctcttatcaccttctccttcttcatgcgacacatccccattcatctgtcatggttcacgacaaatgctctgtcaccagcttgctccacagctttctcaagctgggttatatggaccttttatttggatacacaatatatctctgttttagcacttgtttctattttgtagtcttaagcttaatgtcctctaactgccactggaccataagctcatagaaaacaggaaagcaagtctttttcatctttgtgtccccagagcctggcactactggaccagatcaggaacttaataaatggcttgtggatgcatgaatgattaaattatattaccaacttatgacattttttatgtaataggctatacattgttgccattttaaaataatattttaaaaagtctaaaatagtatctgcatattgcccctccccacccaaaatgagtgccgtgctgtgagaaagacaataaaaattttatgcttggtttgccaccaagcataaccccactgagtcaaagagatgcagggtagtaaggtaaaaacagcacgcaacccagaattaggaaaacacatttctattattttgccactatctcttagtattgtttggtgtaacccacttttttctcctaagacttgatttcttattctctaatagaagaaagtcaagatgggtgccctccaagatcacattattttgatattatttgatagtcaaaaattttcacataagaatatagcttcctttaagtggtagggttgcttcctctggatacatgcttgtataagactgcaaagctttgagttttgaaaaaacagttcttattaatgctatagcatttaattggaaatcctagctcacatctttcttatagttagtgttcaagtgctgattgattgaatcaggataataccattaagacttctatgcccaaagaaaacagacaaaattattaagatacagttgctaagatgcagaagaaatttaaagatatagaaaatggaatttattcgttttattaagcaagccaaggcttatacgcaatataaaagatcttaagaatatgtcataggttactacctactgtgttgctatgagacctgcactagaaagatctaatgccacctgtgaaaagtaactatagtagaccataaggcagctaaggaattcagactacacattgtatgttggccacacccagtctagcaagatttatatatacattttaatttagaaagttcataatattccttttgtaaaacaaggatcatttcagagaaaatatgaaaaaaggtggaaaaaatctctctgattaacaaattgcacattaactggtacgatgacatggtttgaaaaacaaaaataatacttagctgcaaatacaggtgtataggacacatataaaaatttttcattagactcagctcatatacttttattaaaatgtgcataatgtgaacttcagactgtatatgaataacatagaaaagaatcaggaaacagctataaaatgtatatatatataataacagctattatatatataataacagctattatatatatataataacagctattatacacacacacacacacacacacacttatacgattaagaaactggttacattctggaaggaattgttttttgcttttttttcactggtcattttccagctttatcagtccctggccagagctccagccatgcaaggaattgagttcttgagaagtgaattacttgaggattacagatatgttgagaatatggggtcagtagtggaggcagcagagggatttttctaatgtgctcatgtcaacatgactacactggttaatcttgagggcccgttattgccagagacaggaacaggtctccagagtatgttccatacatgcccagtgtttcaaatataccattaaatcagcagtatttacaacaaaataaattgtgacaatttaaaaataggtgattacatgatgagacagatactaaattctcagtagttccacaagacattttcataacatagtaatccaaagacagtatttaaaaagcattagttaatccgtggcttatttgtgaaatgaaacttagaaatttaaaatttgctatatgcagtagtttctgtttgcattatatgcataaatgataacacatataaacacactaaatatgggaataagattcttaatttttctacttatgatactagcaaaggaaaatctgtagagtgtaaatacatgttttgttctagatggtggacacatgaaaaattgttcatatccatttgtcacttaagatttaatggctcttccactgccctgaagggtgagtcccggaccaggcagtattcatcacaaactgacttgagagccgtgggccttaagggaatattggagataggctagcaatattccctgtggcccgttgtggtgatgaccacagggtgacactccttttcctttggaaggagagagaagagtgggaagtgctgcatcttgtggcttgagtgacagctcagccacagtacaacagaacaggtggagttctgaggtttttgactctggtccctgattgctggaggatggcaactctggacctacctgggacctcgggtgactcgccaccctgaagggaaggacataggcctggctggctgtgctacctgatgattgtagaaccccagagccttgagcgaacataggcagcagccagggagtggttacagcaggtcttggggcaacacccagtcctgtgctggctttagatctgacccagcacaatcctagtggtggtggccaaggagtagttgtgtcactccacccctagctttcagtggctcagaacagagagagacactctatttgtgtgggaggaagaagaaagagaacaagagttttcgtccagtaatccataggattctttcagatcttgtccaaggccatcaaggtagtatgtctatgagtctgcaagaaacacagcattactgggcttggggtgccccctaaagctgttacagcttagatcacaatacccaagtccttctgaatatctggaaagctttgccaagaaggatggggacaaagaaggtgagaaggtgaagactacaataaatatctagctttttaatgcccagacatccaagaacatctactagtatcaacaccatccaggaaaacatgacttcaccaaatgagctaaataaggtaccaggaaccaatcctagtgaaacagagatatgtgacttttcagacagagaattcaaaatagctgttttaaggaaactcaaatttaagataaagcggagaaggtattcagaattctatcagataaatttaacaaagagattaaaataattatatattaattaaaaataactaatatatcatataattatatattttttaaattaattgaattaaaaagaatcaagcagaaattctggatttgaaaaaggtaattggcatactgaagaatgcatcagagtcttttaatagcataagagatcaaacagaagaattagtaagcttgaagacaggttatttgaaaatgcacagtcagtgaaaacaagaggaaataataatttttaaaaatgaagcacatctacaggatctagaaaatagcccccaaagggaaatctaagagttattggccataaagaggaggtagaaaaagagatggggtagacagttaattcaaaggtataataacaaaaccctagggaaagatatcaatatccaagtacaagaaggttataaaacactaagcagatttgacccaaagaagactagctcaaggcatttaataactccaaaaggtcaaggataaagaaaggattctaaaagcaacaagagaaaagaagcatatagcaggcaatggagcttcaatatgtctggtagcagacttttcagttgaaaccttacagaccaggagagaggggcatgacatatttacggtgctgaaagaaaaaaacttttaccctaaaatagtatatctggtgatgatatccttcaaatataaaggagaaataaagacttttctagacaaacagaagctgagggattttatcaacaccagacctgtcctatgagaaatgctaaagggagtacttcagtccacaagataaaggatgttaatgagcaataagaaatcacctgaaagtacaaactcactggtaatattaagtacacagaaaaacatggaatattataacacagtaactgaggtgtaaactacttcatcctaagtaaaaagactaaatgatgaaccaataaaaaataaaaagtacaacaatttttgaagacatagacagtacaataagatataaatagaaacaacaaaaagttaaaaagcagaaggatagaggtaaggcatagagtttttattattacttgtgcttatttgtttgtttatacaaacagtgttagttgttatcagcttaaaaaaatgtgttataagatagtatttggaagccccatggtaaccacaaaccaaaatcaaacaatggatacacacaaaataaaaagcaagaaactaaattataccaccagagaagatcaccttcactaaaggaggacaggaagaaagagaagacaaaaaaacaaccagaaaacaaataacaacatggcaagagtaacttcttacttatcaataataacattgaatgtaaatgaactaaactctgcaaacagaagacatacagtagctgaatagatgaaaaagaaaaaccatttgatctgttgcctacaaggaacacacttcacctataaagagacacatagactgaaaaataaagggatggaaaaagatatattccatgcaaatagaaaccaaaaaaagaaaaagagtagctacacttataacagacaaattagatttcatgacaaaaactataataagacacaaagaaggtcactatataatgataaaggtgtcatttcagcaagaggatataacagttttaaatacatatgcatttaacagtggagtaccgcgatatataaagcaaatattattagagctaaagagagagatgggccccaatacaataataactagagaattcaacacctcaccttcagcactggacagatcttctggacaggtaataaacaaaaaaacatcagacttaatcttctctttagactgaatgaatttaacgcatatttatagaacatttcatccaatggctacagatcacacattctttccctcagtatatggatgattctcaaggatagaccatatgttaggtcacaaaacaagacttaaaacattcaaaaaatgaaaataatattaagcatattctttgaccacaatggaataaaactagaaattgataacaagatgaatttttgaaactctacaaatactggaaaattaatatgctcctgaatgaccagtgggccaatgaataaattaagaaggaaattgaaaaatggcttgaaacaaatgatgatggaaacacaacataccaaaaaatctatgggatacgataaaagcagtactaagaggaaagtttatagctataactgtctacatcaaaaaagaagaaaaacttcaaataacctaatgatgcagcttaaagaactagaaaagcaagagcaaaccaaacttaaaattagtggaagaaagaaataataaagatcagagcataaataaataaaattgaagaaaacaatacaaaagaccaatgaaacaaaaatttggtttattgaaaagttaaacacagttgacaagcctttagccagactaggaaaaaaagatccaaataaataaaattggagatgaaaaaggagacattacaactgataccacagaaattaaaaggattattggtggctacaatgagcaactatatgccaataaattggtaaatctaggaaaaatagacaaattcttagacacatacaacctagcaagatttaaccaggaagaaatccaaaacctgaagatatgaatatccagtaacaagatcgaagctataataagaactctgtcaataagaaaagcacaggaactgaaggcggaaatctgaaagcctttcctcgaagatctggaacatgacaaggatgcctactttcaccactgttattcaacgtaatactgaaagtcctaagctagagcattcagacaaaagaacaaaataaagggcatccaaattggagtggaagaagtcatattatccttgtttgcagatgatatgatcttatatttggaaaaacctaaagactccacaaaaaaactattagaactgataaacaaattctgcaaagttgtagtatacaaaatcaacatacaaaaaccagtagcatttctatatgctaacaatgagcaatctgaaacaaaaaaatcaaaatgtaatcccatttacaatagccacagataaaattaaatacctgggaattaaccataaagtgaaagatctctataatgaaaaatataaaacactcatgaaagaaattgaggagaacaccaataagatgaaaaggtatttcatattcatgaattgaaataatcaatattgttaaaatgtccgtccttcccaaagtgatctatagattcagtgtaattcctatgaaaataccaatgacattcttcacagaaataaaaaaaaaaattttaaatttaaaattaaaatttatttggaaccacaaaagacccagaataaccagatctatcctgaacaaaaagaacaaaactggaggaatcacattacctaacttcaaattatgctacagagctagagtaaccaaaacagcatggtacagcataaaaacagacatgtagatcaatggaacagaatgtataacccagaaacaaatccacacagctacagcgaattcattttgacaaaggtgccaagaacatactcttaggaaaacagtctcttcaataaatggttctgggaaaactgaatgttcatatgcggaagaatgaaactagacttctgtctctcaacatatacaaaaagcaaatcaaaataaagacttaaagcaaagacctcaaaatatgaatctactacaagaaaacactggggaaactctccaggacattggtctgggcaaaaatttcttgagtaataccacacaagcataggcaaccaaagcaaaaatggataaatgtgatcagctcaagttaaaaaaaaaacttctgcacagcaaacaatcaacaaagtgaagagacaccccacataatgggagaaaatatttgcaaactacccatctgagatggtgttaataaccagaatattatataaggagctcaaaataactctataggaaaattttaataatatgtttcaataattggccaaagacttaaatagacatttctcaaaagaagacatacaaatggcaaacagacatgtgaaaaagtgctagacatcattgatcatcagaaaatgcaaatcaaaacaacaatgaaatatcatctcaccacagttaaaatggcttatatccaaaagacaggcagtaacaaatgctggtgaggatatggggaacaggaaatcctcatacactgttggtagaaatgtaaattagtacaaccactaagaagcattcagaacttccttgagaagctgaaaatagaactatcatatgatccagcaatcctactgatgggtatatacacaaaagaatggaaatcagtatacggaagaaatatctttactctcatgtttattgcagtactgttcacaatagccaagatttggaagcaaccaaagcatccatcaacagatgagtggataaagaaaatgtggtacatatacacaatggagtactattcagccataaaaagaatgagatacagtcatttgcaacaacatggatggaactagagatcattatgttaagtgaaataagccaggcacagaaagacaaacatcacatgttctcacttatttgggggatccaaaaatcaaaacaattgaactcatggacatagggtggaaggatggtttccagaggctgggaagggtagtgaggggttgcagggggaagtggggatggttaataagtacaaaaaatagaatagtaagacctactattaggtagcacatcagggttaccatagtcaataataacttaattgtacattttaaaataactaaaaagagtctaattggattgtttgtaacacaaagcataaatgcttgagtggatggatacctccttctctgtgatgtgatcattacacattgcatgcctgtatcaaagtatctcatgtaccccataaatatatatacctatgatgtacccacaaaaatttaaaatttaaaaatattgtatggttccaaaggagttattgcaatgtgtaatatacaagtgttacaaaataatttgtaaaatgcatcaacagtaactgttctatttcatcaaaatagagtttatatattattgtttgcatgtgctcacaattaccaaaaaattattttaaaatgtcaattaccaaagaaattgttttaaaatgtcatggcactggacttggtgggcaagatggcagataggagatagggctaatgtgcagttctcacctggatgaactgaactgtgtgtggagactcacactgtgatctgttgctccaagaaccaacaaaggaacataccaggaaaacctgaaggattcccagatcctttgaaagaagcagcacactactacaaatttcatgaaacaggtgaaaaactgagcattcccaaagtgtgagagaaggaaaacctgcctccaaacatacatttctactgggggacctgaaaatccagatcatgagattatggaagaaggatttaacctctcctggagttgaaatggatttagggagtcacatgaaatataaaagtagaagtagcagcagaaaatgccttgcaggcagtcccagtctccagctgaagcccagggaagccatctctgatgatatcttataggggcccttggggaaggcagccagaggaattgggaagtagtcacagtgcaaaggaaactctgaactgaaatttgtagttgtttcaactgggcacaaatcttctcaggtgaagtccaggagacaagcaggagtggctgcagattcgagcacaggagccgcagccaatggagtgggcagatgcaaaggagcaagggccatgcttgcttttttagtggggaagtctatgtcctcaggcaaggtcttattggggcactgtgggagtgagactggccttgccaattgcatgggggggtgggttaggcctctcactaatggctattccccacttctctggtgaactatatgacacagcagaggcagccaagatgtcttttggcctgagaaccaccctgcatccccacagtggctatagcaagccccagccaaggagaggctgagctcagacctgcataaccctgccctgacctgataggatttctttacccaccctagtagctgattacaaaagataaactcttgggagctttatggccctgcccatcacctgagaaactgaaatacttaccctggccaagttagggcaagcttagatccctccactaatactgcagctgttgctgtcttggaaacaccaccttctggttggaggccaaccaactcaggccattacagcaactcatggtagaataaccctgatcccaggaaggagaagacaacacctaattccactgcctacaagatactggctaaccagagttcctgagcgtgtccctgtgaaaacatcactgctagcataaccatcattcaagaaagccagcacactaaacatatctacaaccatggactctcacagagtctacctcacttcgctgccacctctaccagagcaggtgctggtatccatgattgagagacctgaagatggatcacatcataggactctgtagacattccccagcaccagtctagagcctggtagcccagcttggtaaccagacccaaaagagcaataacaatctctgcgttccagctctcaggaagccccatccctagggtaaggggggaagcaccacatcaagggatcaccctgtgggacaagaaaatctgaacagcagatgttgagtttcagacctctccactgaaataatctacgcaaacgagaaggaaccagaaaagtaattctggtaatgtaacaaaacaaggttctatagtatccccaaaagatcataccagctccccagcaatggatccaaaccaaaaagaaatctctgaatagccagataaaaaattcagaaggttgattattaaggtactcagataccagagaaaggtgaaaacaaacttaaagatattaaaacaaggtggggcatggtggctcacgcctgaaatcccagcactttgggaggctgaggcaggtggatcatgaggtcaggagttcaagaccagcctggccaacatagtgaaaccctgtctctactaaaaatacaaaaagtttggtgtgtggtgggcacctgtaatcccaggtacttgggaggctgaggcaggagaatggcttgaacctgggaggcggaggttgcagtgagccgagattgtgccattgcactccagcctgggggacagagcgagactctgtctcaaaaaaaaaaaaaaaaaaaaaaagatattaaaacaaaatacaggatatggatgaaaaattctccacataaatagatgtcataaagaaaaaacaatcacaacttttggaaatgaaagacacacttacggaaatacaaaaagtgtagtgtgggaagtttcaacaatagactagaacaagtaaaagaaagaattttggagctcaaagacaaggctttcaaattaagccaatcagacaaagacaagaaaaaaaaaagaataaaaaagtgaacacagcctccaagaaatttgggattatgttaaatggcaaacctaagtatagttggttttctggaggaagaagagaaatttaaaagtttggaaagcatatttgagggaatacttgaggaaaacttccctggccttgctagagatcaagatacccaaatacaagaagctcaaagaacacctgggaaattcattccaaaaagatcatcacctagcacatagtcattaggttatctaaagttaagacaaaggaaagaatcttaagagctgtgggacaaaagtatcagataacctataaaggaaaacctatcagattaatagcagaattatccatagaaaccttacaagacagaaagaattggggtgtcatctttagccttctgaaacaaaataattgtcagcccaggattttgtatccagtaaaatggagcttcataaatgaaggagagataaagtctttttcagacaaacaaatgctgagaaaatttgccacaactaagccagcgctataagaaatgctaaaaggggttctaaatcttgaaacacaccaaaatagaacctccttaaagcataaatgtcaccaggcctataaaacaataacacaattaaaacaaaacataaggtattaaggcaacaactagcatgatgaagaaaacagtacctcacatctcactgctaatgttgaacgtaaatggcctaaattctccaattaaaagatatagaatggcagaatggataaaaatccaccaacaaaatatctgctgtcttcaaaagactcacctaacacataaggactcacataaacttaaggtaaaggggtggaaaaagatattccatgcaaatggaaaccaaaagcaagcagcagtagctattcttctaccaggaaaaaacagactttaaagccaacagcagttaaaaaaaaaaaaaaaaaaagacaaagaggaacgttataaaatgataaaagaattactccaacagaaaaatatcacaattctaaatatatatgcacctaacactggagctcccaaatttataagggaattattaccagacctaagatgtgagatagatggcaacacaataatagtgggggggcttcaatactcctctgacagcactagatagttcatcaagacgagaagtcaacaaagaaataacggacataggccgaccgctgtggttcatggctgtaatcccagcactttgggaggctgaggtgggtggatcacctgaggttaggagttcaagaacagcctggccaatatggtaaaaccctgtctttactaaaaatgcaaaaaattagccaagcaacgtgatgggtgcctgtaatcccagctacctgggaggctgaggcaggagaatcacttaaaccccagaggcagaggttgcagtgagttgagattgcaccactgcactccagcctgggcaacaagagcaaaactctgtctcaaaaataataataataataataataataataataataataataatagacataaactatactctagaacaaatggatttaacagatagttacagaacgttctactcaacaactgcaggatatacattactttcttcaacacacagaacattctccaagatagaccatatgatagcttacaaaacaagtcttgataaacttaagaaaataaaaagtatatcaggtattctctcagaccacagtggaaaaaaagtggaaattaactccaaaaggaaccctcaaaactatacaaatacttggaaattaaatcacctgttccttaatgatcattgagtcaacaatgaaataaagataaaatttaaaaattgagctgattgatgatagtgacacaacttatcaaaacctctggcatacagcaaaagtggtgctgagaggaaaattcatagcattaaatgccctcatcaaaaagtctgaaagagcacaaataaaaaaatctaagattatacctcaagcaaatagaaaaacaagtacaaacaatatgcaaacccagcagaaaaaaagaaataacaaagatcagaacagaactaaatgaaatacaaacaaaaaaatacaaaagataaatgaaaaaaagtgggttctttgaaaagataaacataattgatagaccattagcaagaataaccaagaaaaaaagagagaagatccaaatgtcaattagaaacaaaacaggaaatattacaaccaataccacagaaatacaaaagatcattcaaggctactatgaacacatttacaaactagaaatctaatgtagatggataaattcctggaaatatacaaccttcctagattaaatcaggaagaaatagagattctaaactgaccaatgacaaatagcaaaattgaaacagtagtaaaaaaaaaaaaaaaaaaaaaaagccaacaaaaaagtccagaaccagacggattcgcagctgaattctaacggacattcaaagaagaatcgacaccaatcttactgaaactattccaaaagacagagaaggagggaattctccctaaatcattctgtgaagtcaatatcaccctaataccaaagccaggaaaggacataacagaaaaggaaaactacagaccaatactgctgatgaacatatatgcaaaaatcctcaacaaaatactagctaaccaaattcaacagcatatcaaaaagataatacaccattatcaagtgggtttcgtaccagggatgcagggatgatttaacatacacaaccaaataaatatgatgcatcacataaaataattaacaacagaagtcatatgagcatcccaatagatgcagaaaaagcatttgacaaagtccagcatccctttacgaataaaaccttctgcaaaattggcatagaagggatgtacctcaatgtaataaaaaccatctatgacaaacccacagccaacattatactgaatgggaaaaagttgaaagcattcatcctgagaactggaacaagagaaggatgcccacccccaccacctctatttaacatagtactggaactcctagctgtagcaatcagacaagagaaagaaataaagggcatcagaatctgtaaagaggaaattaaagttgtgctgttcacagatgatatgatcatatacctagaaaaccctaaagattcatccaaaaagctcctagatatgataaattaatttagtaaagtttcaggatataaaatcaatgtacacaattcagtagcactgctatacaccaacaacaaccaagctgagaaacaaatcaataactcaatcccttttacaacagcttcacaaagtaataataataataaaatacttaggactatacctaaccaaggaggtgaaagatctctacaaagttaactacaaaacactggtgaaagaaatcattaatgacacaaacaaatggaaacacaacccaatgctcatggatgggtagaatcaatactgtgaaaatgaccatactgccaaaatcaatctacagattgcaatttccatcaaagtaccatcaatattcttcacagaactataaaaaacaatcctaaagttcatatgaaaccaaaaacaagcctgcatagccaaagcaagacaaagctaaaagaacaaatctggaggcatcacgttaccctaattaaaactattctacaaggctatagagaccaaaacaggatggtactggtgtaaaaataggcaagtagaccaatggaacaaaatagagaatccagaaatatagccaaatatttaaagccaactgatcttcaacaaagcaaacaaaaacattaagtggggaaaggataccctattcaacaaatggtgctgggataattggcaagtcacatgtagaagtatgaagctgcatcctcatcgcttaacttatgtaaaaaatcaactcaagattgatcaaagacttaaatgtaagtcctgaaaccgtaaacattctagaaaataacatcaggaaagttcttctagacattgacataggcaaaaatttcatgacaaagcatccgaaagcaaatgcaccaaaaacaaagataaataaatgggacctaattaaactaaaagcttctgcacagcaaaagaaatagtcagcagagtaaacagacaacccacagtgggagaaaatctttgcacactatgtaggtgacaaagcactaatatccggaatccacaagaaactcaaacaaatcagcaacaaaaaaccaatcccatcaaaaagtgggaaaagagcatgagtagagaattctcaaaagaagatgtacaaatggacaacaaacatatgaaaacatgcccaatgtcactaattatcagggaaaggcaaatcaaaaccacaatgagataccacctgatatggtggttcggttgtgtccccacccaaatctcatcttgaattgtagttcccatgatccccaacccagtgttgcgggagggaccaggtagagataattggataatgggggtggtttccctaatcctgttgtgatagtaagttagttctcacgagatctgatggttttataaggggcttttctgcctttgcgttgctctcattctctcttgctgccctgtaaagaggtgccttccaccatggctgttaagtttcctgatgcctcctcagccatgtgaaactaagagtcaattaaaactctttcctttataaattacccagtctcaggtatttcttcatagcaatgtgagaacagactaatacagtaaattggtactgggtagtggggtgctgctgtaaagatatccaaaaatatggaagcaactttggaactgggtaacaggaagagactggaacagtttggagggctcagaataagacaagaaaatgtgggaaagtttggagacttgttgaatggttttgaccaaaatgctgatagtgatatggacaatgaagtctagtctgaggtggtctcatatgaagatgaggaacttattgggaactggagtaaaagtgactcttgctatgcaaagagactggtggcattttgtccctgcctcattcaagaggaagcagagcataaaagtttggaaaatttgcagcctgacaatgaggtagaaaagaaaactccgttttctggtgagaaattcaaacaggctgcagaaatttgcacaagcagcccatcccatcacaggcccagaggcctaggagggaaaaatcttttgtgtgttaggcccttgggacatggtgcccagcatcccaactgcttcagcgccagccttggctaaaaggggtcaaggaacagctcaagccattgcttcagaggatgcaagccccaatccatggtgactttcacatgatgttgggcctgtgggtacacagaagtcaaaaaccaaggttggagaacctccacctagatttcagaggatgtatggaaatgcctggatgtctaaacagaagtttgctttgctacaggggtcaagctctcatagagatcctctgctagggcagtgcagacgagatatgtggggttggagcccccacacaagactttggacttgagcctttgggttaatgctggaataagctaagactttgaagaccattggaaaggcatgattgtgttttgaattgtgaggtcatgagatttgggaggggccaggagaagaatggtatgccttggctatgtccccacccaaatctcatcctgaattataggtcccataatcctatgcgaggaccagatggagttaattgaatcatggaggcagtttccccacatcttgttgttgtgataataagttagttctcataaggtctgatggttttatagggagcttttcctcctttgctcaactctcattctctctcccgccaccctgtgaagaggtgccttctgccatgattgtaagtttcctgaggcctccccagcaatgtggaaatgtgagtcaattaaacttctttccttcataaattacccagtcttaggtatttattcatagcaacatgagcatggactaatacattaccttattcctgcaagaatggccataattaaaaaatcaaaaaataacaggtggcatggatgtggtgaaaagggaacacttctacactgctggtgggaatataagctagtacaagcactatggaaaacagtatggagattccctaaagaactaaaggtagagctaccatttgatccagcaatcccactactgggtatctacccagaggaaaagaagtcattatatgaaaaagatacttgcacacacatttttacagcaacagtatttgcaattgcaacaatatggaaccagcctaaaagtccatcaaccaatgagtggataaagagaatgtggtatatatacaccatggaatactactcgtcataaaaagaatgaaataatggcattggcagcaacctggatggagttggagactattattctaagtaaaataactcagcaatggaaaaccaaatattgtatgttctcacttgtaagtgggagctaatctatgaagacataaaagcataacaatgatataatggactttggggacttggcggggaagggatggggtgagggataaaagactacgtattgggtacagtgtacactgctcaggtgatgggtgcaccaaaatctcagaaatcaccactaaagaactttatgtaaccaaaaaccacctgtaccccccaaaatactgaaatgaaataaaaatttaaacattgtgctttctcagaaaaaaaatgacaagacgctgtaaaaatttttaattattttataaaatagatacatacgtgcatgtgtatttcttttcaaatctttccaaaatataattttattgaagaatagtatatcaataaataagttacagcatgctacttttctgctcaaaatcctccaatgccaacagttgcttgttttcctttgactacaagccagatctcttactatgacacagcagactgctggtcatgctcgtcccatgcccaaccatttctaactcccgcttcttcctattcttccttctgtcactcagtggactctttgtatacctgaatgatgccgggaaaattccagaattagaacatttgcatttgtatttcttctgtctggaatattttccccaggcattcacatggcttgctggataactaccttacacattcaaatgttattttctcagtgaagccttttgcagcttttgctgtatttgaaaaggcaatccccattcacagggtctatacttcccttccttgatgtagcttttctcccagccattatcactggcaaactatatatatatatatatgtttaattttaattattttgcttacgatctgtttttccgccactagaatggaagaatataagctccaaaactttttttttttaatcgaatttttaaaactaactttgagacagggtcttgctgtgttgcccaggctgatcttgaattcgtgggttcaagtgatcctcctatctcggcttcccaaagtgctgggattacaggcatgagccaccacaccctgcccaagctccaaaaatgtataaatgcttattgcactgtggtttccttagatacattccctagatctgtatctgtcatatcgtaagcactcaataatatttgttgaatgcatgggtgtgttacaaaacaaacatataacagataatgcataggggtttgatagagaaatgtttgtggtgagaggggcagaagtagagtttagggctgagaagtcactaggaacaaatcagtagagactcttcaatctcagcaaataggtaatatttttaaagttaatgaagttgtgtaagatagagactgtaaatgggtgaccatttggttttatttgcttaaattaatgcttgcctttatgaccattatattgaaaagacgtttatgaccctttaaagaagacatcaggtttgaaggctattccatcatgagtcaaagaaagatttggagtactactgcaggacaaggctcttgatagagatttgtgagaaaaaaaataaaaaatggaagcagtgtcagacactagaaagttttatgccagaggctgactgtaacagaaaagatcaaaaccaatctaatttaattaatgtatctttaattaggtgaaggtaaatctgcaggtctggacacaaatgacaaacagtttatcatcagaatcatgtcagaaagtgacagaattactaaaatatgatgtggcttctttgcttatcagaagaactaaaggaaggcagttacaaagaggctaaaggtaaaactggaatatatttattctacagaaaatatattaccatgggggacactgtaactgaacttttctgattgattcaagaagagcaaactggaaagtgctctagcagagagggatgttgttatagatgaaaggggtttagagcctagaagatgaagtcacttgtctagagtctcacaggatagtcctgaccaagccagaactgggaccaaaatgactttaaactgttcctagattgagtagcttggatctatttaacttttacttttttatttttttattttcctttaagttcttggatacatgtgcagaacgtgcaggtttgttacatagatatacatgtgccatggtggtttgccgcacctatcaacctgtcatctaggttctaagccctgcatgcatcaggtatttgtcctaatgctctccctcccatttaccctgcaccccccaacaagccctggtgtgtgatattctcctttctgtgtccatgtgttctcatttttcaactcccactcatgagtgagaacattaactttcgttaattcctctttctactcaactaatatttctgaagccctactatgtgccaattattgtgcaatctctgctttcttaacttttaatgtggggggacagactttaaaaaaataaaatgtgtgcaagtaaaggggagatgaatgctagggagaaaattaaagcaggaagaggaggcagagagcagctgtagaataggaaaggaaaggctggcactggaagagaagaaggagtgggtcctgagggtgccgaggaaagacaaaggaagcagcaggtgcagaggcactaaggagggaccctgctgatgtgtttgaggaatgaaaggtccatatggctggtgccaaaggagcaaggagggaggattgacatgtgagggcatagaggcggggaggagccaggtcacggagggacttcagctgttttaaggacttgacttctactggaacaagacccgctgccattgaaggctttgagcagagtatcagaatctcacttatatttgaaaaacctcaccctgactcccgtgttgagtgtagatgtgaggaggcaagggtggaaagcagcagactggttaggaatcaggatggctttaaccctagtagtggtggtgggttggcaggaggcgtgttcaaattttggaaatacactgaaggtagagcagagaggattcatgggcaggcttgatgatgaatgcagaagaaagagaggcattaatggtgactcctgggttttgtcttgagcacctgaaagaatggagttgccatgtaccaaaataagaccaaatgaggaggaagttcaataagtctcttttaatctacagcacgctctctcttgcgctctgtctctctctcaccacttctttcctctctacccacttcctttgcaatttatcagttgataaaactatattggtctatagagtttcccacgggcagggatttcatggagtatttccctgtgtgctatttaatatgttcctctctcccttataaattctggaaatccagaatttaggtctatagacttggtcaaattcatgcttgatttttatcaatagtacattacgtgtaacattgattgtgtattttcatccaaaggtgcatcatgtgtggtttcacttgtggttatattagcagccattgataatcattgcttagatcctactaaatttgtcagaagttaggaaatcatgatactctaatcccaccatttagtcttcttttatgagctgaaatatctccataaagacaatatttggtttcattaaggttcctataacaaagaaaggccaaaggcttgattcttctctttattcgccaatattcaaaataatgagttggttacctagcatcttccaaaattaaacatttttaacaattttaataaaattaaggatttaaatatatttgatatgcctcaatccattgcagaatattcttgttgatgttcagattggcccatctttggccctgggtgtttttgaactgccctcagtctctaattgcttctttttttctactgggatatgttcctggctcatctttcatcttgcacatttccagccgtagaagccatcatttctccagggatcctagttttatcttagaggaaatggtatttagtgatcacagtctggtgcacgaggtcagtccttgtgtaggagctttttcagtgcacagaggcaagacatatgccacatttaaaattagataacattatcttaggttcttagagatgcttctaactaaaatttaaaagtatatggagcttttatttaaccttatctattttatatctgcttcttttctcgcagtgaaattttcagggtcaaaatcaccaagataattagtcacttgctttattccacatgtacagaacatttcaatagcagagaatgcaatgtctaattttgcctaaaaggtcagtgtgaagagaacatttgttgacaagatgaggatacatattctgatgagagcaaacaccatgtaggaagactcagaggcttgaaagagagcatagttcatttaggaaagagaaaatcctgttccaccagaggaatgatggatgacaaagtcagcaagaagttgggacataatgagcctgatattcaatgctgcagatgttagagcaccaacaagatacaaaagctttttttttttttctttttttgccttgctttcaggaggtatcttgcatttgttttcaataaaaatattactttcctactttgtcctcataagcagaacttagggatgagcaaagagcagggggttttaaggattgctctccttaacactgttctacaccagctcagtaaaaagaccatttaagtgtggctcaattattttctgacatttggagaagcatttgcatactaatgatccagggtcctggttgtttttctccccacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccaggtaggctgagaatggaatgttacttttaatcactatctcagctggtgcttagaattgcctaaagaatccaacaggtgtggttcattatcttatagtctagtcttcagtaggaaggaagctgtaaataagtaaaataaaatcattgggcttgttttctggggaatgaagctaagaaagaatgattttgaggaaaaaatagtccattgttttaaacttacggatttttaaattgtatgtgcatatatgtttctagtgcttaactgtcagtagtggctgtgggacaaagtttatcagagctccttgtgaacattcaagcaattccctttgagagcttcaggtgtctttattgtaaagatgaaagcattctaaaaattgtctacagccaaataggatatagaatagcgatagaatttagagctctttcttcccagtagttgcttcacagtacctgtttgtctcaagaagtctagcctgattttttgttttcatgatggccaacttttagcatgtgctagtgtgtgtgtgagtgtgcacatgcaaacacacatacatgtgtgcaagactgtgtccgggtgtagagaacagagagattccaaaagatatactggaaataactttactgcaacaagttccatatgctctgggagtcttggcagtaaattcgagatgttgtcagaaaactgcatctctgtgtctgtagtaaaacacagtggaaataagtcaaagaaacatgagctcataatttccaaccttaccacttcccaagtatgtgactttggtggagtgagttgacctctttttaaaattttaccttaattgacaaaattgtatatgtctttcgtgtacaatatgatatgatatatatatatatatagtgcaatggctaaatcaaactaacatatgccttgcctcatacatttattattttttgtgaagcaaatacttaaaatccatgcttagcagttttcgagatataataaatacattgctattaaccgtagtcaccatgttatacaatagaccttttgatattaagcctcagtttccagcgactttttctgtcaaggagaaattataatgcctacttcagggtgattgggagaatttcataaggtaatatactaggtacttataagacttgatacacttaaggacatgataagtagcaagtagtatattgattttttaaaatcatgttaagcaactttgtgctatgtcagagaccaatgggctgttggatgccccaaaacagcaatgaattgaaagcaatgttgtagggagcagtttacagagaagagttataagcaaacagtgataaggctccgatgactgaaggaacaccaaggttcttaatctcacgcagaactggataaaacgacatggacatacgtggagtggttttaaggagaggagagtttaacaggcaagaaagaaggaaggaggaaaaaaacagctccctcatacagagacagagagaggaagggattccaatgagagaaaaccctgtgtgtggtggtaaagtggctgcttatatgaggaggctggaggaggtggtacctgacttgcatagggctcagggaattggtttgaccgggcacgttattcacgtagcccagggggaaaactggccctcccaccctagccttttaatatgcaaaggcagggcgccatgatgctctacccacatggagatatgtgggggcggccatgttgccaggcacatgtgagggcaaggaagaacagggcaggaatcgccatgtttgggtggacccagtttctaatggccggtatttgcacatcaaagcttgccggcctggctctaagagcgggggctttcctgctagacaagaaacattttggagctgctttaaaagaccccttttcccctctatgtgtctaaaataatttcttaataatttcttaataacttctataacgatagtacacaatattgtgaaaatgtgagtgctttctatgtgcaaagccttgtgctagaattatagacagagtaccctctaagaaataaggttggaaaggagggtgggagtaaactgggaaggaaagtaaatgctgtgctgtggagttgggacttcatccagagggccagtacttctcagactttagtgggcattacaatacctggtgagataataaaacctgctttgctgggctccatttcctgagtttctgattcagtaggtctcaggtggtgcttgagaatttgcatttataatgagtgctatggactgaattatgttcccccaaattcctgtgttaaacccctaacacccaatgtgactatatttggagatttggctttcagtaagtaattaagattaaatgaggtagatcataatggtggggtcctagtccaataggattggtggcctcaggagaagaaacagagctctgtcatgtgagggcatagcaaaaaggcagccacctgtaagccaggaagagagccctcaccagaaacagaatcagccaaaaccttgatctttcacttcccagcctccagaactgtgagaaaataaatttctgtcattgaagccactcaatctatggtattttgttatggaagcctgagcagatgaatacaatggggttccaagtgatgctgatattcctgctctagagaccatgctgagaaccagcacaactcttttttctgttcactttcacttatcataggtgtgtgtgtgtgcgtgtgtgtgtgtgtgtgtgttttaactggattctgtttccagtgccaggaaaagtcaaagactgtatgtagaagaccaagggcaataagagccactaatgaacctcatcagcttgtcttcactgtttcatgagcggctgctccttattgaagcccttttcacagattccagttaattagtcttcagtcctggggtaggggtggaggtggggacaaattcctgaccagcaaaagaaccttggtactctcagctttatgttctttattttctttctttcttgtattaaactccaaagtcagctttcagtttttgaattttgctctggtaattaaaaaacacagtatggcttccaaatatgttcaacttacggttgaggtaccaggagaattagactagaggtgggaaaatagttcacctttagtgctcctggtcttgcagttcagcatctttctttccccctcattgacattccttgtctcttcccctcggccaccgtgaagcctcacacacataaccactctcctttacaaaacataaaatgtacaaaacatcaggaaaaatgggataaacttgttattaagcactctgttagttgcatttcctaataatgagatgaagacatttttctttaacctctagatacccctttcacgagaaaaactgctaaattgaaatcaagagtaaacttttaatctgaacagtaaatatatcactttctttgtatttctagacatctagacactgggtttcccatcatttgtagattattattgtacataataaataatacttcaaaaatcagtttctcataagcttcttgcctgtttggacattctatatatatatcaaatctttggttcacataggatttgtacttaacaaatgtttgctgattcaaatgaaatgaataatatatagctttaagtgttacctcacccaaccttggggcagtggtttaagcaggagtgtgcatcaaaatttttaggttgcttgtcaaaatgtggattgaatggccttactcccaggctttgatagagcttggttggggcctcagaatatttgcttttaacaaacacccatgggtaattctgtgaatcacacattgagaaacactgtctttaatttatggcatgaaggtttctcatgttggaatttaaggtgttagtccttcatgtgggagaagattaaagggaatattagggcttgtctgacccattgaaataaaatggcatacatagttacctccttcagctaaaataaattggcataataaaaattttaaatccttctgatataccagtctctaaatatcgtaaagtgaatttcagcttacccttctgagtcattttttacactcccaattttcattttccaggcctactaatctgcagaatagctgacgcaaggaaaaggagtggttgagacagcaagttccttgtattgttatattttgcatatgtcaaaacaagaaagaacacaatttaataaaaatctttaatttgtgttttaaagaagctaatgtttactgtaattgatttttttttcctccttcatggtaacattcaattttaaatatccatttacttattcttaactaagactgaaattatattagaacttctgtagtagtacttgtgacatctgttcaaatacaaagtatattcattatagtgattgcaattaaaatgaatatcaaatgagtttgtaatagctttgcgcttaaaatgttattttttattttaagagctttacgctcaagagttcatttggggctctatagtttctaatgatacttatgataaagagttgatattcatatggacctcatttttattttgataaatattcttttataccataccattagctagtaaatgtaaaattacccattattagtatcttccaatttttacaaggatagtaatacatgccttgtaatgtgctctcttttattactacaaaacttaaaaatggaaacaaattaaaaataatgattttgccagtatttatggtcatgtccattctcgcaatgtaactgttacttcagttgtcctcagctttacaaaatacacagaaatggaaaaataaaaagttattttattttacgtagaaaagcctgcttagaatgaggcataccaatttgggaatcaccaaattagttctacccaaacagagaaaaatcattaatggtcatccaaatggatgtctacatgatttatatttatatccccggatttgtaaatgtaatattaccttaacttatgaagggctaaattagtgaacagtgaaatctacttctcaaataagtaccataagaacttgaatttggccgggtggggtggttcaggcctgtaatcccagcactttgggaggccaaggcaggtggatcacttgaagtcaggagttcaagaccagcctggccaacatggtgaaaacccgtctctactaaaaatacagaaaattagctgggtgtggtggcatgcacctgtaatcccagctacttgagaggctgacacaggaaaatcacttgaactcgggaggcagaggttgcagtgagctggtatcatgccactgcactccaacctgggcgatagagcgagactctgtcgcaaaacaaacaaacaaaacaaaacaaatcttgaattagataaatcaagcactgagggagttcccttagagcctacttgagtagtcttagtcaacaatactaatacttttagataaccaaaatgtttctctgtatttggacaagaactattatgctgccattaaaatgtttatttgtgtatcttacatacattgtagtcatatatttattttacaaatcatattacactttctagttaagaatttttttgctgaagtattgattccttacatatatatttatttaattgtagagataaaaagttatcttccctatttttctggctatatttagccctgttttgttggtttccagtgtttttcctcttttaatttttcagtgttggctagttttcatgaatgatactttttactgcttcttttgttgaaagaagcaatataaattatatatatttttggatagtttactattagattttgtatctattgaaattgaattatgcttacaatttttgcctataaagtaagctgtgtaaaattcagcatactttatgatactaaactgtgatttagtggctttgaaaagacaagaaaacatgactctggcattgtaacatataatctatttttagcaagaaattctaaactttggtgcggctatcaagcaaatgaatttcaagttatgctgtgcattataagaagctgcagcatttaactcttaagacgacatggataaatcaattccaataaaagatttttcagtaaataaaatttattgtgactaatcagtgtattaatcagaagattatttacttaattattatacccactcattgtattaaaattgggtgatataattaaatgagacaagcaacgaggatagtaataactaaagggtaaaattagaaaattgtatcgagtaatgtttcatactcagacaactagcatctgcatgatgggcactgtaattgaaggggacagagggattgcagggagaagagtaagcaactatttcaacaatatggataggagttgatgagaacctcaactggaataatgagtaggagaataagtcaacaaatattttttagttttgcctgtgtatcaggaagtgtgacatataagctgatatgggaaagattcatatgagttaactaagaaaaaaatgagagaaggattctgggttagcgatgtcagcatattcaatgattcagagatggagatcaagagacactaatttgaaggaagtgagaggcgtcagaatggctggagtagtgaacttgaaggtgggagaggcagaaaaatggaaaccggaaattaattcagagtctctacctaatgttgaggattttatttgaatggcaaacagaatgatttcaagtagggaagttctggctgttccatggatactggagtggaggaagcagaggtggtgggaagagtctgtccgcaccagagtgcacatggactgcatgtctgggaggccagctgggacttgagagaaagtttgttgttgttgttgttgctgttattgtttttaagtttagatgctggaatcaacaggagttgtgattacttatatatacaggaggaagaaaattcaagggtgactcaagtttctgacttgaaaaactggccaacagttctaaggcttaccttgtttattaagaaaaaactggagaattggtggtcacttagctttaacatgcaaagtgatggcactaggaatacaggtttttatgtgatctgtgatggctgatggcatagtgtaaaatccttttaactgacatcaaaagattaatgaattaaattttttcttccttgaaattttcttaaacatactctacaactaaaataaaatggaagaactaagagtatcatcagaatcctaatgttttccattcttgtatttatattgaaagatcagaaaacatatagtcaagactgacctatctcaattatgtaccaattttttttttcctcatgcaaagcctcctgtattgcttcagcttcctgggctgccttggtttcatggcacctgcatgatgtctgaagcaagggaggagcaggctgcaaacctaagcgcagacaattaaatactcctgcaaggaagtaacacgttgtgtgtgtgtacattttatggaccaaagcaagtcacatgttttgctgggcctaactttagaagaggacaaagtacaatcttcccatgtactcaggagcaaagatcacgtggacttattgaatagttgtaatgccttcttaagatgactcagagaggtaatgggaggagaaagaaaagaacgcagaagaaaagaaaaatactaattttgtttatttgtttgtggatggaatgttattatgttcactttttttttttttttgagacggaatctcactctgtcaccaggctggagtgcagtggcatgatctaggctcactgcaacctcagcctcctgggttcaagtgattcgtgattctcctgcctcagcctcctgagtagctgggactacaggcgcatgctgccacgcccagctaattttttttcttttttttttgtattttagtagagacagggtttcaccatgttgcccagactggtctagaactcctgagctcaggcaatctgcccgccttggcctcccaaagtgttaggattacaggcgtgagccaccgcgcccggccagttcacttttttttttttaacgagggtcagagataaagagagactccactcaaaggccaatttcaatgtaagaggacacccttcttttacagattaactggtaagcaaaaaaataaaataaaaaataaaaatactggtactacaattatttgcttccttatgaaactttctacaattcttacccacggtgatcaccattttttctgaatttctgtttcacttagggcctaacctctatcacttagcagttgattatgggctattcatggcttttcttgctcttcattgttttctggtgttttaatgggctctttcttacaataacacaaggtctttgaggacaggggccatatcttagtatcttccatcatgcccagcttctagacatctacctagatagtgaataaattagaaaaacactaattttaaaaggggactaaagaagaggatgcagctagctaaaggaactgaaaagttattaaacagtaggaagaaagaatcagattaggaaagtcctataattgggaagctaagggagatgggtatttaacaataaacaggcaagcaagtaaaaaaataagcaaaagcaagaaaattgaggtatggtgaatggtgagacatcctagagaggaagccatcccctgtcattatctgttgggaggctgctggagtttcatgtcagtggagtttggtggattgagccactgaagactgcatggggaaaggaaagagcaggggtaagttttcaaaaggttgatggtacgaggatggctacatgtagaaaagctgcttaatcagatgacaaagcaagagtaggggtttaaaaatgtttgatatttttagggatgaggagttgtaagtaaatttataaactgagaaggagacattggagaggttcagattaaagatgtaagacagaaaaggaataataggtcccaggagagaaagaagagtgtagaatttgctttggtaaagaacaaggacacctgtttcaagaagggagctaaagacaagggcagaagttctcattaaatgtcttgaacaataccattctagacatttatctcatttaactctcaaagttacgcaaagtagattttattatctctgttttgcaaaataggactcagaggaataaacttactgaaggctaccatattagttcattttcacgctgctgataaagacatacctgagactgggcaatttacaaaagaaagagttttaatggactcacagttccacatggctgaggaggcctcacaatcatgatggaaagtgaaagacatgtctcacatggcggcagacaagagagcttgctcagagaaactcgcctttataaaaccatcagatcttgtgagacttattcactatcatgagagtagcacaggaaagacctgcccccgtgattcaattacctcccaccaggtccctcccacaacacgtgggaattgtgggagctacagttcaagatgagatttgggtgtggacacagccaaaccatatcagccatcattgctggaagtggaaaaactgagtttcaaatgtatatctatcctattaaaaacctttctgacacactgaagaaactgtgaacatggagaagtcaatgcttggccaccaaagtgagtatagaactaatcccggcaggaattgtacccaccctcatctcttcaaccactatgaaagaacgttttccctcttgtcattttcttttttgtgtgcatgattagaaatgctatttaccaagtgacctttggtcagttccagtatttctgattaataaattaatcttaaggtaaattttattaagggtagctcgagttgtactaaaagggtactgctagtgcctttcaagtggcagacttgagctttgaggtgagactttgattttgtatgtagcttagtctttaaaataacaaatataaggatgaaatggaaactctgtgaggttatccagtcactctgtagagcttgaaaatctgccttctcatgtctttctgtttaaggtagactctaaccttttgattctgaaaagccatgttcaaataaatacttattctagtatagaataatcataaagcaaagtgaaaatgcaaagactgcatgagaattatgggtttcatgtttatttctccttgtagttatctggctatatgttttcttaagttttcagacgggataccacactgctgttaatcttttttaaacaaagattatatattaaaatgagagcaacttagaaattacaccaaagctgaattttctttgaagatgatcacatcttaatgaacggatttgtcctaatttatgagaagtatgagtttatagagttgcatttaaactaaacttcaatatattaaaagaccataaagccaagtttttaaaatttgcattttagtttattatattataaaagattgtaaaaatgaagaaacggctattatccaattcaaaaaattaaaaaactacttttggactatttttcaaaattccatactacttactctgccattctgaataaaaaaagggataatcataaaaagtcttctaaaaagattggatagataaaaaaaaatgtactttaaactttgtgaaggataaaataatgtaacaaaatttaaggagaaaatttttaaaaagtactgacaattttattatttatctttatgaatattactctctagtttttgcttccatctgtacatactttcacagaaacaaaactggaatgaagttaatctgatagtcttttctactgacattaaatcgtaattttttccagttcatatattttccttaaaattatccactttaattacatcgtaaaatgaagataaacttaattcatcacctgataaacctaatcgtaaattatttttgaaaatacctcccctaaacaagatactgaaaaaaagcatcagagttttacaataaacttctcttggaaatacctaaagtattactaagatattgctcagttattcattctgcaaacatttattgagtataaaatatttagctgggtgctatgagaatacaatgagggtaaaaataatacagttgacccttcaacaacatgagtttaaactgtgagggtctgcttacatgtggatttcttctgtctctaccacctctgagacagcaagaccaacccctcctcttcctcctcctcctcagcctactcaacatgaagatatgaggatgaagacttttataatgacccacttatgcttcatgattagtaaacgtatgttctcttccttttaattttcttaataacattttcttttctctagcttactttattgtaaggatacagaatataatatatataacatataaaatgtgtgttaattggctgtttatgttatctgtaaggtttctagtcaacagtaggctattggtagttaagtttgtggggagtcaaagatgtaggtcaatttttactgcacagggggttggtgccccaacccctgagttgtttactggacttttaaatagcatttgccttaaaatatagagtgaaattttttttatgatgacaataaaatcattttgtataagacttataaatactgaaaaaatcttaactagtatgtccatcatggataaaagactgaataaatttagaattcataatgacttccaaacattttgatatgtgtattttgcattaggtaattctgcctcccctgtttgaagaggttatatttggaggaaagatgaggaaggcttaggaatgggagaaaatagggtctcagagtactattagctgggatatcagttcaggttcaaccggagaaacagaacaagtagaagatatatttagagatttattgcaaggaattggcttatgcaacagcggggcctggcaaggcaagtcggaagctggggcacactatcaggaaggaaaggctggaactgccagacacaaactgaagctgatgtccacaggaggtagttcttcttcaaggaagtctcagctctattcttaaggcctttcaactgattgaatcaggcccatccagattatctagaatatgctcttttacttaaactgtaattacatttacaaaatgcctatgcagcaacacctggaagagtgtttttttgaataactggaccccgtagctaagttgacagataaaaccgaccatcacagtcaacaaagatgacttttaatatgaactactgataaatctatttctagaatagcaatgatttattccctcatttgtatcacatatgcctctctaggtcagcatagtcaggtgagatccacctattacaggtatggagggatcttccattgtcctatcttttcatttctaatgaagatacagtttggttgagtgtcaaattgccaaacaaagttagaacaatggcaatttgagagaatcaagtagatcaactcagggagataagtcaaaagacaaagactccttttctctgtgttgtttcagaaaagttggctcagaaaagatggcttcattccacattttaatgaatatggcatgtgtccattaactcctcattctcttatctaaagggaagcacctccattgagccaaatacaaacatcctctttctacaaccttcggaaagctgcaatgtagccctatcttgccatcaacattcctctgcaatgttttctaacttacagttgaatcaagttccactaccatgcatcataaaggtaatgttaaagatgctcagagaaatacggttgaagaaactcatccttacagaagcacctatgaataaaataatccataaattttatttcagagactgtatctttcccgagctagtattttcccaccaatgaatgataagacttctctgaaatactagtaacactgatggaagttggattctattacctattgtttgcttacaatttaccaacaccagtggctgggtaaatagtttttataggacaatgaataatgttgcagagtgttagctgactaggaatgccacagccattatgaccttcatcccgtatcttaaaatctctataaaaacatgctcaggtattttttctctcttggtattggacctgaaattcaggcttaaaaatatattgtcatctatatatctagataactaatgcttaataattatctccaaattagatcatgatataaatgaagggagaggaaatagcagtagtatttattaaaggttcacctgggcattttatatatattggctcattccgccccaaatctctgtgagttgtatatcggaatttctattttatatctgaggaaacataactttagaagggttaattaattcacccaaggaaaaacagtaaataccgtgctgagagtccaaaccaagattaaaatctaggtttatgtacctctagactctatatattttctacctcaagaagttagaaaggaaggaaggggggaagaaaggaaagagaaagaaaggaagggagggaaaggaaggaagaaagagaatgaggcaacctaataagttaatcagttggggaatttttaatttcttatattgaaacattaatatgggcttccagcatagttaaagacccaaactttatttttttgttgttttgttaagtagtaggccaaaagagacatttataagagctgcacaaacttctttctgaaaaatcctacctttttatgttttttcaatatccactattggccctgacaagtatattaaaaaatatggtttatataacaatttgtttgaaatgatattgaaaaacatttgatgtgaaagaaacgaaaaaaacatgcctctctctacagagcatttgactttcatgtttttaatatcaaggtatttcaaatagaacatatgaattgtatattgattaaatagaaaaatgctgtaaaaggttatccccttcttttcagacataagatatggaaacgaaatgttgatgttttctttctttcttcttcttcttctttttttgatcttttcagaagaaactcttatgtctaagcctaacacaagtgacacatccagtgtttcattcttaccttataaatttgcttttgatagagttctccgagatcctgttaaaacgagaaagatcagaaatcaccagcttggcagagcccggtgggcagcacctggggggatgaacagcaggacactgatacagacatgaaattcaactatcagagatattgagacttactccattagggtagggacttgcttcctgtcaaaaacaaacaaacaaaaatatgaaatcaccctcagttcgattttgtaagtaggagggagagcagactagaggaagaggcactaggggaggaaccacgctgaggagcagaaaggagggcactgggtgtataagcagaggggagggaggtcctgcgcaggaaggcaaggccctggtggacagcaacagcaactagaacaaacagtccactctgcaggtctgttcagccagcctgttggctatatttagtatttcataaattttataaactcatgttactttagttggctcaaatgttaaaatcaattaatctttctctttagaaggcagatatttaagcctacctagaaaccaaacatattttattttgtttttatttcaaaatctcaaaatggtgaggtaatcaaggcagcaaaattaagaggatcaacattatgagacgttgaagtataccaaaagaagcttaatatgtaaacgaggacaaacaggtttctgctccattaatcacagttataaatttgcataaagagaactgggagaacaatttataaggttctaatgtaaatataagaaatcttaatgaaatggtatcaaccaaagccgagaaaaagtgtgtacctcctaaatgctggttatgctacataggtctcttagattttcacaaatgacttgaattttggaataactagacaaatgttctccaaactaataaaagatggccaaaaggtagattaatatagtaaaaaattataatatacttttttggcatcggaatgttctaaaataattgtttaaatataggtgttagcaatatccaaaaatatattctaaacctgatgacgaaggtataagataatcaatggcaatgatttgtctcctccttctatccctgagcaatttcttattctttttccttccagtctgggaataaaccactttctttgtttagccataagaaacaactcatccattaaagttttatcatgagattgcagcaattcagttacatcttcagactccatttctaatgctaattcttttgttatttctattacattcgcagtgacttgctccactgaagttttgaacctctcaaactcactcatgatgtttggaatcaacttctttcaaactccttttattgctaatatgttgatttcctcccatgaatgtttttaatggcttctaggatggcaaatccttaccaggaggttttcaatgtagtttactcagatccatcaaagaaatcactatccatggcagctatagcctagcaaaatatatttctttttttttttttttttttttttgagactgagtctcactctgtcgcccaggctggagtgcagtggtgtgatcttggctcactgctgcaacctccacctcccaggatcaagcaattctcctgcctcagcctcccaaatagctgggattacaggtgcccgtcaccatgcccggctaatttttgtatttttagtagagacagggtttcaccatgttggccaggctgatctcttctgacctcaggtgatccacccgcctgggcctcccaaagtgctgggattacagacgtgagctaccatgcctggcccatatttctttttcttttttcttttttcaaggcagagtctcactctgtcacccaggctggagtgcagtggcacaatcttggctcactgcatcctccgcctcctggattcaagcaattctcctgcctcagcctcctgagtagctgggattacagacacatgccaccacgcttagctaatgtttgtatttttattagagatggggttttatcgtgtttgccatgctggtctcgaactcctgacctcaggtgatccgcccatcttggcctcccaaagtgctgggattacaggcgtgagccaccgcgcccagcctattttttaaataatataacttgaaagtcaaaattactcctttgtccatgggcaatagaattcatgttgtattagcaggcatgaaaaaacattaatcttgttcatctccatgagggctcttgcctaaccaggtgcattgtcaatgagcagtaatattttgaaaggaatatttattattttttctgggcagtaactctcaatgggcttaaagtattcagtaaacctgttaaagttgtaaacagatgtgctgtcctccaagctttgttgttccatttctagagcacaggcagtgtagagttaacagaactcttaaggatcctaggatttttgcaaaagtaaatgagcactggcttcatcttcaagtaacctgctgcattagcccctaataaggggctgtcctttgaaggtttgaagccaagcgttcacttttcctctttagctgtgagtgtcctagatggcatcctcttccaatagaaagatgtttcatctagattgaaaatctgttgtttagtgtagccaccttcatcaattaccttagctggaacttctaggtaacttgctgtagcttctatatcagcatttgctgtttcactttgcactctcacattacgaagaaggcttctttcctaaatctcatgaaccaacctctggtagcttcaaatttttcttctgcagacttctcacctttctgagccttcatataactgaagagagttagggccttgctctggattaggctatggcttaagggaatgttgtggttggttctatgcagaccactaaaactttctccatatcagcaataaagctgtttcacttttctatctttcatctgttcactggagtagcactttcaattgcctttgagaatcttttctttgcattcacaactttgctagctgtttggcgcaagagggttagcttccagcctatcttggctttcgacatgtcttcctcactaagcttaatgatgtctagcttttgatttaaattgagcgatgtgtgactttctttcactcgaatacttagaggccatcttatggttatgaacagggctaatttcaatattattttgtctcaaggaataagaaggcctgaggagaaggcaaaagatgagggatcagctggtcagtagagcagtcagaactcacataattatcaattaagtttgtcatcttctatgggcacagttaatggcactccaaaacaatgacaatagtaacgtcaaagatcactgatcacagatcaccataacagatgtaataataatgaaaaattttaaattttgaaagaattaccagagtgtgacagagagacacaaagtgagagcatgccattgaaaaaacaaacaacaacaaaaaaacccgatgccaatagatttactcgaagcagggttgccacaagccttcaatttataataaagcatatgatctgtgaagcacaatgaaatgagaatgcctgtgtatatctgaagtcacccaatggaggatgtatcagtgcctatgtctctgtgtgggaacataacatgatgtgtctgtgtgtgtggtttaaatatataaataacacacacacactcacaaacacacactcgtggtttcaaaaagaaactactcaagcacaattcttctactcaaaatgtccctgaagtgagacatttagctctgatgaacttctatactatgtggggcagacttcttgaaaataacaatacacagagcttatttgaaaagcaaacaaatcagattacttatatgctataggtgtttgctattaaatttgaaaataacatatgtggggagaataatcaggctgtaggtaactaaaagttgactgtcatcactaaattaactacaagtgaatccaagattaaaagtgacagaggcagaaaaaaataaaaatgaagtgtaatgtcatacagctgaaaccagagtaatttaccaagagcagatacaaattcaatgggaggggttggcttcggtgaaatatgggagataaagatctaaggtaacatagactaaatgtaaattttaaaaaatgatctgaggtgagaatgttgtggaaatatgtaaccaatatttttaagaactgtttttttccatcaattcaacattgctgttatcctgtttctagtttcaccttaatatagaaacaaagcaattccagtaagatatataaaatatgtgcaggcatgattcagaggaatagaaaaaagaatgaataatttgaggaggaaaaatataattggggttatatatgtaggataaaggtatataaaacaagcccttaaaaataatgttaactgccttgaaaatgttatttttaatgagaaagtagattaatgaagacattggccttcacttgtattagaaaggatttagcagagattttatctgaagcaacttcttagcatagtgtaaatgaaatatttgcctgagtatcgggtttagaagtttcactgaaaggaaaagaaacttgacttgctgcctcaaattctagtagctgaaattatatgaggtgaagtttccaacgctgtctcttaagatagccgacctggccgggcgcggtggctcacgcctgtaatcccagcactttgggaggccgaggcgggcggatcacgaggtcaggagatcgagaccatcccggcaaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagtgagccgagatcccgccactgcactccagcctgggagacagagcgagactccgtcccaaaaaaaaaaaaaaaaaaagatagccgaccttaccttaatgaattttccacaaacctaagtcagattctttgggcaaaacttgacttatccacagactctagttcaatcacaagcataatcacagtctgtgagactgaaatccataatcaaaatgccattaaattaacttaaaacaagaagactaactgctaaagggagaggagggtctggccaccacactgtgtgggtaaggtatatggagagccaaattgtaaactaggatgccagtgtattaatttgtaatgaaaaagtgtattgctgaaaggactggacacttctgttctctaccccgccaaatctccccctgcagggctaccagatgggaagccaaattaaaatcagatgcttgcttcttgggcttggaattggaacaagaggagtaaatgataggattgcaagttcagggtaacaggtcatctttggactgtggagccctttctcctaggctgccgatggctatgcacaaacttgatcttgtttactgtgctttcccctccagcttcccactgaccctttgttttttctatagttctgttaatgtactcaatcaggctacagtggggtcttgctggcctgggagctatttagttctctttgtggtaattttgttcccatctttccactgagtgttgatattttagtttaactcacaaggcacaatcttatttttggaactcttcagggaggcccccctcaacccagcactgacgatgtaagacaacagagatgattgcttaaatgttttccaatcctacatctctgtggcaaaaagttttttaacactatattatggcacacagataactgaatttcctttccaaagagtagaaaagacaaaggaaaggaaaatctgggtggactcagaagatgtggcctctataaaactaaatcctcaatcttttctcatttctaagaaggggaaaaatgatgatgattgagatgttggaattcattgtcaggaaacttgaatttttgctccccatggagatcaaatggaatatgcagatggagtactttatttcttggtagcttttatagatattttgatcattttcttcatattagagatttcaatttgaaattgactgtgaagatatagaaacacatgctcagcagaaacgtcttacgacatattaaaccattttctccctggaaactgttgtgataataaatactaccaacatagaggaaaccactggggtggataaaccttattatctatctgtgcattattgttaaaaatactaaaatcaagccatgtgtgttgcatggagttctactggaaagctatcatgtaataatacaaaggaagataagagagaagaaatacaaatgggagtgactagagagtaatacaattaatttatagccacatatattaaatttgtttaatattgacagtagatttacccctgggaaggagaagaagaaaacagaatagattttattttaaagaactcctgaaaccttaccggatgttgcctaatgaggtgatgtaacataaaacatcactcgatgctgtatttgcatactgcctttttcccctaagagattgttttgaaagaataacaaagaaacagaaatgaggtggaaaacaaaataacaaagcataaatattttctcagtgtttgcaaatattcataataatttcctatcctctgattcattagttctctcaaaagcccacctggatgtcctcagaatgcaaactgatacttaattattacattgggatctagattctttatagctatgccactcgtgtgaaaaatatgcatatctatttaagagctgtgcaaagcagtggtgatgtgagttatgccattttgctcaacacaagacaaactcctaaaaacagctttaatgtagacacaaactgttttgataaataaagctaactcttaacaagattgttcagagaagactgactttttcaatgtattcctttgtacccttttcctttcaatgtagaaccttctcttcctgctgcttcctacaaccttttcctcctacagttttctgagcaactccacttatccatagagaaaaagattttggcactctgattttcagattactcttagcccaaggtctacatatctttcccttcttcctcacccttcccaatttcacaggagacccagtgctcccttgtctcgctttaaattcttccctataataggccagaaagactctgacaccagatgcattggatttgttttctaactaaattttagtataaaaacatttaagtctagtgacatcacctcgtgcgtatggttttgcatttagtacccttcatattccattttgaaattggccattcactcattcattctctgaactggtgcatattgatcatctgctctctttaaggcactaagctaacttctatgagaggttaaaaaataagacctggtcccttaaggccagttaaagacaaggcctattaaagatttaatcttctactaaagacatttcaaacagcctttgcttaaagagaagtaagatggtaggagactggttagcctctgaaatcacattatgcctaatattggccctaaaaatatattttgttgaggtctttgttaagggagatatggggatatggggcagatgaaatcacagcatactcttcctctgtcagaattctcatgcccccctattgcacacccaccaacccaacaaacacacacattaagatataattacttatacccagacttctgtttgcaaggggctgctgtcctgcctatggctattgaaaacctatttctccatgatgtacctatctttcctgggccctttacctataatatgcacttccctcctcttccagtcatgtagtagatataatcctccagttaacccagcccctaacttcagtgttttattttgtctcaaaaatccaaatatttccatcgaatatttggtgtactttttagagaatgccgtgtcatttttttttgtaattcttcttttctaaaattcttgaattttaattttaagcggtgcatttttatttctgaaaatcaaatttggctaatgaagtgtttagcccaatccagtgaagctcagctccctctttgagccacagtctgtgctgtctaacgaaccttcactgaactcatgggtagtacaatttagtagtggtatttcagtagtacctgttgtatgcctcgacaaggctttggagaaaattcctctgttctgatttccaaattcagctcttttctctgctaattgcttcttcttcttcttttttttttttttttagacggagtcttgctctgtcacccaggctggagtgcagtggcatgacctcggctcactacgacccctgcctgctgggttcaagtgagtctcctgccacagcctcctaagtagctgggattacaggtgtgtgccactacgcctggctaatttttgtatttttagtagagacggggtttcaccatgttggtcaggctgttcttgaactcctgacctcgtgatctgcccacctcggcctcccaaagtgctgggattataggcgtgagccacggcgcctggcccattgcttcttgatataagtactagctattctacagcctgcaccatgacgtagccctacctagtagaaactttgagttagattgcagtcatcaaagccatttgcccttcctttgtctctaataaaattaccaaggacctctccttaagtagtctatcatcctaaactctcaggagatacctctgagtcttggttttctttaaggtttgcaagaaaggccaatcactcctttcttagaacatttaataccactttttaacttatttcctataataccaagatggcacacatattaatcaaaaacacaaaccctcccgatctgacataatgtagatgcaacattacacactttgcccagtaagtaccctctccacctcaaggatcctttgccctttacaaaccatgtttcaggttctccatctctatcacagcctgaagggcaatgtcccaatgtattcaggaatcatttagactatgatgggatggcacagtccctacatctgctaccaaatcaaggagctgattaacagtgcattgcagctcttggcaagagttagagtaggaaataaaattaaggtgtaggggttaggcaggaaattcagataaaactacttgggaaatgtagctaagcaagatataattatctaacttataattagactagaacatcaggcctcccatccctaaaggcttctttttgcaaagagacaagtgataccatcaggtagcagatggtattcttgtatgggtgcgagtgagtgatgaacacttcttaccttaagaatttggttgtaggaattattcctactggtgataacttgctagcttaatagttcattatttctgtgtcttccattcctttgggctagtacacttattaaattagaaaggtggggtggtctgcaaaatttcagtgacatctctacaggctagctattggcctctgccatttgatcatctcaaactatctagcaaattaatacaaccaacgaaagccgacagactacattgatttgaatataactccaatttttttattgtatttcttaaaagttctatgacatactttagtttgcagaaaacagaaagttacttagttttagagcgtgattttttttgtctcactggatgtttctggtttgtttgtttgtttgtttgtttgtttttgagaccgagtctcgctctgtcgcccaggctggagtgcagtggcgcgttctcggctcactgcaacctccacttcccgggttcaagtgattctcctgcctcagcctcctgagcagctgggattacaggtgcccacaaccacgcccggctaatttttgtaattttcgtagggacgggtttcaccattttggccaggctggtctccaacccttgacctcgtgatccacccgccttggcctcccaacgtgctgggattacaggcgtaagccaccgtgcccagctgaatgtttctgttttaaagatccttgcatgtggctctgtatgtaaccctgtccttgcaaagttgttagaaaaagataaatgaactcccattggtttaaggaattgactgtgaagagcgtgatgtaatctaaaaatcagaacaccaaaacttgtttcctctttggataagtagaattggtcaaagaacagagtttatgacttctcttcacataaaagatgacattatctatgatgaaagacctagttcttgattttcttcagattccacatggacatcttacttgctaaaagcaacgtggccaaacaatttctgcctgtagcaaattgttttcagttatgtttcctcacgaagtagtatcctgaaattaccagtttgcatactgtttgcaattattactacaaatgcagtttagcttttgtgtaaatgaatgaatttttattgtatatatttaaggtatagaacatgatgttttcatatatacatacatagtgaaataattactgtagtccagcaaattaatatatccaccacctaatatttagcttttaaagccctttaatttctaaatgtggaattggttcatttatttacttatttatccattctataactcattaattctttgtaccaacatttgctgaatatgtactttgtgtaagtcactttgttaagctctctggaaaataaaaacaaagttcaattttctgtgtagtaaaacgtgtttaaccacaagacattaacagagtactaaattaatagaaatttttcatgtcaactagtgcattattttgttatggcttccatcactaagtaccatagactagatggcttaaacagcagatactggttttctctcagttctcccagtgtgactatcaggattctaatcctgtttttgtatttgtattaaaaagtgatagaacgtatagtcaagacggatggattaaattgttcatctcgcccctaagaattaagagtttttgttggtggtggtttgtttgtttcatctctggctgacaggaagagtgaagaagagaacgctgtttcctcgtagccccaaataacatttcacctacttctaaagctgctgtgaggtatgcaaggtcttacataaagagaaaaatctgtctcaaaaatctgcctcaagattgtggagtcttgctctccttgcattcttttggtttttctgccacaattttgagacttatcctaggaattcagttcagcctttttttcgccttcaaaataagcacatttggctgcttattttgcagcagccaaaacgaagcattcggagatgttattgttgttgttcttctctatcggtccagtacagttccttttcttcttttattcctaggaaatctctttgaatctactctgtaaatagaaatggcttcccaccacacagtgaaaaccaaaatccttatcttgactttacagggtctttcatggtctggccctgcctgtatccggcctcctctctcactcttcctcttgctacgtggctagaagcaagaaaacagggaatctaatctagttttatctggctctaaacccactgctcttaatcaatacactgcaatgcccttgtaagttatttacctctctcccatacagtacgtgccaggtggcccatagttctagctcctatctccaacctgaaaccaattattttcacaaagtcacattgattaaagtataatatttacagaggtatgtgtaagagttgtagatgcaaagtttgattgcttttcacaaagtagatgccactgcataaccaaaatccagaccaaatttttacctgtgccccaatgaaccccttataaccctttctgaaacctaccccaccaagtaaccactattctgacttctgaaactataggtgtattttcctgtttatgaagtttaactcttaatttaagagtattagatatactgttttgtgtctagcctgttttgcttaatattaaatttgacagattcacctatgcagaagatagtatagttcattctcattactgtgtatgtgagtatattacaaattgtctcctattttaccgtagatggatatttgggttgcttctagtttggaagaaattcaaatactgccactagaaacattcttgaatatgtcttgtggtgaatatatattcttttccttcctcttatttttaaacttctattttaagtttagggatacaagggcagaggtttgctacataggtaacttgtgccatgggtttgttgtacagattatttcatcaccgaggtatttcatcaccttagtacccattagttatttttcctgatcctctccctcctcccatcctccaccctctgagaggccccagtgtgtgtttccctctgtctgtccatgtgttcacatcatttagctcccacttataagtgagaacatgcagtatttggttttctgttcctgtgttagtttgctaagaataatggcctccagctccattcatgttcctacagaggacatgacctcattcttttgtacggctgcatagtattccatggtgtatatgtaccacattttccttagtcagtctattattgatgggcatttaggttgattccatgtctttgtgtattctaacagtttacatcactatcagcagaggatgagaatattagagttctcattactctgtatgcttctcagcacttaatagtgtatctatatcatttgagccattctcatgagtatgtcataacactacctctttttatagaccttatttttccttaaagtaactaatttattttagctgtaggacgaaagcagaaaactcagacaaaagagaaatattacctttagcaaaacaatcagaaatgagatatcaaaaatcacccgaaatatactacctaaagaagactaataacatttccagcgttagtcggttagacctttcctttgtttgtgctttcaagtacagtcatgtgctgcataacaacatttcggtcaactacaaggcacacgtgtgacggtggtctcaggagactacaatggaactgaaaaattcttaacacctagtgatgtcccagctgtcgtagctgtagcccaccacattactcatgtgtgtgtggtgatgctggtgtaaacaaacccactgtgcttccagtcatataaaagcatatcacatacaattacaagcagtatataatgcttgataatgaaaatcaactatgttactggtttatgtatttactatgctatactttaattgttattttaaggtgtattccttgtacttctttttaggtttgctgtaaaaccgtattcagtgttatgccagcagcagcctcatacatcccatgtttactgtgtctcttgactgtatcatgttcttttgtgcttaatttaattacacattattttattcatcacggtccttaatcatcaaaattcatggctaatgtgtcagaaagaggccctgtcctgtgattgacctgaaagctaaattaaaagtgaataagaggtacaaagatggaaaatcagtaatggttattgctcaccagtcaggtctgtcccattccaccatagccatgatctcaaagaatgagaacaaaatgatggaagctgaaaagatcttcttcattgaaggcaatgagactaacaacagttcaggaagagcctatatcagatatggagaaacttctaatgacctggaatgaagaccagtcacagaagtgaattcctcccagcaccatgatgatcacagccaagcaagaagtttgttcgcaatgttgaaagaaaaggctggacccaactacaatgttgaatttactgctagctctgggtggtttaaatgattcaagaactgtttttcattacgttatgtgaaagtaagtggtgagtctgcaagtgctgatgtgaagacagctgaagaatttctgaaaactctagttttcagttgattagtgataagttgattgtgagggggaattacttgtcagagcaaatcttcagtatgaaggaaacctctgtattctggaaaccaatgccttaaagcactattatccctaagggggccaagtcaatgctggatgtcaggtttttaaggacagaataaccatctcactttggagaaatgttgcaggctacaaatagaaacttttaatgatatggcacagtgacgaccccagggtctccaagcatatcactaaacacgcactgctggtaaactagaggagccataagaagtcatggatgacccagctcctttccaagacgcccttctgaattactatgccagcaaaatgagaagtactattggagaataacatacctttcaggatttgcttattgttggtgatggtcccacacatgctccttttattggtgatctccatcccaatatcaaagtaatgtttttccctccaaacaccacctctttgattcaaccattgcatcaaggcattaaagcactttttaaggcctattacctgagaaggacttttacccaggctgctgctgcaaaaaaaaaaaataataaaaaaaataaaataaaaaaataaaagataccaatgcaattctggaaggattacgacatctctgactgcaccaagaatcttgcttgggcttggggtggtgtcactaaggagtgtataaatggcagctggaagaagatactcaagaggttcatcaatgacttcaaatgatttgctcaggatgagcaggttggaaaaatcaacaaggtggtggttgaactggcagacaacttgaacgtgggtgtggatgaggatgacatcgaggagctcctggaggttcttgagaaattgactaatgaggagttgttggaatagaacatatagctgaagaagaggcaacagaaaaggaaactgcaggagaagaaaaggaaaacccccaaggaaattcacagtgaaaggtttagaagtttttacagacctcaacaaactccttaaaaagtttaaaaacgtggaccccaaaactgaatggttcgttcatagaggaatgttcatagtgcattgtctactgataagaaaatctatgattaaagaaagaaagaaacccagcaaaacttcataaacatatttctgaaaagagtgacacatctttaaaaagagccttaagcaggtccttcaggagccattccagaagcaggcattgttatcacagtagacagcagctccatgggtgtcagtgcccctgagaacgtcccagtgggacaaggtgtagaggtggaagacagcagtagtgaccctaaccctttataggcctaggctactgtgtgtgtttgggtcttagtttttaacaaaaaagtttaaaaagtaaaaataaaaaattaaagattgaaaaaatatttaaaaatcttaaggtaaggatataaagaaagaaaatatttttgtacggctgtttgtgtttcaagctaagtgtgataaaagagtaaaaaataattaaaatttataaagtaaaaatttataataagctaaggttaattatcaaagagaaaagttttctatatatttagtgtggcctaagtgtccagtgcttctggcatctacagtagtgtgcggtgatgccctaggtgttcacatcctgtcaccactcactgactcactcagagcaacttccagtcctgcaagctccatttttgttaagtgccctatataggtgtgctttttttttatcttttatattaatttttactgtattttttctatgtttagatatacaaacacttaccattgtgttacagttgcctaaggtatccagtacagcaacacactgtacaggtttataacctaggagcaataggctataccatatagcctagctgtgtagcaggatataccatctgggtttaagtacattctatgatgtccatacaaagatgaaattacctaatgatgcatttctcagaacatacccccactgttaagggacacaaaataagattttacacaaaatcttgttacttcatataacaaaatgcaacataaaactttcaaaacaaataaatacacttatgccccataaatgttaatgtgaaaatcatatttcatcaaaaatctatattactatgttaaaatgaacagccttgtaacatatctttgcataggtccctaattaattttcttaaaataagtcccaaagtggaattcttgtgtcaaaaactatgtattttgttacagctttcgaagactactgttagacaatattgtaccctgaccaactatatgctaccaccatcctacatttttacccaagctggatgtgggaattcttatttaggtcattgtgacactagtttattggtagtcgttactggtagtgaaacaatgactccaattcacttcccagccagccatcctggaggggctctgggtgcccgggcaagccccagcctctcatctgcatgctcaattccactcttcttttgtttcccattggcaccaccattgtccgcctcctggactcatctcttggtcttctccatccttccagctattccagctatcatatcatgaccatatcaggcttggactcccccctaatatttattcgctaccataaactaaattatgttttccatcctaagcacaaacatttcactaacacccgtcatctgtttgtgaggcagcagcaggagcaggtaatccacggttctgctttctctgtactcttctagaaataggggagcttagattctccctggatcccatcttctagagatggcattactggtctcatattctattttctttcatgtattgaaacttttgttattaatagcttctgactaaagtgaaaatgtcaatgtgtaaaatatgtggggtaatgtgttccacaatatacagagaaaagctctgaaacagtctcctgtaattctggattttctgttttcttcttgttttttaaatttccgggttcttgagtccatgtggtctaagtcctgcattaatcctgaacacatggcagcagggataaagggaagacctgaggtccgtgttccaattcgccagggatgtgaatgccctggacgttctccttctgatagggacaggaggcagagaaattctaggcagaaaagggtggatccccaacaaaaccccaccctcaagcctgggaacacagtccaaagtgagaacttacatctctgtttctggctcaaatatttccttttccaaaaccatgtgtggccctgccccatcctgtgcctataaaaacctcatactcaaccagcagagagaggtgaagcagctggacatcagagactgtggctggatgttggagagaagtggcttgacttcagagggagagcttgacagcataactttggagaagaatctggccagagatggccagacgtcaggggaagattaccttcccattccatttgcttttcagctccccttccaactgaaagccacttccattggcggtaaaatccccgacagttgccatccttcaggttgttcatatgacctcatttctcctgaattccaggcaagagcctggataccactagtgtggataaaaaaggctgtcacacttgccctgtgcccctgctggagggcagccacctcatgtgagtaggcagagggacgactcagctgttaacactcaagccgtccacggatggcagagctaaaagagcactgtaacactccctctggagcttcaggggtcatgggcatcacgccagactctgccacggggcctgcatgaagtttgctcctgctggtgcccaaaagcactggctctcggctcctgcctccacttacccgtgtgctccttcccatgagtggtggagcacagcggatccgagtgagtggagctggctcctgcctgcgctgaagcagccagttggttccagtgtttgcgcactccagttctcacctcgttcatttcatgctctttcctgcaaggagttgacggctgtgagctgggcaaatgaggcacccggttgcaagttccatgaaaggctcggggaaatatcctgcttcacttccatatggagctagtgctttgtaaagtgcactgacaataacaaagtgtagaggaggaccggacacaggctgaactgagcttcttgaaaaggctgcagctctcagaacaacgctgagaaaactggtccttcagctatagacacagagtcaagaactccatttttcaaattatatctcatgaaaagctggtgtccagtgacgtttatctgagaaaaagaaatttttttttggccaaaataactagatagatttttgttagactttataatgagaattatgaatttcctgaaagtgggatggaatacagaatgttccccaaattgtttccatggaacagctaatagcacatagagcatgcgtatttgctgtgacatgataaagctcaaggccagagatgtcttgtggggctcccaagtactctaacctcaaggtgcatgccctccactcactaattggctcctctggctgtgatcgagctccaaaagggaaggaggctaattcaaatgggatggccccaaaataagaggaatagtgtgcatttaaaccaggatatgggctatacctgcttacagtaccctttatgcaatctccagttcattaactctagtagatattgtgaagatactatcaaaaaaaggttatgttcccccaaattagggaagccctaagggattccgtatctcctttttgtacagagtttgttagaaaatcagatactggtctgagaaaaatgctgattcagatggtcaagagactaaaaaaaagtactttaaaacatcagaatgaaatcactgaaggcaatccttagctttatgatgtgctgtactcctggacaagatggtgtaagttgagatgatatgtcaaatctgatttttctataggaaaaaattgtactttagggaggtatagttctagccatgttcttaatacccaaaagttaatcagaattaccacaaatgatctactcattcaaatataagtagcccacaaataccatgttaaactttctaaatttgaattgtttaaaaaagcaaagttatagaaaatgacatttatgacccattatcagaagctttagatccaatattagaatattagaggcttttgtgctaaactcttttctttcttataaattctagcctttatttatctattttaggagggcatgtggcaaagcatggcagggaattctttcaaaagtggaatccaggaagaaaattccttgggaaactttggactggattctcaacaaacccttcagagagacttaaagccggtaaaagaccttttgcaaaagtgatccggggggcctccactttgtttctctggatatttctctgttgaaatataggtgtcaagcacgtcccattttagatgctcttcagacttcaaaacattaccttcctgctttcagggagccatttcatcagcttttgtactgtgtattcactgcagaccctgctgttatgcaaggtaccaccatggctaaaaattcacaagacgattcttagttgcactgattttttttttatttgatctttcacaatgttgctgcttccgtttcaaaaacgtctcaaagctttgatttgattgcagctggattcaaggatacccaaagccaagtttgatcctgaattccccaaatcaaaagtatttcatttcagatgtatgttctatacctggccataataatgaacagcaaccattactggagcatgcttttgatttttttttcattaacagtcatttttatgatttggaaacataattagaagattcctattccagactacaaatcaatggatttgattctactacacatttgccaataaagagcaatggtatcaaatgaagcatttgacctgtctttaaatttctttcattctgtaaattctacatgaggtatgatatatggagccaactggctcctctgccacactgctgcagttcagttgttggtattgtctggaaggaaaaaacgaagttgtggaagtgtgtgagttagttggaggtaattaccatgtaactgattatcattcatgttctgagcgctgtgctattacatacattattttatttcatccttgcaacatccttattcctatttttcagctaagtaaaaaatgaggctcagaatagtgaagtaattatccacggagagggaagatcagcagtatagattaagttggaataaatctaaagctcatcctctttcactatagcatgctgctttctagctatataagaaaaaaacctcattattctattaccccattgagaaagtactgttctctcttgttcagctgtctgctttacttagctccgatgaaatctaaattaaatgctctgctgctgatgatgttggtaacactctggtggtactaaccatagttctggggagtgaatgggaagaatggccaagactggagatggggacattagattttgagacacagaccaactgaaatgagactgtgttttctgttaataataggaatttaaatgaatcattgaaaaatcagagaaagttttctgaaatataggaagcaaatgctacctatacttctttatatctttcaaattaaaaaataattttcaatacatgttaaatggtacaaaaatcagtggggcttttttaaaaattcaagctttataagaaaaaataataaaacatgtgccaaatatgtctgaatactattaaatgtaaatggtgtatcattaaatgcactggctgtttgggagaggtgtaataaacaagagacacattgtagctatgaccgtgacgatttactttttttaattctggaggaaatttcaaactgtggaatatataagcagaaaggaaatgaataatgcatctaactagcatgcgatagtaagcctcactcccgttgtggacagacaatatacaagaaaagattttggtggaaagatgtaggtgctatttaaggggaggatattctttattgaaaacatatccagcaacatctgaatgccaaataaaagtctttacagtttcatctctccttagagagcatattttttagttgttgttttgtttgggagaaaattgcagtttaagatttacaaaccacttcatttgcaaactgctattactatagtttctgcctctgaaaatgtttaaagctgcaggcaatgaaaagacatattattagagcttttccttataaagaaagctctcattctattgtaaaaaatgagcgtataaaaatacaatattatttatagagttatttatataagcagcattttgatgtgccttcctgaggcttggagatattagaaagcagaatatctgagaaaacatatttcacttcgttgtttaaatgcaatagagatcaagagattatcttcatcatgataagattcaaagaaatttacactggtaattggagcttgtccatagaatttattccttattacaatatagactataggttgttacatttttttccttaagggaggtaaggttagatttttcactatttaggttgagactctttagttgataactgaaagttttcttttagcattcaatttgttcttgaattattttttatttcagcatatctttctaaaaattatgcatgatcagctcttttttttttccattttcctatcagctgtttatcttagatcttcattcatggatgtgttagtttcccaggattgccaaaacaaatcaccacaaactttgtgtcttaaaacaacagacatttattctctcagcagttctagaagccagaagtttgatatcaaggtattcataaggccaaacctccttcaaaggctccagggaaaaatccttccctgcctcttccatattctggtggctccaggcttttattggcttttggtggtatcactccaatctctgcctccgtcttcacaaggccttccattcagtgtctcaaatcaaatctcttttctcttataagaacaccagtcacttgacttagggcccacccaaatccaggatgattaattttgagatccttaacttaaacatatctgcaaaaatccaacttttcaatttccgaataagatcacatttccaggtgctaaggtatattagtcagggttccccagagaaacagaaccaaggggatatctaaatgacccttatgggagaccactagtgtcgatcctggttcaactctaaaggcctgaaaatcatgagtgctgatatctgagggcaggtactcagaaagaagaaatttattctttctccaccttgttttaaattcaatccctccatggattggatgattcgcacattggtgaggtggtcttctttactcactgtactgattcaaatgccaatctcttctagaaacacttcacagacacacccagaaatgatgttttactagctatctaggcatcctttagcaccatcaagttgacacataaaattaaccatcacacaggggttagcgtttgggcatgtattttagagggattcaggtgaatgtattacaagatgtgaaaaatagactttggagttaggcaaaactgagtgaaaaacatggatctgccactcacattgaggaattatgatcatgcccataattctttagagcacaagtttcccccttttaaaaataacgatattttaataattgtgatgatactagcttcacacatgttgtattagataatagcgtgcattgtaagataatatgtataaagcaattagctccctgctttgccaataaatggccattgttaatttattgattatatggattttatttttctaattagagtaattccattgacttcaatttctatagagttcttctttccttttatgcagcagaagttacaaaagagaatgtgacatgaatcatatctgtattgaaaatagacatacgatgactaattttgttctaaatgaagaatgttttcttatggaattattgtaagaattaaatggaaaaaaatgtatgtgaagtacttagcagttagcatttagtgttagctactattatcaacaattccctaaaacctgctagggttacagtaaccatggcaacacaaactctattttatttagtaatatatttatttgctaattgacaaacaaaattgtatttgttcactatatataatatattgttttgaagtctatatacattatggaatgactaggtctaggtaactaacatatgcactgcctcgtatagttatcatttttgtggatattttgcattcattctcttagcattgtttaagaatacaatatatggctaactatagtctctgtgttgtatgatagacgtctttaacttcctcctatctaattgaaatttcgtattctttgaccaatatcttcccaaccaccatccaccaactaccccagcccctggtaactaccattctattctctacttatatgagatcaactttttaagattccatttatgagggcaatcatgcaatatttgtctttgttcctttggttggtttgtttcacttaacataaggtcctccaggttcatccatgttgtcacaaataacaagatttcctcctttttcatggctgaatatagtattccactgtgtatacatacagcattttctttatccattcacccatcaatggatacttagattgattccatctcagctgttgtgaataatgctgcagcgaacgtgagaatgtagatatctctttgacatacagatttcatttcctttggatatatactcagtagtgagattgctggatcacttaggagttctgtttcattaatttttttttttttgaggaacctccatactgttttaaatactggctagtttacattatcaccaacatcaggcaagttctcctttctttacatcctcaccaacacttgttctcttttgtctttttgacgttctgagaagtatgaggtcatgtcacattgtagttttaatttgtctttccctaatgattagtgatgttgagcattttttcatatagctattgaccattttgtatatcttgtttagagaaatttagagtcatggctcatttttaaattgagctatttgttattctttgtttgttctgccattgagttgtttgagttccttgtttattttggatataaaccccttatcagatgtgtagtttgcaaatattttctttcccccattctgtaggttttctctttactctgttgattgtttcctttgctgtagaacagctttctattttgatgcagtcctatttgtctatctttgcttttgtcgcctgtgcttttgaagttatatccaaaaatcgttgctcagaaaaatgtcatgtagcttttttttctatggtttttcaacgagtttcacagtttggggtcttatatttcagtttttaatccattttaagcagatttttatatatggtgtgagataaggatctaattttattattctatatgtgggtatccagttttcccagcaccatatattaaagagactctcctttctccatggtgtgttcatagtacctttgttgaatattattagttataagtgcataaatttatttctggagttcctatcttgtctcattgttctacacgtctgtttttatgccagtgttgtgatgttttggttactatagctatgtagtatattttgaaatcagggagtgtgatgcttccagttttgttctttttgctcaatatcacacactcctttctaaacctcatcatcgtttagggtatataatacaattaataaatgcatatataattatatgtcttttcaaataattgataacctaaacttgataaccaatcatagttttacatactaactggcagttcctttctatcttgccctgaatcttattttatagacatacatttccaggatgttacatgagccttcagtttagctcatcaatactcagctatccaaaattcctcattgccttgcagcagtttttcccaataccagggccatgttcttagctggctttgaaaaatgttttgaagaggcatcttctccagaaatcttttgagactgatctccccaaatatgaatggtgctaggattattttactaataattgaaccttctaatgcttttctctttgttattgatttcttttgtggcattaatttttaaagtgcttgatttcccagttgattatttgctatattaatcatatgtctttcaaggtcttggctttgttaatactgtcttaactgactacagaatgaagacttctaactttcaggtaaggattccgcgttttttattcaggacaggtccaaaaaatggcaagataacagcaaggggattcatttgcctgcaggcagtttggttaaaattctcccttagttctcatatacacattataatttgcattttaattttactgtcttcacaaccacgaaagcatatttaggtaaaagtgctaattagatctttgtaaacaaccatatgttattttggtttatgaaatttaaagagcaattaaaaacacatatatttactacttataggtgggagtgggaatgactttaatctgaaaagtgtaagtgaatctgaggaaaaagctaaattagagatgtgttgaatgatcttttggaagaaactaaaagaaatttgaaacttttcttcagaaaaccatagggccacacaatgctacacattgagcctcaccataattaaatcaaaatacttgaaaattatatttcaaacctcttttcaactactgtacttaccttagagaaatcttcaaaagaaatctgtggtatgtttattgttaatgaaagcatgtcattctttctctggtgacttatccgtctttatcagtttcactgtgaagagcagagtgatatatgagtgtgataacttaagatgacatcttatagtgcaatccattatctgaaagatttaaggaaaaagctctctgaaaaaacataattaagaaaataaatgtttttagaaatataataaagatcttttatggttttggttcaggaacatccatttctataatatgatacactaaggaaatagtctgccaatcatctaaataacacttgtattttgatttttattggtttggcttctccacaaagaaactaacaaatcattaacaaggattaagaacaaaaaagtgtctaaagtttttttagaaatggattgaggaagtagattaaaaggagactcagagaaaagagactgttttctaaaaatatggccacgttgtaaatgtgtgtttattttctcaccaataaaaataggcaatatgttgtttattgcctggatagttggacttgacttggtttttggctcctgatttttggtctgagtctaatgaaccaataaaaatctcttgatgtgccacataagtaactcccacttgaccccattccaggagctaaagaatctcatggcttcaacaaattctcctgaaccttgctttggaattatattgtttatttgtaatagttattttctctttgccttagttgatttaagaagtctagtatcacgtcaggatcataatatatagatacagaactccttaaaaataaaccccaaatctaaaatcaggattgaaaaaaggacagaagtgaaatcaaccaaagtaaatgtttaaaatatgcattcttagctgtgcttattcaaattggtcaactctgaatatcttcgtttctttttttttttaattccactggttacagattccaaatttcatccattccttcttgccttaaactgtgatctgtaacctgtgccttcactcaaattaccatttcagctcttttacaaacatcaaatagcaaagggcaatatggatattttattagacttgcacagatcagaaacaaaaaatgtgcacacaggttcaggggactatgtgcagcatttctgtaaggaaatagtgggtgtgaggtatagagagaaaactttcccatcatcaagttcctggacactatggtactgcacttgtcccactataattcctttaaagtatagcgactacttttcacctttgtaataactacggtacttctaaagggccactacaatagcaatgagaatatcatctgtttttcttggaggtggtagttttcatcaagcatatcaagacatatgagaagatggtatttaaaatattcagccaacaatatgtcctgggcatggaccagaatgaacactggccgaagtgctaaagcaatatattggggccccggctgtttctgagatgtggggacttttgtgaggtctaccctagtgtacacccggagtagattcaggaaacctaagccgttgatgtttaccagttatacaaaagtatttcaatacctgaactgctgtggctataccagggcatgttcactaaatatcagccatggactttgcaaatttaagcaagcagacataaaaataagtcatacagtcattctgatgttcttgccattgcacatgctctctctctctctgtctccctctctatatataatttattatacaatacattataataaatagtatgtataataaatagcataaactaatacctacaaaatatataataacatattagtcatattagacatattcttatacccaattaaatttttattaatagaatagacataaggctggagtgcaattaatgcaaaattaatatatacgttatataactcatgtataaagacagaatatttaacattagaatattttgttattcttgtttggcattgctttcaaagtccatttctgttccacataaagaaattcatttcaggttttcatagtcgtaacccacatatttgaaaggggaagtttcatgtgtatgagatcatagaccaaagagcatatttgtaaccatcattggttgtttttgtctgtttcatttagtttttatagaaatagaacggatttggaagcttactgtaaacactgtgaaatggtgaagacttaagaagcttttcttaaatctctaaactgctgagagcgtcctagtatgacaaaatggtgccgtcctttagtacttaaataaatatcattcttcctgaaacactacagttaaactcagtgggtcacttttgtgctttggggtgtaagaccccaaatattaacctgaggaacctaaaagcacaccagaactttctgaaactttttcccccatgctagatggggtttggtctaggagaaaagttttgcttctcttcccagtgggtcttgttttagaactctctaaagcaatgagcttctctggtttatcttccatcttgtttattgtacctagtctctgacatgcagaaatgacttaataaaggttttctgaattcgtgaaattcacctcctgaaaattaccaccttatgatctgaaaaaactatctgctcaacagaaagttactcatatatctgcttctatagatacagtagtctcccttacccatggtttagctttctgtactttcagttaactgcagccaactgtggtctgaaactatcacagtattttgcaagagagagagagagagagactacattcatgtaaattttattacagaaaacatggcatatatgggacttagtgctatctgtggtttcagcatccactggggtcttggaatgtgtcacccatggataaagggggaattactctgctagatttggtaaaaaggcagactagtggagagatcttctgaaaaaaggagataggaaatgttactgaagagaaatagaaaatattgtattaatttattaaaagtaaaggttattagaaggtattaaatttttgatataatgtaggtgacagtgtgagtggggaaagacctgtaagtgcaacaaggggatgaaattccctatcttctagccatactccagtacataaacggcttaaaaataatgtatatcaaagcaatgtaataaaggattaccgtgatgaattttatgagattaagctgcagttaatttccttatgcatttaagattaataaactgctaattagaatatgcaaataagggtttctgaagcctaaaatatattccctagcatcttacccataaatcttattcagtaactattttgttatataattggggaataacagattgatgagccaatctaattatgtgaaatttacatgtgtatggtattttataataaaggacatgaactaatgttaaagtagtggaaagtagttgtaacattcattatagttattaattacaaaatttaacttagtttgaaagtactttgtgccatataagctatcagccacaccaagtactcttactacacatctggtgcataattgtcgggtgagactgagcccatcagcaattacagcaattattgggactcttacatttacagctcacacacatcacacccaagcacacgtttctggaatattgctgatcatccagggacctagataacaactaattgcctcattatgcaaagtggggaaagatattcgtatttcttacatcttctgttctacattatacacatagagatgcctgtttgacagcaagcaacagataaaagaatattagaattatttttgtgcccagttaaggttttttgggtttggcttcgactttttcataaagaaagcatcttcatgaggctggaggacataaagcaatttgaaagctattatgggtaaaaaacatctaaagggtttacacacacacaaacacgatgaaggaattaggaagggctctaatgatcctactatttactactttggcaagataccaaatggaataagaattaaaattctattgaaaattaattcaactgagtggacagaatgctatgaagtattcggggcattttctttcatataatatataacatttactaatatgttcaagtaacaaaagttacctttatacagttcacctgtactctgtgtatttgtccaacattcccatgaaggacaaatgtaattaatcccaatttaaacaggtaaaaaatgaaactttgatatatgcaaactgcaatttgtaatcaatagtgagaaaatggaaactgcagcctttgcaatccagttctgtgttctttatacctgtgtattgccagatctatgtgtgtaaataaaattcaacaaagaaatacctgataagataagttttgtgggcatttatagcacacttagtgaaaatatataatatcaccaagcccgccatattagaccacttttaccttatttttcttactttaatcaatatttcattaaatttgacttaactttatgtgtaaagatactggtatgaacaacaattaccttgtccatattattatctcttccagctttttcagagcagtttgaacaaatgaataaaaacttgagaaacataaaagatgcctaactaatacatatggcacatgcattataatattaaaagggaagaattctcaacttgttatgtacacactcaagcttttttttttttttttgagtattcaattagcagaataaccctacagaatccgtcaatatcctgtcttcactgtgaacagaatagaaaattcctcttcttttttttttaatgactgccaaaatctagggcacttggtgttgatgcatgactaattactaatgtttcaacagagtaagtcagattcaaattgtaaaggcacacaagtgaatttaaaacctactttttcattctttgataatttctctaccaatggaggataagaagagatgatgccggtttgaaattcctgacaaaaacttaaaactgcttttaccctgtctggtatactattattttattctaactgtgagaaaagtagtaatgagatcatcctatttcaactaccgtgactttaaagagaacatgacagatacaatttttcaacaaattaggctgttttctgaaatactaacaaagtttgccttttcagaataaaatgttacaagagctgcttctggccctaatgtgcccttatcagcgtgtgtgtttttaatgtggttaaggtttaacattcattccagcttcacctatagcttgttggtatgctttatcaccatggattttaaacacactgaagaaaataatttctacccccaaaattattaaagcccctacaaggaactttacactttcaaaaaaataattattttcaaatataaacacctctttatatcttgacttttagatccctataaaagccaataagacaaatttgattcaatgggaattctttgtactggcaaaaaatattacatgaacgataatataggagaccctctgttatgtaaaattacgctatttattactttagcaagttccaatagaataatcgttgatggccctgaggtgtcacatgatcctgaattacttaattgttacatatattcaggaaaataataatgttaactgcatcatgctctagtctaagcttcaagaaattggtaatacaaatattctatataatctagcattctacctaaatatttgatcatttgtgacaactacattgaatgagagtttaccatacttttttaacaaaagaaaaaatatagcttagttagctattgatgagacctactagaagaaattaaaactcatatcttatgatttatcacaaagcatttgagcacaaagcatttgaatttgatgttaattcaccttggctgtgactcactgagaattctgggttttacagatgggtagatcacttccttttcatgtagctttttttaatattgttgacataagagaatctgaagtatcatttcttcacatcctatttcacctgtcattgtcatctcaaaaatctattttctcttgcataaaacctcagtgtttaaagctataaaagcaaacacagcagtgaggaaattttcccctgggtctatttgccatatgctttaaaacagaactatttgaacaccaaaatcagcattcctgaacttgcgtatagagacgtttgttttcttttcccacctgcataagggtaaagaattcaggcttgcagaatatcctttgaattctaaaaccttgctgaaaaatcatttttatactgcagagtgatgactcttgctaccttcttatgattggaagggtttccaagagaaacaagatggacttgacttctcttggaaatataactcagagtgtttgagagatttagaagttattcttctgttactttctagatattcacttttaattataagtaaaatatgtttcagatccaaacaatggtgacttcattcattcattcattcaaaaaatgagtgtattatgttttcactgtgtttccttcacagatattcttggcacatcagataacacagtgaaaaaaaaacagatgacaaatcgtcaccttctaaagcttatattctacagggggaataaaaaaacagaaacgtatacatacacgcatgcatatacacacacataaatttaatagcatgacagatggtaatactgctatggaaaaaataaagcaagaaaaaggaatagtgagtttaggatgaggtttggagggttaaaatttgaacagaaatttgaaggagatgagagtacagatatcatgctatctgtggggaagattgctccaggttctaggactagcaggtataaaaggaatttgctggggaagagcacggaggaccatgtgtccagaaagagaagttaagtaaccaggagtgaggggcagacttattgaggctgtgtgcaattaaaggggatgttgactttaagtgagagggagggccattagtggcatttgagcagagcaatgaaatattctacttaaaaaaaataataagctaactttagctgctatacacaaggaagcagaggtgccacttaggagattattgagtattttaggaagagatgagagtgtctcagacctgggtgatagtgatataggtgatgagaatcagacagattctggatatagtctgaagtttgagacatttggcttttgtattcaatatgaaatatgacagaaaggatgagttgaaggtatttgatttgagcaaggaagaagttgcatttattaagatacaaaagaatgcagaaaaagaaggcttgggggaaatgtcagaagttagctctagactcttgaagttttaaattcaaaataaatatccaagtgagtactactcaatctattgagtagatgattgcatatctaagtttgaatttcagagaagaggtgtatactataaatatatatgtggattttgtcagtgtggaattggtatttaaatccaggggtccaattaaaatcaccaagagagtaatgtagatagagaatgggagatgtttgaagactgagccttgggatatccaagactcatagtttgtagagatgagaaaaaccacaaaagaagactgagaaggaacagccagttaagtaagagtaaaatcagaagagtttaggctgtcctggaaggaggactgatgtttctgctaaagtgatgcaatgatattgcaaatgtaatatacttgaaagacaccaagaggagaggtattggaggcagtacatttttgcttaacaaaaaagcaagggaaaaggacagtagatagagagggatagtgtaaaaaaaaaaagctgtataatttttaaagagagggttattaatgggtacaaatttacaattagctagaactgtaaataagacccattcaatagctcagaagggtgactacagttaacatttatctattgtatatttcaaaataggtaggagagaataaatcaaatgttactagtataaataaaagataaatatttaaggcaatggatattctgattaacctgatttgacctttagagattatatacatgtatcaaattatcacttgtatcccaaaaatatgaacaactattatctatcaatttaaaaagttggctaaaatagcagtacttttgttggaatgaattcatagaaaaataaatgataatgtatgtgaatgaagaatttctggagaattaaatttctgcaagtaatgatggaatatagtatacaaatgggtgcattgccttgtatacaagtaaggatagtttatccagagtgataggagaggtctatgggctcattcacaggtcagtctgtgaatattgtgatgaaggctttgggatattttttctgattcttttattttcttaatgaagtaagaagctgagaatgagaaagtgtagaagcttaagaaggaaatgttaggcaatagtaatcaaggaaaagaaggagagtgaatgaaatagatgtcagtagtagaagggcagatggcaacagaggctcacatgggtttaagggtcatgaagaccatgcttcatattgttaatgtttttctagagccatatttgaccatgggtaggaggagtaatttaaccattgtatagagattctccaactgtatataaggcagcaacagagtagcaaacacaagtaaataaatgtaatgaccaattatgggggaggagcaaattaagagcatgaggaagagagagaaggcaaggggcagaatcagtacactgtaagttctaatgctgaagttagggtactaagagtgaactctcaccttctctatgataacatccatatttacataaaatctgtacacaaacattctgatacagtatagcatcttccattttccattgagaatgattctcatccatttgtgctattcccattttgcaaggaggaccttcttatgttgggaaattttaatgattataaatgctctgcatataatccctgctgacggaatctatgcttcattgatggatgaatgtactcaatcatgatgcggaagagggctacatggtaccttccaccaacagctactttttctattcctctctctctctctttaaatattttgcctttaaaaaatatatcttcttaccatttgacgcattcctgggaaggctgttcttatcagcagacattgctggaaataaagagagaaattgtagaaggaagaccagttattaaagaacaaaatgtcgatagccccaaagagaggtttaattttaaaaagcaaagctaaaaatagcaaaaatagaaaaaacacaaacaacaaaacctctaaaactctgaaatgcgtgaaagagtacttttcaaatgcaagcatgcatgctaacttcacatttccacccctacttatctctcccacacttgagcctcacagctcacatagccgcctttctcctgagtatgacagctcaactcccagaacagcctatcaggtcacaaaccataactgatcatttttgtgtgcttcttagattctgtttgcctggaagcagcttttcttttaacattatttttctcctacagatggaaatggaagagaggagaataaaaattcaagtctaagactgagaggttccataccagcgagcctggcaccaggttgagcatgtatcatagggaaaagttagagaccacacaagcctctgtggttatactatgctgcagagaagagggcaaattaaactggaggtccaccttacaagaattttgtgaacagctgaatgttataactgttatgaatacctgcatcacctaacttaaccacatgaaactcactcgtgaattccctactgtacacatgtcagcattctgaggttttagtgattttcttaaacaccagaatactaccaaggggtcactcaaaatgcagtgctgggaatgttgtaagaaacagttattccccttatttaaccaaattttctgtcacaagctgcataattccaagtttctggatcttatttaacccttggggaaaaaccagtccttgaattaaaattaaatataacattattcctgaagtattacaggattttttttttatttcttgaaagcggagtattcataattactacttttttttttttttttgagacagcgtcttgccctgttgcccaggctgaagttcagtggcacaatctcagctcactgcaagctccacctccctggttcaagtgattttcctgtgccagtcccctgagtagctgggattacagttacgcaccaccaagcccagttaattttttgatttttagtggagacagggtttcaccaagttggccaggcttgtttgaactcctgacctcaagtgatcctcccacctcagcctcccaaagtgctgggattacaggcgtgagccactatgcccggtctcataattactttgatctccctctcatataattaaagaaatcattctatcatcttttctatcacgttattctctttacacatttgtccgatttctttctgctcctctgtagtgacagttttaaaatcttcatttgttattgcgttattatatactgatcaaaacaccaaaatatactttgtgctaaacatttcattgtgcactatggatgattacaaaatcaagtaaaaacacagcttcagctctgaaggtatgatacagataaataccactgtgaaaattttgtgtgattaaagataagtgagattattgaagaaagtaggttttcctagagtcaggatttgaagtaggggttattcacagaaagaataaaaaaaaaatttcaaattgcaggagacagtatgcagaaaagctggatttgaccccgatgacttgtccccatcccttttatttcagcaatattttcctttcaactaaagcaccaatgcaaattataccagttttttctctctgtagattgtgtggcttgaggaactacggtgtaggaaccaatcagtgccaagcctccctccccaaattccgcctccagtctcccttccttcctttcttcctcattgtctacagagggtgcccagaaaagaatcttattgcctccttttccaatgatttacaggataaattccagatccttagcatggcccacacttttctctgtgttgtggccctgtttcactaacgttaccttgctcggctggcagtttcatttctccaaaatgacttttttccctgtccaccaggcaaactgcctaatatttcaagacgtaactctgataccaccttctatacaaagtcttcccttaggcaaaatgtctaatcttttctctacttctttaaaaccaaacaggtttctttcattttattgcatttctgtgtagctttcctctgagatttttgaagtcaggggctcttcactcagcattacatcaatacatcattaccgaccaatgactatatctcagacattgtaccaggcatttacgatgatggtgaccacaatcatacatagactcttgcttcatgaagtttatcgagtaacaaaaaaggtatccacaaataattacacaaataattaatcttaatatatcataaaggaaaattacacagcaatatgaaaacagatcaaggagagcaaatagattctggactgttggggtgggaggcaatattaggagtcacagtttttatgtatatatgcttttcttttgataaattagaatcatttataaaacttttaaagtttttctttcaattatcattgtatatttgaataatacaattaatcatccactttgagttgtattgaccttaaattgtgtattttgattctccactgtacagatgaaaaaattatattgtatttgcaatgtaattattgcttattatacttccccctactctgcctcaaaattttggttagttatattattatttcagcttttctagcagttatctttatatagcggtgaacttgtgactggcttttaagtccaaatccaaaataaattttggttgataatttgtgtctgttaatgagtaaaacaaagggaaaacattgaagatgaatgtcagaacttcactcattcatcaaagatataaatgacttaatcatagatcacattaattcaattggattaatttgattaattaattcaattatgattgcttgatcatagattaggttttaagttctgaaaaaagattttctcaattttttgtactattctatatgtaatgactgtaggcacaacacacttttaagtttcatctgtattattaacattttttccgttctctcttcagtttgacagtcaaaaaagcagtaagtcaaaccctgatttgcagcatttgtcaatttccatggtataaatattccctgtgtggcttatttaaagcttccagcctaccctcatggaatgcagagaagagcacagagagataatacatgttatttgaaagactcaatattatcacaatatctactcttcctaacttgatctacagattcaatgcaatccgaatcaaaatctgagtaagctattttatgaatgttgacaaagtgatcaccagcagcataccacaatgtaggatttcccccacacatttgcggtgtcaagagcatagatactagtaaagtgtagtaaaatccgttaacttatttacttgcaaatgtatatgcttaatattttcaataagctttattttattatcagagaagttttaggtttacagcaaaattaagcagaaaatatggagtttccatattccctcatcttcacacatactcagactcccctactatcaacatcccacaccagagtggcttgatttgttacaatcaataaacctacacagacacatcattatcaatccaactccacagtttacattagggttcacccttgctgttgtacatgcgtgggttttgacaaatgtataatgacatgtgtctactactgtagtatcacacagaatgttccactgccctaaaagtcctctgctctggttattcatcattccacttctccagattctgacaactattgatctttttactgtttccatggttttgccttttccagaatgtcatatagtctgaatcatacagtattgccttttcaaattggcttctttcatgtaataatatgcatttaagcttcctttgtgtcttttcaaggctcaatatctcatttcattttagcattgagtaatttgtcattgcaatgtaccacagtttatttatccacttacctactgaaggacatcttgattgcttccactggcaattatgaatgaagttactataaacatccttgcacagacttttgtgtgaacataagttttcacctcctttgggtaaataccaaacaacactattgctgtatcctatggcaagaggaagtacaggtttgtaacacactaccaaaaactatcttccaaagtggccataccattttgcattttcaccaacaataataagagctgtcattgcttcacattcttggcagcatttcgtgttgtcagtgttgcagattttggccattctaataggtgtgcagtagtatctaattgtcattttaatttgcatttctctgatgacatgagcattttttcttatgcttatctgccatctgtatatcttctttaatgaagtagctgttaagatacggaccatttttaattgagttgttttcttattattgtgttttaagagggcttttttcggtatagtttggatgacactcctctatcagatgtcttttgcgtaccttttcctctagtctttgacttgtctttttattctcttgacatgctccttcacagagcagaaaatttaattttaatgaagtctagcttgccattttttccctaaagtgtgccttagatgttgtatctaaaaagccattctgacaccataggtcgtctagattttctcccttgtcatttctaggagttttatagtttagcattttacatttaggtctataattcattttgagttcattgttgtgaggggttcaaggtgtatgtctagattatttatttagttagttagttattttgcttgtggatatccagttgttccagcctcctttgttgaagaaaactatcttttcttcattttagttccttcgtcaagatcacttggctatatttacacagatgtattcctgggttctttgttctgttcagctaatctatttgtctaatcttttgccaacaccacactgtcttattactttagttttatagtaagtttaaacttggatagtgtcagtcctccaactttagtcttctttaatattcttggctattttgggtatgttgcccctttacataatctttaaagatcactttgtcaacattcacaaaatagcttgctcagattttaattgggattgcactgaatctgtagatcaaagtaggaagagtagatattgtgataatattgagtctttcaaacaatacatatcagctgttcatttcgttctttgatttctctcatcagagttttatagttttcctgttatagctcttgtgcatattttgttagtttatttctaggtatatcattttcggggggcgctgatataaatagtattgtgctttgaatttcaaatcttacttatttattgctggtatatggtaaagtgattgactcttgtactttgaccttgtatcttgcaaccttactacaatttcttattaactcagatagtttttttgttgttgttgttgattctttcagattttctacatagacaatgatgtcatctgtgaacaagcacacagttttatttcttcctctccaatatgtataccttttcttttattttcttgtcttattgcattagctaggactttcagtacagtattgaaaagcagtggtgagaggggacatccttaccttgttcctgatcttagcaggagaacttcaggtttctaactattaaatacattagccgtagattttttgtgaatatattttatcaagtaggaagctcccctttattactactttattgagcattttgttatgctttgttttttaatcatgagtgggtactggattttgtcaaatgctttttctttatctcttgatatgatcatgtgatttctcttccttaacccattgatatgatggattacattaattgatttttaaatgttgtaccagtcttgcatatctttaataaatcacagttgttcatagtatacagttctttctatacattgctggattggatatgctaatattttgttgaggatttttacatctatattcatgagagataatgatctgtagttttcttttcttataatgtctttgtctggttttggtattcctcaaagtatgagttaggacatattctctctgcttctaccttctagataagattctagagaattgatataaatttcttctttaattacgtggtaaaatttaccaataagttgatctgggcctgctgtttcctgatttagaaggttattaattattgattcagtttctttaatagatacaggcctattcagattgtcaatttattctcatgtgagtttttcaaagaattggcccatttcatctaggtcatcaaaatagtggatttagaatttttcacagaattcatttgttattcctttaatgtccacagaatctgtagtgatggcacctctttcatttctgctagtagtagttgatgccttctctctccttttttgtcagttatcctggcaagaggcttatcaatgttactgatctttttgaagaacctgttttcagttttgttgattttctccatcaatttcctgtttccaattttattactttgtgctctaattttcattacttttttttctttgcctactttggaattaatttactcttctttctttagctttttaaaaaactaaggcagaagtttatatggctgattttagatctttttttctaatatatgcatttagtgttacaatttccctctaagcactcctttcactgcatcccacacattttgataagtttggttttcattttaatttagtgcaaaagatttttaaatttttcttgtaatttattttttctaaataacacatatcttctttagaagtgtgttatgtgatccccaaatattttgaaaatttccaactatctttcttttattgatttctcacttaattctattttggtctgagagcagacactgtatgatttgtattcttttaaatttgtatgtgttattacccagaacgtgatctatcttgttgaatattttatgtgagtctgagagcaatgtgccttttgtggctgttggatgaagtagtttataggtgtcgactgtacctagatgatctagtgtttttgagttcagctatggccttactgattttctgcctgctggatctgttaatttatggatgaagggtatcgaagttgccaactataacagtgggacttaatctaattctctgggcagttctatcaatttttgctttaagtatttttacattctggccggcaccgtggctcatgcctgtaatcccagcactttgggaggccaaggtgggtggatcacgaggtcaggagttcaagaccagcctgaccaacatggtgaatgaaacactgtctgtactgaaaatacaaaaaatagctaggcttggtggtgcatgcctgtaatcccagctactctggagactgaggcaggagaatctcttgaacccgggaggcgaaggttgcagtgagctgagattgtgccactgcactccagcctgggccacagagtgagactccatctcaaaaaaaataaaaaactaaaaaatttttaaaaagtatatttacattctgttgttagaaaacagacatatatattaagaattgttatgacttttggcagggaggattgacccctttatcattatgtaatgctccactttcctgacaaattttcttgctgtgaaatctgctctgtctgaaattaatacagctacttccactttcttttgattcatgttagcatgatctatgtttctctatccatttatttttaatccatatttgtctttacatttaaagtgaatttcatgtacaacacatattgttaggttttggttttttattcagtctgacaatctctgtcttttaattggggaatttagaccattgacatttaaggtaaatatcgatgtagttcaattaatatctataatacttgggtttggttttgattttttgcccttgttctttgttcctgttttcatctttcacacatttgctgctttttgtggttctgaggattttatatgactctatcctctctcttttcttagtgtctcaattatacttctttgtttttacttcttaagtggttgccctagggtttgcaataaatatttgcaactaattcaaatctgctttcaaataactgtcacaggtagtgcaaatactttataataacaaaatattttgaatccctcctccatatacatagagtacattattattattatcatgaacaacctgttgtctgttagataaattaagaataagaaaaataaaagtttttgttgtgtcttcccttaatcattctttagcgctctccctttatgtagatctagtttctgacctatatcatttttgtttcctctgaataacttcatttaacattttttttgcaagtcagatctactggcaacaaatttcctctatctttatttgtctgagaaagtccttatttttccttcacttttgaaggatagttttgcagagtgcagaattccaggttggctgattttttttttctcccaacaccttgaatatttaactctactctcttcttgcttgcatggtctctgaggagatgtcagacgtaattttataagtgaagtgtttttccctccctctggcttatttcaaaattttttctttatctgatttaatgaggtttgaatatgatgtgcctaagcatagtttttaaattttcattttttggcatttatcctgcttggtttcctttgagcttcctatttctgtagtttgatgtctgcaatagtgactgagaatttttccaaattaatgtgtggtttggaagtttctgttatcacgtcctcacactcagagattctctcttcaaccacattcagtctactaattaaatgtcagtcaccaaagccattcttcatttctgttaacagcgtttttattccttagcatttcttttttgttctttcttagaatagccatctctcagctgacattgtttattcgctctgacatgtcttttttttcctattaaagccttctagcatattaattatactttaaaaaaattccttttctgataattccaacgtccctaccatatctgactctggttctgatgctaattcgatcgatctcgccaactgtggttttttgtttgttgcctttattaatgcagcgataagtcatgaggatgattttctgataatttcaacatccctaccatatctgactctggttctgatgctaattcagtctccaactatggtttttgtttttttgcctttattaatatagtgatacgttgtgggggagcggggaagcattctatgattaggtctcagtcttttggtgagcttgtgcctctgggctatggacttcacaagtttccgccaacccctttacgtggcacagggtgactggaggagaccacagctgtgcatttcccctcccctaggtaagtgaggctctgatacaacctcagaagattcagctctggtaaaatagtttctcctctgggtaggccttgttaagaagaacggaaggctgtgatgtatttcaaaatggtaacatttcctttctccctactagaagcaaaagggactcttttccaatatttactgtgagaagctggcagactcctggagaggaaacttgtagaagtgtgaggaccccctatgactgagtgccctggagttttcatctttcaagcttgtccacactcaacctccagaagttcgttaattacagtttagggtttcctaccctggtactggctcataatgagttttctgctcatggatttctgtttggttattaagttgtaattttccgtgtccacctgtctatctctccaatgttgccctgtggtttgctctatgagtacccttctctgatagattcaagaagagttgtaatttttcattttgctcagatttttacttattgttaggccagactgaagatacctaatctccttacatgccagatcagaaatcaggagtttatactttatttttcagttatggctttatttaacaactggtttgcaaatttcctgaaaatttaacagttgcctcttgtgagtttggggtgggaaagagaaggggctccaacacaccactacctttataccattacatcacatatttaaacatctattattgatagatttgttttaaaataatgtcagttaccaactgtctattaaatatgaaaaaaaatcatttcttctttcttcttcccccatccacacttaagcttttcatttcactgctacattttattatttaagtccaaatgacaggacttttttttaagacatggtcttgctctattgtcaagtctagagtgcagtagcacagtcatgctcactgctgtcctgaaccccaggctcaagtgatttccccacctcagcctcccagttatctggggctagaggtgtgcaccaccacactcagctaatttttgtatcttattttgcagatatggggttttgccatgttacccaggctggtcgtgagctcctgggctcaagcagtaccctgcctcagcctcctaaaatgctgggattgctggtgtgagcacattattgaataatatcagaaatactaaccaaaataattagaaaaagtaaataaataaataaataccttagaggaaaaaatcaacaacaacctttcaagtgaaggagtgggacagatctttctaagaaggaaacagaaatcagacattataaagcaaagattgaccaatagaactaaagaagaacttgataaatttgactacatgtaaacactaattcatatgagaggaaaaggggtagtagtgcccttaatacatgcttataacttaatgtttagattataacgatttaaaaaaagaataaatatatataaagggttatctaggtgacttaagcaagctgaacgggttggagttcatgcctcatccccactaaaattctattaaaaaaaaaaaaaaacgctttttaaaagatggctttcataaaaaggaatgagttcatgtcctttgcagggacatggatgaagctggaaaccatcattctcagcaaactaacacaggagcagaaaaccaaacaccacatgctctcactcataagtgggagttggacaatgagaacacatggacacagggaagggaacattacacaccggggcctgtcgtggggtggggggcaaggggagagatagcattaggagaaatacctaatgtagatgacgggttgatgggtgcagcaaaccatcatggcatgtgtatacctatgtaacaaacctgcacgttctgcacatgtaccccagaacttaaaatataataaataaataaataaaaagatggctttaatattacagaaaaatcacgaaggtagtttttcattttatttttaattttgtattgatgtgaaagtcacaaaatataacattaaccattttaaaatgaacaattctggggcaattagtgcacgtatcatgttgtgcaataaccaaaactgtctagtcctaaacatttcatcactccccccaaaatttctagacccagcaagcagttactccccactcccagctccttcagttcccagcaactgtcagtctgtcttcctctctctgaatttacctattctgaatattttatataaatggaatcacacaatatgtggctttttatatctggcttcttgtacttagcataatgtttttgaggttcatccacccactcttcttaatggcttttcaagttctcacactgacaatgtggaaaatgtattattttcctgctttattcatagcctttctttgcttttcactctctgttggtaatgaccagaatcatacctagtcctaagtggggctgaaatttttcccttcgaaggctttttctttcagttccctagttgtattaaaaaagtaaacgtagatatgtagagtaggtactgatatcagtaaggatatgatgctataatttaccatggattaaaatgattcagaaaaattacccagggttaagtatgaattattaacatttagtgaaatacagcttggggccaccagtgcactgttccaggagggctgttcacatggaggcccacagtcatagaaggtgacccaggtgcgtgtaactgcaccagtccattcccctcatgattacaactattttactttattcaactaaattttatacctatccacttcaaattcattcccagaaattgtactcaccatttgccacttttattctcagaaggtaagaagtttaaaagccacaaaacgtatgcctaaaagatgaaagaatggagtcacagtatgagtgctaaattgaagaaatatcagaaggaagaaatgaaatcacaagtaaagtgattgaaacttggaaacttattggtgttttatgaggagacacaattgctcccacagtgctatactgaagaaagtgccagcctccaaatgaaaagctgatataagagtggtgtgaaaccagtgttaagtattttgcctggaagaaattgcttagaatgagagcagtccctaaactccttagtatcatttagtatgtttacttataactattactcatcatttggcccgctgggtctccttttgtactggaacagccctgccaagggactccctgtcgtggactaattctggagagtggaacaccgctgggcagggggtctctgtgctgtgaaatctgaagctaagaggatggatggcatttagttgagtgcattcctccacggatgctcatttaatttttaaaaatgtctctgaactgctgggacggttcttcctggattttttgtagttctcttcagttacacacataactccttagagatgcattttgctagtgaggtctttcaatatgtcaggctcttttcatttaagcttagacattttagatgttggaccattgtagctgaatatttctcttcccttgccttcatgtaaaatgaccctagtgtaaagtataaacctggtttgtttgcaaggaaaatgcactcttcagtttcatgtttctgggtgaaggagtctgtcaaagtgctgcctgtcattactgataactgcagtaggtcagtttgctttactgtaacattaatttatcatgtgacttgtatcatgtaagtgtaagaatacagccaataaaagccataaaaataagtcaactgctaagagatatttcaatttttttagaaattcgctgggtgacttgtcattgatacattttattaaattacatatccaaacagagtatactgtgaagatcaggcgagaaatttgtcttctaacggcttttttcataatttccattaatccatattgtatttggtttcttactggaggctattttaagtagtcttttatcagaatcagagattttatactaatcctaccttttagttatgagcatttagaatattcgttaacaggagttgtaagttctcccaactaaacagacgtggtatattcagtttaacacagagcacatatcagaaaacttcattctagttataaggccgaacttcccttaaacctcaatatcatttgatcctcaaactaaaatcttttgagactaccagctatgctatgctttcattacggtgcggaaggaaccctgttagagacacagtatacctaagttttgggtccagctctctctaactgcctgcatgaatataagcttgttattgaacctgtttccttaactgagggaaaaaggatttgaagtagaacagtagttcttaaccaggagaccatcaaatcactttggttggttttttttttttttttttttttccgaaatatacttgtccatatctctctggcatccttcaaccccattctgatgtaatgaagctggggtggttaatttccagttaagtttgtcttggagagatgacatctctcgtcggatccacctctacaagatatgactctgaaatcacaagagctggggttgcagaatttgcagcagcaattgtatcaatggcatcaatattcttataaaaagtgtttatatctagttctagcaatgaaagtcttgaacagactttctgattaaaatcagaaaaaaatacaactttctgattaaaataaatgggttagctgtttcccaatctgttatgacaacaaacctatttctggaccaaaaatcttgatgtgtaatgtaatgtaagatatggtcccacatatgtttcagtaagaataaagaatatttaaaagtatagtggtcctcactagacttcttctcggtgggaaaattgtacagaatgcgagttctgtaacctctgcttcctttagtaaccccacctgagagccagaagaccaacagttcagaccagaaaaagtaatagaagcagaacttccggaggcttgcagatggagtgttaattggtgatctgaaaaaaagtgcttcatctctcttgtcgttaatgtttgggtctgcaggaaaggctgacttcatgaacatgtggcctgtgtagccacagagggccccaagttcagaaaggcctcgtgctgttgtaatgctctgctgtgatggtcttgaaatccttaatgtttttaaacaagggtcctgcattttcattttgtactgggctttgcaaattaggtagttagtcctgcttgtagcaatgaaactaacaccccctgccccggtaaaaccaagcagttcctatcatttttctgcttctttacttttgcctttaaggatcacttgttatttacattgttcaagcaatggtaagaagtgtcactttccctggctgcctcccacacttgaggcgcatagcaagcctgtcctcttcagttctgatgacctgcccattctaaccactgcgcctgtttcctgaacccttctccatacaccaaccacattaccaacctccccttcccatcgagagaagacgatttgcttcttaattcccagatcactctaattagaacactgcaaaaactgacaactaaagcaagtggccacctactagttctcacacactggactctctaacagtaatgaatttctgtgattatttccttgctactaataaaatactagctggaaaagtggtcaagtgaggagccaccagaattttatttcttcttcaagcatttaatagccaactatagggccctgggcatttactgaaaggcaatttcagttatgttagtaaattgctgtttaggacaacagatcaataaaataaattattaggtctataatttaggtatttacagagtaaggacaaaaaatactttttcactctgtgtattcaaagcagttgatccatgatttttggatacataatagctgtatgtatttatgagatacacgtgatattttgttacatgcatagagggtataatgatcaagtcagagtatttagggtgtctgtcatctggagtatacatcatttctatgtgttgggaacatttcaagttctctcttcttgctgttttgaaatatacatttttgttaactgtagtcaccctactgtgctactgaatattagcatttattccttctacctaaatgtatgtttgcactctttacccaacttctcttcgtctcgctcccccatgcacacacccttcccagcctctggtaaccattattctactctctacctccatgaggtcgatttttcagctcccacatatgagtgagaacatgcaatatttgtctttccatgcctggcatatttcttttaagataataactccagttccatccatgttgctgtaaatgacataatttcattcttttttattgccaaatattaggttggcacagcagtaattgcggtttttgcaatgataatagtattccattgtgtacatacacaacttttttgctgtttttctcaatgactctagagaaacatttattcgctaatacattttctttgtgttctctaacttaatgtcatcttttcatctcgcttgattttcatgcagctaaatcggaaatttgtcgttttctccctaaaaaaatacaataaagttctttcttataaattatattctctgattttcttgtcagcctgcttcaagaaaatccatgtgtgcaaaatacttgctatcagtttgccccataccaaatggctgtttaatccaaatatctgaccagcaaaccaagcaattccttctgaagaaagggtggttggacagccaaagccactgggtagtggaagagaagaccacccatcctgagctccccagtctagtgtgaggggaggacagctgatagctggagatgcagcatttccagatgtcactggtcccaaaccattatcagagtaacactggcctcatagaatgagttagggataattccctcttcttcagtctttggacggtattttcgaggagagctcttgtccgttctttgaaagtttgttagaattcaacattgaaaccattcagttttggactttgctctgttgggagactttttttactgattcaatctcactgctcattattggttcgttcaggctttttatttcttgctgattcaatcttgataggttgtgtccagaattttagacatgttctctaggtttttggtttgttagtgtatagtttttcataatggtctttaattatgtttttatttttgtagtgtcagttgtaatgtctcttttctatttctcatttttttatttgggtcttctttatttcttggcttgtctagctaacagtttattgatttcatcttttaaaaaaccaacttttcattttgttgatcctttgtatttttttaagtctctgtttcgtttagttctactctaatttttattatgtatttccttctattaattggggctttggattgttcttgtttctctagtttcttgaggtgcattagattgtttattgaaatctttctacttttttttgacataggtgtttatggctataaattttccccttagttttgcttccatagttttggtatactacgttttgacttgcatttgtttcaagatatttcttgatttcttccttaatttcttccttgaatcaatgatcattcaagagcatgttggttaattttcatgtatttctgcagtttttaaagtgtcccttgttactgatttctagttttattccattgtgatctgagaagatacttgatataattttgatttttaaaagtttcttcagacttgttctgtttcctaacatatggtctatcctgggaaatgttccatgtactgatgggaagaaggtgcattctgtagctgctgaatgaagtgttctctagatgtctgttaggtccatttggtcaagtgtgcagtttaaatccttttaatttttttgataattatctgtctagatgatttgtctcatgctgagtgtaaggtgttgaagttcccaactattatcgtattggagtctatctctccctttaaatctaataatatttactttctatatccaggtgttccagtgttaggtgcatatgtgtttagaatttttatatccacttgctgagttgatcctttttcatcatataatgatctttcttgcttctgtttactgtttttgacttaaagtctgtgttttctcatacaagtttagctattccgtttgtttgtgatttccatttacatggaatctcttttttcacctctgctttcagtctgtgtctttataggtgagataaatttcttgtgggtggaagagagttggctcattttttttttgtcttttcagccagtccatatcttttaagtggaaggtttaacctatttacattcaaagttattgttaatatataaaagcttattcctgtcatcttgttaattggtttctagttattttgtaatgtcttttgattctctttctctcctattgtttattatagaaaaccttctgtagtggtaacatttgaggttttttttttttttttccttatttgtgtgtttgctctaccagtgggttttatcctttcatgtggtttttatgatggtagatatcatcctatcacttccaggtataggactccctttagcatttcttataggaccaggctaatggtaatgaattccttccactttcacttgtctgggagtttatttctccttcatttatgaatgacaacttttctgggtatgtaatccttgggtggcattttttttttctttcagcactttcaatatatcatctcattcttcctggcttgaaaggtttctgctgagagattcactgttagtctgataggggttcccttataagtgactagatgcttttctcttgctggttttagaattctctctttgtctttgacttttgacagtttgactataatgtgctgtggagaaggcctttaggaattgtatttgtatgggaacttctaagcttcctgtatctggatgtctaaacctcttcctagactttgaaagttttcagctattattttgttaaataggttttctatcccttttgttttctcttcaccttctacagcacccagaattcaaacatttgatcacctgattgtgttccatatgccacaaggctttgttcattctttttaattttttaaaattatttttgtctggctgggttatttcaaaagaccgctcttaaagttcggaaattctttcttctctttcatctaatatattgttgaagctttcaaatgtattttttatttcatttaaggaattattcagtttcacaatttctgtttggtccttttctgtgatatctatctctttggtaaatttctcattcatattctgaattttttttctgatttctttgtattctcttgcatttcactgagtttccttaatatcaatattttgaattcttttttcaaggatttcataaacttacttttgattagaatatattgccagaaaattcttgtgtttctttgaaagtatccttgtttttccatgtttcttttgtccttacattgacatctatgtatctggtgtaaacatttcttcttccgggtttttgaatttgctttcctaaggaaggactctgttaaagatgaatctgtggtttaggttgggtaggacactttggctttgattctggatgcttgcagtagtgtaatcactgtgtgatttatttggctgtaaatagtatcagtggtgtcagtgatttcctcagtgactgcagtgtctgtgatttcctcagtgatttatgatacagtggaggctgtgatgaagattttctggggacagggacaacaggtgggcctgtcctcaaaccccactggtggccagtcacaggccaaacatgcctttccttgggccccagggcaacatatgctaatatacctgtgttagcaggctcaggcaggccattcttgggcctctaggtggcttgcccaggtgctggtagtggcaatggtgggccaggtgggtgggtaggttatcagacctctgggcagcagcatggaatgggtgatggcagtagcaatagtgagacaatcatctagctctgaagtgatttgcattgtttgttggcattggctacaatgggctgggaaggccagtctccagtcccacctgtggtatgtgtacgtgggtacccagtatggtgattgcattgttgtgggcattggctagaatgagctgggcaggcgtgaactcaggaccacagaaggagtaccctggtgctgatggtggtcaacttgggtaggtggtttccaggcccttggatgtcatgtctggacatagagtgggggagagagccaggactggtggacctgtcctcagacctcccagtggtatgagcaggtgccagttgtggtagacaggggtggagtgatccacatgtccccaaagaaatgtttgagagaaggcagcagctgcaaccctgctactggggaaggcaaggttgctttcagtggcagcagctgtatacatgtgtttagggaacacacattttcttcaagcttgaccctgggaacagcagtcacttgcagtgacagcagctgtgggcaggagagtttgttcatggggcacatgaaaatgcatggcagctttgttcctggggatattggggtcacagtcaatggcttgcacttgaatattggctgcaactagctgccagccatgacatgcattggctgcaggtgaggaatgtcaataggacaccagggatgtggtgatgcaggtaccgttggacctcccaggcaggatggtaggggctaggctttcaatatggtgacttgctgtagctgcctagggcttgggggcagagggtgtgactcagcttgagctctctctggagcaatgccttcacttggtctccttgcagcttcctatgttagtcttggggcccactaggtcctagggactctcctgtgtctaggattgcatgagttcatggtgggaacctggactgttgggggtcactcacttacccttttcctccactggggagccagcctctccaggttctcagccaatgctagccaagcaggcagcctcacttccccttccttttttgttttggttgtgtcctgtcacttatctgttgaattctaatgttctttcataaatgatctattcaaagtgtgatcatctattcactgtttttgttcttctctgtgtaagagacacgtagcagatgcctctagtcagccaccttgcaacccctctgccatgcagttaatacatgattttttctacttttggatggaattagataaggcccaagctaagaactccatacagcccattttgtaatatgatccagacacagagatgcactgttcagatcctcgttcaaaaaacgacccaccgcatagctgagagggatgtggtcagctgatgcctccagctgttagatccttcaggatctgtctcagttttcaaaccaaggttacgctcttctctcagtgatctccaggcaatggccgagcagaatgatggtacaagggccaggtcatcaacatcccctacaggacttctccatcaggttatctttactccagaactcccctttgagctggtaaagaattttagatctgcactgagatctgtcagcttcctatgcccaatcccgcatcttacttttttctttaattggttttacttccaataaaactcttgcaatcctaactccatctcagcatctgtttcccagacaacccaacttgcacaatgtccttacagtaatgcaaaaatgaatttcacagagctctttttgtaaagatgctgatacatgaagtctcaaatttcatggacgtgacataaggaaggcaacagcttgggaagaaaatatgagaaatagcacttagattgggtttattctagaagaaaggacacctcatctaactttctagtagtcctctataaacactgttcctctggactgggcgtttgatacataccgagcagccttgttttcaaggttagagtccctagaaaatagatgatgttcagagacaaacctgtctaggtactgagaactctttctacttgatgtctgattgccatctccaacagattatattttgggatgaattattcatctttagcacataagtaatctttcttattttcttattatctttacaaatcagtgtaatgcccagaaagcccagtgtacaatcaaaattttagttgcttatttttttcttttgctcctttatgtccaactagttactaaattatgtttatgtgtctttgaaatcttttgccttttgcttgtcataagatgcccaaaagatctgtcttttggccaaactccatggcagagataggctacagttgtacaccagtttgtacagtgtacaaaattgtacaccaactttgttttctttttctcctgtgcaagataaccagctggcatcctacaaaacacacatgaattttaaatagaatttgtgaggaggtattgtttctgcatgttggagttcctgtaaattacatttacaactctttattggtatcataatgttgatggagaaatagatctcctaggaatatgtgcactgaccattcaactatccccatagctaacattttggatgcattttaagcttcttagcttagcacataaatcccatcataatttatcctctgtttcccaccatcaccactcctgaaacacagcctcacagactatttactctagctataaccagttataatgcttcatgcttcatatatgctatttatcttttcaagaatcctttcttttttgccttctgcttaaagacaacttctacaagccttcaaacctcagcttaagcattacttcctatgtaaactcttttgtgatctcctaatttgactctttttccctaatgcatttatttccattggatctcttttatacttttatcataacattgactataccgttccctaaatgttgctcttttagaactataatcctatattatttgacttcatatataaatgtgctctaaaaatgttgaatgaatatggtgagttttccactttgatatcttcatgctgtcttttaccccagggcctcaaattagccatcagaacagatggcttataagaactggtatgctaaaaagtaggtttaactgtggttgtggacatgcttctttctcaggggttccatttctgaagtggaaattaatttgatgcttctctagagtgatgttcagattaatgttatgccatttgtaaaggcctctaggactctcagatgaagggcatttgatattagcctcattgttactcgaagctgttgtagggttcatctatttgctactcagcaagacatttgacattctcgtaatacagcacatcccaggattaattaagagatttccggaagtctcaggaatacacctactttgacatcaatgtgctgtgaatgttgatcttggtagccttactttgaatagctatagggtatttaaatagtaacctaacttacaattaagactgcttagtccctgtaaggattctgagtggaatttagcaatggataatgaatatattctccggagtcttatactgaatttgaaaagaaacccaaattcctgagctttagtcacttaactacaacatctttctacataaagaccataagctaagaccatagaagagagagctcatgcatacatgagtacagatggttaccaaagtaaggatctaaaattggactctgctgtactcacatcgaagctcccaatgtacgaagggatgaccttccttcaatggctttatgcaagggtcaaaatgtatttgaactctggagcagaaaagcactgctctataggatttccaagtgttcattatttaggaggtcaggaacgatgggagcatgtggcaatccagacagctgcagtccccacagacctaaaagaaaacagctgccagagcagccatttctatacaaaatgtctcatgaccagaagctatggaaataaacggctagaggcagctgtgcttccctcttgctaaacactcaaagattccatttttaacacaggatgtctattattaagacaatcagctaagatgtcaattcaaaagccacaaagttctgcaacataaatactgtactgacttctctcttctgttgtgtgggaccatggcttctttccctgtatgctggggacactacttcagaataatcaagtgaaaatactgcttttttatggtaactctccattcaagaacttattataatagtgttataaaaagactgtaatcttatcataggctgtatttgaaaattaagatcctccacaatctggctctatcctctttctcaaatcaatttctcattactctcaatacaaatgctatccttcaggtaggtaagactcttcattcttgctccacgtttcttactcacgttccttcaggcaaaaatgccctgtcagacacatgaaaaaaatgctcatcatcgctggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactggttcaaccattgtggaagacagtgtggcaattcctcaaggaggtagaactagaaataccatttgacccagccatcccatgactggacatataccgaaaggattataaatcatactgctgtaaagacacatgcacatgtatgtttattgcggcactattcacaatagcaaagacttggaaccaatccaaatgcccatcaatgatagactggattaagcaaacgtggcacatatacaccgtggaataccacgcagccataaaaaggatgagttcatgtcctttgtagaacatggatgaagctggaaaccatcattctgagcaaactatcgcaaggacaaaaaaccaaacaccgcatgttctcactcataggtgggaattgaacaataagaacacttggacacaggaaggggaacatcacacaccggggcctgtcatggggtggtgggaggagggagggatagcattaggagatatacctaatgtaaatgaccagttaacgggtgcagcacaccaacatggcacatgtatacatatgtaaccaacctgcacgttgtgcacatgtaccctaaaacttaaagtataataataaaaaaatttttaaaaatcccctgtcagtcctctctgcccacccttttgacatttgatggtaaagcccaatctttcctctgcccacattagtcagtgatttctttaaatttcatttataacgatccctaaacctcataattccgcaaccaattacatgctagtacacgtgattctctaatctgtgtattttaatctcatctcctaagaacacggtggcaagatctgtgttatttactttgaggctgcatcccatttttttcttttgtgtttttttaattgaagtgaaatttgcatgtaataaaattcacccttttcagtgtacatttctatgagttctaagaaatgcatgcagttgtataatcaccactacaattaagggatagaacagttcgaacaccctaaatattttccttgtgactttgtagtcaaacctctcccacctgcagccactgataacctgatccatttcctgcctctatagttttccatctatgaaaccatgcagtatataggcctgtgtgtctagatccttttacttagcataatgcatttgtgatcattcatgttttatgtatcagtagtacattcctttgtattttgggtaataattcattgtatggatacacctagcatgtttatacatttaccggttggagaacgtttgggtaatttccaatgtgggaccataaagccactataaacattctcacacagatttttgtttgaacatacgttttcatttcacttggaaaaatgcctgggagtgggattgctggattgtatggtaagtgaatgtttaaattgatgagaaactgctaaactgttttctatggtggtgtagcgttttgtttttagaccagcaatgaatgacagatccagttgctcagcatcttagtcattctaataggtgtatagtggtatcacataatggttttaattagcatttccctaatgactaatgatattgagcatcttttaagtgctcctttatgttctatattttttggttatttcatagtactagcaaagtactaacaatgtattagatgcttaacgaatatttgcagattgttaaattgcagatcattaatactactctcttttgcatgccatttgcatcccattactagctgttaccatttattgagtacctactgtatgccaagcgctgtagtaagtgctttatatatggcatcttattaatacacataagaaccctatgaatgtgctgggtggtattgttcccatttgataaggaaaagggacaaacagtgctgacttgtgactctccaaatccttctctttccccaggaattttgggtttgcttgttcaggttctggaaggtttttatactactgctaaggatgagtgaagaggtaaatttaaataatccaaaacaggctgaaatgatccacatgataaagagataatttagaggttagtggggccatgaggaagaaagggaaaagtacttgggagaggcaagggaagtatagttgtggaggtagaagagagagaaagaggttctttgtttgtgtgtttgtttttgtttcagtttttgttcaaaaaaaaaagacaagagggagcaagaattgtgaagaagactgaggggttagagggatgaagagagtgtttagtatgctaattatgaaatattctctttttggagtttttttgagtgaataagattaaaacaaggtttttagggaaaaggaattggatttttttatattgatactagtataagccatagagcttattaatatttcaacagttatacacacccttacttgtgcacgtgtgtgtgtactcatgtgtatgtatatgtagttttatgcagtttattaaatgtgtagatatgtgtaaccactaatcaagatatttaactgtaccattaccagaagacttcattcttcattgtgctacttatttacagcggaatctacaccctcatcccttacccctggaaaccattaattgttttctccatatctataatgatgttatttcacaaatgctatatttataaaagtatgaagtatgtattcttttaagatttttttcacccagcaaatttttttgaggttcacgcaagatgttgtgtgtatcaagttcttcctttttcttcctgagtagtattccctgatatgcatataccacagtttgattaattgttcacacattaaagaagatttgagtagtttatgttttggactattaataaaactgctataaaccttggtttatcaatttctgcatgaaattaagtcttcctttatctaggacaaatgtccacatgtataattcctggatcacatagtaagtccatttttatttttattttaaaagaaactatcaaactattttacagagtgactgtactattttagattcccatcaggaatgtatgagtgattccgcttatccacatccttgccagcatttgatgttatcactatttttatcctagtcattctgataggtgtgtagtaatattttgttgtggtttccattttaatttctctgatgactaatgatgccaagagagttgtcatgggctaatctgccatctgtatagtctctttgtatacacgtcttttgtccattttctaatttcatgtcttttgcccattttctaattttatggggtttttttagtattgaaattgagaattatttatatgttctagatactagtactgtgtgagatagatgatttgcaaatattttctcccagtctgcaatttgtcttttcacccttaacaggctcttttacagaatactttttttttattttgatgaggtccaatttatcaacttttcttttaatcatctatgatttttggtgttaagtctaagaactctttccttgtcctgtatcttgaagattttctcctatttctttttctagacattttatagttttgtaagctgcgcacttacatctatggtccatttttagttgatttttgtataaggtgcaaggtttagatcaaggttcatttttatttagctagttagctatttgcctataaatcattgcatcgtcatttattgaagacttttcttcctccatcagattgcttttgctctatttaagaaaactaattgggtataattaggtttttatttctgtgagatgcaacttgtaccaacactggtcacaagagagccagttcttactctggttaaatatggatcaggaaactgaaactcagtttaagtaacataatatagcatgtatccacctactacttggctgtcctttttacaaagtttgtaaatgccatgttgaagttaccttgttttctggggtaatacccaaggtttgttgtcttatgtcacagatatcgaggatgcagacacacagagtgaggttaacagtgaacgtttaataagcgaaagaaagataataggtctctgctacagagaacggttctggaaaaatgggttgccagtccacagtgaaatgccaggggctttataggtgagctggtggtgaggcagagtctgatctacatagggcacaaaaaaactggttaggactaagtgtgccattggcatagggcgcaaatttctggcagctcccaccctaagcttttattatgcaggcgagttctctgcctgagctgagccatgttgccaatttctttctttctgtacatgtgctaaccaaaaagggaagatggagcttccatggtggacatgcctggcccccaggtagcccttttctattgacgcagctaccggcatcccccgtgcaagcttccagcttccttatctatgtttgcagctcgatttttcaggctgctgtttgtcaggaaaagaataatttcttgggctgctttttgttagaagggaagttctgccgaggactctgttgccctcactatctgccgaaataatttctttctacattctgtatcagtattgctaggatcatgagttggacagtgtgttacacaattttttagatatcaaagtagtatttatatgctttattaccacagcaaaactaacccggtgctcagcttgaggtgaactttacattgatacctttcccttctctaataaagcaagtagattgggagctacatgcttggcaaatacataacaatcttcttggtatgtttccaaaatattttgacaacaatatcagtggaattcttggagcttatcaccaaaatctgggtgaagtaggcctttctatttctaaagaaaaaaaaaggagagtcaatcacctttcctttaggtcctatggctggtatttaaaaggctgagtaactatgatttaaatgaaatgtcgtatttttaaaacactgaaagctgcagtgactacaggcctggggaggttcactctgatttgctgcccatcagatctgcagaaggcacacactaattcccgaggcgcagcattgtaagacttaacacggccaacactaataattaggcctggttgaaaagtggcagagaaatgctcaatttaccagcagtatcctcacctaatttcatatatattttctaatttgactttgagttaggcagtatcccatttcatggaaatgggaaccagattcagaggagggaaatagcagagtaaaatggcagatctgtatctgactccatagctaatgctccaccttggggttttatttcttccaatttagaatttacggtgagttatagaacttacactgcaacttaagttaatatcaaatcacagaatatttatcctggaagtaactccagggtctcactggagagtcttaatgttaaaatatactttcatactattgatgaaaaaaattttgaggagaatttaaaaaagcaaacagccagacatgggcagggcggggcacatgcttatagttttagctgctcaagaggcggaggtgggaggggtgcttgagtccaggagttcatagtgagttatgatggtgccactgcactccagcctgggcaacagagtgaaaacccgtctcaaatacataaatacatagcaatgtaaaggtagcgcaaatagcctaatttcctctgttttttttttctgaattcactcatattactataatagtaccaattatatactttattatatctaattgtactcatgtcccttgtaactaaataactccttgaaatcaaggataaattcatagtcatctttgtaatcatattgcttgatatagtatctgatgtatgaatgttaacgtcagcatgattaattgtaattaaatgtgcctagccaagttaatttatttattttactttgaccgtggaagcacagttgtattagccatggaatgctgcctcaaatacctttcatatataggtataggtagggtaaaaagctacacagaacattactaaactccagctttcatagtcatttgtatgagcacgtactacacaggcaattaatgtaactgtagctatttttatacatggaaacactcttaagggaaatgatcagtttcttaattaacttgtgatgaaatgcatgatgttgttggaaaatatgtattctgcctggttttaactgactctataatattattaatttattaatatttccagtttttgcataagaatcactagtactttttaaagtgaacctcttacaaaacaaaatatatttcagtctttagagagttaagtcattagacatagcaagttcaaaaagcaggatttgagatcatttttggtaagacctgttttgctgactcttcttgttatgcaaatggcattttctcagttttgtatcctgggtaccatgtaaatggatagagaatgatgagggttgctcactgttggttcctataaaaagtaattactaaaaaacataccacatagccatttacaaatatgactgctaagtttatattgcagagcagcacttcctgagcccaatgtaataatggcttaatctaattacatacacatatgcttgttaacacatgtaagtttccagtacacaataatagtgctctatatctcaagagctttagtattactattgcactgagacataaacactttttaataactgtcctttaaggattttcaaagaaaaaacaatctatgaaaaactctgttaacagggagttcttaggaagaaaataaggaataatgggcataaagagatgctaatattttgtgattgtcttgcagcaaaatgttattaaaagggatagttaaagaggttattatttcacctttgcaaatactaatgggtgctcttgcctccttcattgaacttttagctctccaaaggaattgcagtggtcagtttgttgcagaagctgggtacctaagcactgccaaatgccccacccacagatctctactccaactgcaaacaagcccaggaaggaatgttttttctctctctctcacattcgatacaactgctcaatctacttctctctggtagacatagctccaaaaaccaatgactgattgaacaaattaaagggaatcctgccactagaataaaaattattctaatctggctggtatttttattaattatattcttacataacaatctggcagaatttgagtgaatctgccagcttctgtacacagacctcattgtctctaaatgattcacctaactgccagtggtcataaatacaataataacaacagcaaccaccggagcaaattaaaatgttttacactggtaaacagcgtaactgtttggctgaaactgtcacttaaaatcttaaattatctcactaggtaggggtatgaaatttcaacacaactagggaactaagtctaagctatttaatatttgaataatattaaaaacaagagtaaaatacttaaccatgctgtaatttcccagcattcctcttgtagccacccgcactgtgacttttgcctttctctcttttttcacttccattacctcctctgtaattgaagcatccacctctttatatttccttcaacagacaaggttttattttccatgtcctttaccactactgtgattgaagatttcctactttctctattcccatcattcacatcaaagttaatatgttcccgccttgtaacacacccaccttgtacattttaattaagacaggcactcctgtattctgtgtgttcatcacctgatcttcactcatattcttctctttctgtttttttcttatactcaatgactattttcactcttccccaagattcacgttttataaattccaattttcccaaagcgaagtgacacacatgttccttttgtctaaactgacctgtatgctaatgactcttaatttcattctaagaaaagaagaaaagagaggaaaaagagcatttatggtatacaaactgtataagcatgcccactagacatactgttatgtctgtgggagataagctgttctaaaaataattcctcaaaagcaaatagcagactctgaaggttaatgtaatatgtacagcattcccatttcctttctttctgttgtgttgaggatcaccaaacaagctaatagccctcaagtgtgggatcacgttaaacaaaaacaggacattttgattcatggatgtgccaagttacaaagtttatcctttcaaaagtttaatgctgagtgatatggttaggctttgtgtccccacacaaatctcatcttgaattgtaaccccgtaatccccacgtgtgaaggaagagaccaggtggaggtaattgaatcatggggacagtttcccccatgctgttctcacgatagtaagttctcaggagatccgatggttttataaggggccctccccacttcactaggcacttctccttcctgccgccttgcgaagaaagtacctcgcttccctttcaccttctgccatgatgaggcctccccagccatgctgaactgtgagttagttaaacctctttcctttataaattatcagtgtcaggcagttatttatagcagtatgaaaaaaagactaataccctgggtatcaaggtctttatggttttcatcaggataccaagttctagcccacagcctgtgagttatagggtggcttggtggcttggtcatgatgacaaaccccatcaattcccaaatatgttgaattaattaattaacacattaattcaacaagtatttatgcagtgccttgtctatgctcagcattctgtgagatactgtctggtaaacaaaatacacctaagacatagtgtcttacctgaaatagaatcctagggaattaggtgggcaggcatacctaatctgtaattgagttggtactaaaatcagtgctggtttctatgttgttgttgttgttgttattgtttggggtttgggcttgggttttgggttttcctgtatatttccacttgagtagtaatgttacagtatgtttgtttatttgtcttgtttgtttttggttttggacttggttgacaaaatcagaatatatatgttatgggtttgcagttttcaatcactttttaaccctgttaactttagtctcaagtaaacaaaaaattactgagacttctataaatctaagcaatgtcaggttcagaaaaagggtggcatttgtggtgtatgccttttcactcccctttgctctagtatctcaggctttcctgtgtcctccaggctgacatttagtcccatggaaacaagacttataaggagcattactctttttcattccattaaaatttaccttaacgttgtgccatttcttccaggagttccctttacatatttctgtcatctaaaaaataaatcagtttctctttaaattaaaccttcctggctcctttgccccattgaatcctggaggaaaacaggaaattaagtatgaaattcaggtattaattaaaataaatgctcatagtgccctattaaattggctgcattttgacaggaacactggttcaagagttacctactctcaactgctgtaatctatatacctccatcatttccaagcatcagtcaagttctgaaacacggacttctaacttcataggcaattgtttaccagcgtttcagtttattactaaacactggaaattataccagacatcttagtcctggatggggcatgcccttctgatcagcaagtctgttcagttataacccaaaacgccatacagtttaaggagaatgaaaacagaggtaccaaaccttttgaggaattgtcttttccacttttagctgtttctatctaaagaactggggctagccccaaaccatcagcgtgccctttcctcatggacagtgtgggagaaatacagaccaatcccttctctttgtggatttcatgcagtcccactcttctaattttatttgtcagtaacatgttccagtttctgagatcacaattaatcttacattaattacattttaaattaaccacaatatgctctttcagcagcacttaaaatgtcatcagcaagacattgcataaatcattgttgagcgtggtttacttgtgaggagatttatgtagatgataattccttaaaaggcacatggattttttaaaactcttatcaaagtatgatatttctggggttcgaccacagttacaggaaggtcatagtgtatccggcagtttgcacagcccttcacctaattttgccaacaagcatatgaagggaaatatattttcttctgtgattatccattttgtgttttgtcagtttcaatgacttctcttccagatttatgaagtttatatggcactgttatgagagacctattccaactctgccttttagtacctccagacccctaatgacacaattatgagctttctcaagtaatgttattgcttaaacctttaaagtctcccaaagctcggagcactatttgcaaatatgtagtaaattaaactgcaacacctgctactgtgtagttgtgtcacaggtcatttcatctctctgggtatcagtttcctcaaatgtcaaaataaagggaagctagaatcactgtaagatcttctgcaagtctaaaattctggtattctctgaacaatgctatagatagttgactttcactttcctcatatcacactgactgattgatgttgattcttatctcaaaaagtaagatttctagctctagagagaccttcaagattgtcagctctaacacctccattttgcagataaaggaaacttagggcttgagaaatgaagtgacttctcaaactttccacagtcagcaagtggctggcactaaatgccaactctcctgctactgataaagttctctctcctctactccatgaaaaaaaaaattcttgcatttttatttaagttgaagatatttcaaagtaaacctgatcaatgaaattcaactgtgaacacgtatgtcagaatattacagtcaggaaacaggaaagggggatgaaaaatggcatgtgtagtaggacccagacagccaaattaatattgattcaaagaaccagaactgcaatgaaataaggacagaactaaagaaattcagaggtttggggaaaagaaaaaatttaataaaaatggaaataagactcagacaagcacagctatgcttttgtcattgacattcagtactattaagttcatcttcatcgggacattggtaaggaaaggcgtgtgatctctttgcagactgatagactttttggccctgtaatgatagactttgtctttttttttttagaactctagttgcaaaactctgcttatacgtgaaaaaaagatcagtctgcatctgtccctgttgctaatagtaaccatctttcaaatattgccagcttttcatatcacaagcattttggtccaactcacttcacctcattcagtcttcgctactcaggacttccttttaattgacacacaataattatacatatttatggggtacaatgtgatgtttcagtacacatatgcattgcctaacgatcaagtcagggtatttagcaaacccgtgacctcaaatatttattatttctttgtggtaaacacttttagaatcctctcttttaggaattctttgtatagtttcaaggcttctgccacctccacagaatgctttttggttctctctgtgatctgcacagtgtattttttctcatttcatctactgcttgtcctacactttcatttcttcatagcactcctgatgtatttcaaaatctttaaaagcattactggtaatcatcataataataataatgaggctataacattttccataccacagtcttagaaatcatctagtttattacgttcaaaaaatttcccaaaagaaggcctaccaaacatgtaataaacctaaaaatgtatcaggcactagttcagaggctgcatacaccaatctgatgctcataaactcattctagctatttgtacaatacaggctttcttctccaaggtttccatagagtcctagaggaattattagaatcctgagccggaattaaatgaaatgagtgttaaactgtgatctggtaaattgaggtagatggtgcaaacagctgattgttaaaggaaagtatcctcaagcctcacagttgcagggtctgttttataatctcatatcctagttttgcctatttggccattgaaaaccaatccaaacagcctctttaagtgacagctagattcaattcctgttgaggtgttgttgtttaaaccctctctccagagagcttcagtgggattgaaaaatacttgttccctggaagctacagtaggaatgctctatgatttgtgcataatacatatgataatctgagctttaaattaatccctaacccttctggataatacgctgcaggtaatttctccttcctatattacactgcggaagctagaattcagaagtatagtcttgctcaccttttaaggataatagagcttcaaaacagtattgcaggaagcaaagtggaataaacagaaaactgtcaaactagatgccactactgtgagttgttgaaaaggttaaatgtcagaagcaaatataattggatgactggaatgaatgactaagtgctttttacactaagttgcttgtttcacaagcaaccctagacccttagaaacagggttgatgaagtcaaagggacggccattctgtcttgtctttccccttctcagatcagcagaaaagcagcagaaaaacatggtgttggattgtagtccctacagatttggtacttccaagactctcccactccagcaaaaagaaaggacactcataacctttcctttttttctactccatggtaaaaatctagagatgggtatagtgcaaaatattcagattttggagaattattatccattttgtacttaaaaaaaagaaatcttttgagaatttaaacccattgtttaataggatctcaaataaagcaattgcactaaaattcaagccaaagaagccattaagaactgatcatttatttggaggaattaatgttattttcctttaaggaaacaaagataagaagcatagatgttttaaatgcagttcttaaaacaatcttttcttcttaatgcttcagaaattgtttatgatcaaaagatgcttctgcgtttttatattaaagccctgccttgggcagggagcaaggagaatatatcattattagtgggaagctcgcaagaaagatgagtgtcccccactctctctcctcctctctggagtccaactgcagctgtaactttggctctgaaatttgaacaagggaggaagaaggctggatctggtgtcaactgtgaacgtgatttcccccaaggcaagagccaccccaaacagggcatgtactttaaattgcttttcgggtaaaggtccgaggtttccattgaaccagtagcctaaagttgtgaacccaacacgagacttcctgtattcccactctgcttctaccacaaaccagttttaggagcttgaaaagatcacagagctgctataggcctcttttctcccctctgtcaagtgaggaactaggaggaggtggcttttagtctttttcagtttctgactgtgtgaaagctatattcttcctgactggtgaaagctttgtatattatccctcacaagggatgttttctttttaacaagaaaacaacaggagataggtaatatcagcaaatactgcatgatttctcgtataaaaaggcatctaaaataatcaacagtatggcgatagagaatagaatggtggaagggcatggaatcagggggataacgagagctgttactcaataaatataaatttattcaagatgaataagttccagagatctcctgtacaacgtgatacctatagtgaacagtaaagtattatatacttaaaaatttattgagagagatcttgtgttaagtatccttgtcacacacacacacaaagaggacacaagaagacttttggcggtgtggatacgtttattacccaggttgtggggatgataatgtaactgaacccaggactggccacttgctacttaaaagccagacatgacagacgagggttggtaggaggaaaatgaggtttatccatagagccagtacaccgcaaagagggtggactatagcctcaaagaccatcttaagtcagcacaggtgttaggctgtctttatgttaagggcagggggaagagaaggggaatctagatcaagagctgaccaataactgcagacatctgggcagcagcaagggtccgagaaggttgagaacgtctttgtcctgggtcaggtcacaatgctcctataaatccttaacaaaacagagttgtttacatacttccccctttaatcccagatttagttgtaaatctgatttacaactaaatacatgatttaatgtaacatcacatacatttctgttacattaggattagagacaagttctatttagaaataacttcaacagtttttatattttattttcacattgaaaatcggtcagacttgcttcagcctcaaagagcatgtttatattataattaaatgagcactggtggtgagctgtagtttctgtttctaaatgggaaatgggttaaaccaaaatgaagttaattatattagtttttttgctgtttcactgttacagtaatgctagtgtgtagacatacatatgcgtatatgtatatgtgtgtatatatatatatatgtccaacctcaacaaaattgtatacattaattatgtgcagtttttagtataccaattagacctcaataaagctggaaaaatgacaaaagaagacagatagcatcctgagtgcctccccaacctacctgaaccccagtagattggtgtgtaggtaggaactggacctttcatctctgtcttcccaatgtccagtacactgggcacttagtaggtattacataaatgtgtgttactggtcggtttaaatcaacaacctgatacctttctgagagtagaatatgagacctagtttaggtaccaggtaaagagattctaacctgctttctctacgtaagactaacctcaccctggccatgttaattccaatccttaatcttttaatctaatgagttaactatcagttgtataatttttatctgattattccaattcatcacatttaattatcttactgtttctgccttccattagtgaggaggagaaaacatttgctaataattttattatgtagtagggactgtagtaagtactttatatatcccatcatattttatttaacagcattctcaaaaacactgaggtagaaattatgacacttattttacaggtgaggaagcagctcgtagcattttagtaacatgtccagattctcatcactaagcagcatcatagctaggactggaaacaagcctgtttccaaagcctgctttttttttttttttcctgcgctcactgcactggagttttcttcccctaccaaataaatcaacattatttctgagattgcataatgggagtatgagggacttggataggaagcagagaactgtctgaaatgacattttctaatattggtggtagattgcattgatccagtgagatgaacatctccatctcactagccacccctatggtcatcaatgtgcatcttgttatgtattttggtgcacctagtggtacaaatgagaccacaaatcttattcttgtgtaaagcatcagattgttttgggctcgccatccatgtcttttgcctcattagagccatattctactcaatccagtgagaaaattgccatagacgacttttcagataacaatgatgaatactactttatatatgtatacacacacaatgtgtgtgtgtgtgtgtgtgtgtgatcaattctttcagcttagtaaaacaaaagtgttagcagaatttttacattcaagttttctgacagtcataatggtaaataaataactctaattctgtttctcaggtgaagcgaagttcggaagttgtcaggctactgaccactctgatggaactagcaaggaaatgtgtgtcatatattattttggaaaaagaggatttttaaactgaattcttaaagttgtgaagagaaaaactgaaacctattttctcctcttggttaccagtgtccatttagcgcccagaaatatcaaatggggatcagagtagccctaaaatgatgccataacacaccttgcaagtttctttcattgtgaaatttgtgagtctgataatacatcttttttcatgtttctagttagcccctttattgcatgattaataaaagcaaagggatgaaggactggggaactcagtgggcaatgtatgcgataataatatctaatcaatttccttctgcaagtttgattacattaagacttctggagaagaaaattgattggactcattcacttgggaacctttcaggaaacaaagtgatttcttttagttttctattgcaactgatattatgggcctagagccaaggaaaaatgaattgtcctatcctaatcaattacttaaatctggtttttataccaagtgttcataaaattggcaaagcattgaatgggtggaaaaatgctaaacaggaaatagaaaaagaacaaatcaaatttaagtaaacaaggatgaaaggaaaattatatgtataatatatattatgtataatgtatataatatataaatatatatttatatattttttgagacagggtcttgccctattgctaggactacagatacacactaccatatctggcttattttgttcattttttgtagagatgaggtctcactatgttgtacaggctgatcttgaactccagagctcaagtgatcctcctgcctcagcctcccaaagtgctgggatgacagttgtaagccactgcacccgggaggaagaatgcgtattaaaggaagtaatttagccttatctcacctcaggtgtccagacatttattgagcacctactatgtgtccggcctttaactagatgttagaagtctaaaggtgaataaatcatcatatctctaactttaagggcctcccgctctaataagaaaacatgcacacacacgcacacacacacgcacacacacacacacacacagagttgtgaaactactagatggatcaatggcaaagatgaggatagggaacaattatagcacaagaaaaggctcctaattcatagaattaggtaaaaaggtatttgctttgaggcaaaaaaaatacatcagagtgtacaaaaaagaaaaagaaaaactgtgtggaccacaggattttgtaattgctgagcatgctgtgtgagacatggaagcttacaacatgaggagcagtgagggtaatagagaagatggattgtagaaaatcataggtgctgctctttgtgaagcaggttgtacttcaggcagtagaaaaccactgaatgtttttaaatggtggacaatatggtcagatttaggtgttgaagggatgattctggcaccattatagaacatgacttttactaggaaaagatgagagaaaaaagaccagtgaggatatagagattttccttgtatgctgcaaatggaattcctctttcaattttattttgaaggatctccactggatttaagtagtcaatgaattaaaaaataagggagtgaataagaaaggaggaattatagctatagccaacaattaatatctatggctatgaagatggaagttgacttcattgagcaaacaggaacacacttttagtatttaggctaatgagttagcacatctgatcatttatcttcaatctgtccacagaagatcttttgaggtaaaggatttccaaagaagtgggcttatgtcaaatgttccaagatcttgaacaattacggtcctttcagaagggcagataaaatccaatcacaggcataattgttttattgggttttgctttattgagcttcgcagatactgcacttttcacaaattgaaggtttgtgacaaccctgttttaagccaaccctattggcgccattttcttgcagcatttgctcacttcatacctcagtgtcacattttgataattctcccaacaattcaaaatttctcattattattatatctgttatggtgatttgtgatcagtgacctttgataatactattataattgttttggggaaccatgaactctgcccgtacaagacaatgaatttaatcaataaatgttctgtgtgttctaactgctccaccgaccagccattaccccatctctccctctcctcaagaccccctattcccaaagacacaatactgaacttaggccagttaatgacagtacagcggcctctaagtgttcaagtgaaaaaaagagtcacacatctgtcactttaaatcaaaagctagaaatcattaagcttagtgaagaaggcatgtcaaaagcaaagataggcccaaaactatatctcttataccaaacagccaaggtgtgaatgcaaagaaaaagttcttaaggacattgaaagtgctactccagtgaaaacatgaacgatagaaaagtgaaacagctttattgctgatatggagaaagttttgatggtctgcatagaaccaaccacaacattcccttaagccacagcctattccagagcaaggccctaactctcttcaactctgtgaaggctcagagaagtgagaaagctgcagaagaaaaatttgaagctagcagagttggttcatgagatttaaggaaagaagccttctctataacgtgaaagtgcaaggtgaaacagcaaatgctgatgtagaagctgcaacaagttatctagaaggtctagctaacgtaattgatgaaggcagctatactaaacaacagagtttcaatctagatgaaacatctttctattggaagaagatgccatctaggacttctatagctagaaagaaaaagtggatgtctggcttcaggacttcaaaggacagaccttgttaggttacttgaagttgaagccaatattcacttactgttctgaaaatcctgagactcttaagagttctactatctctactctgcctgtcccctagaaatggaataacaaagcccggaagacagcacatctgtttatgcatggcttactaaatattttaagcccactattgagacatacatagaaaaaaaaaagatttctttcaaactgttagtgttcattgaccttgcacctcatcacccaagagctctgatggagatatacaagaagattaatgttgttttcatgcatgctaacacaacgtctattctgaagcctgtgaatcaaggagtaatcctgactttcaaatcttattatttaagaaatacaattcatagggctagagctgccaaacagagtgatttctctagtaggtctgggcaaaataaattttgaaactactggaaaggacccaccattttagatgtcattaagagcatttgtgattaatgagagggagtcaaaaggttaacattaacaggagtttagaagaagttgattccaacccttatggatgacttcgaggggttcaagactccagtggtggaagtaactgcagatgtggtagaaataacaggagaagtagaattaaattttgagcctgaaggtgtgactgaattgctgtaatttcatgataaaactttaatggatgagatgttgcttcttccagatgagcaaagaaattggtttctttttttttattattatactttaagttctagtgtacatgtgcacagtgagcaggtttgttacatatgtatacatgtgccatgttggtgtgctgcacccgttaactggtcatttacattaggtatatctcctaatgctatccctcccccccccaccacccccatgacaggccccagtgtgtgatgttccccttcctgtgtccaagtgttctcattgttcaattcccacctataaatgagaatatgtggtgtttggttttctgtcattgcgatagtttgctcagaatgatggtttgcagcttcatccatgtccctacaaaggacatgaactcatcctttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcttctccagcacctgctgtttcctgactttttaatgaccaccattctaactggtgtgagatggtatctcattgtggttttgatttgcatttctctgatggccagtgatgatgagcattttttcatcatcttggctgcataaatgtcttcttttgagaagtgtctgttcatatccttcgcccacttgttgatggggttgtttgttgttttcttgtaaatttgtttgagttctttgtagattctggatattaaccctttgtcagatgagtggattgcaaaaattttctcccattgtgtaggttgccagttcactctgatggtagtttcttttttgtgcagaagctctttagtttaattagatcccatttgtcaattttggctttgttgccattgcttttggtgttttagacatgaagtccttgcccatgcctatgtcctgaatggtattgcctaggttttcttctaaggcttttatggttttaggtctaacatttaagtctttaatccatcttgaattcatttttgtataaggtgtaaggaagggatccagtttcagctttctacatatggctagtcagttttgttaaatagggaatcctttccccatttcttgtttttgtcaggtttgtcaaagatcagatagttgtagatgtgtggtattatttctgaggactctgttttgttcccttggtctatatctctgttttggtaccagtaccatgctgttttggttactgtagccttgtagtatagtttgaagtcaggtagcatgatgcctccagctttgttcttttggcttaggattgacttgccaatgtgggctctttttggttccatatgaactttaaagtagttttttccaattctgtgaagaaagtcattggttgcttgatggggatggcattgaatctataaattaccttgggcaatatggccattttcatgatattgattcttcctacccatgagcatggaatgttcttccatttgtttgtatcctcttttatttcattgaacaatggtttgtagttctccttgaagaggtccttcacatcctttgtaagttggattcctaggtattttattctctttgaagcaattgtgaatgggaatttacttgtgatttggctctctgtctgttattggtgtataagaatgcttgtgatttttgcacattgattttgtatcctgagactttgctgaaattgcttatcagcttaaggagattttgggctgagacgatggggttttctagatatacaatcatttcatctgcaaacaaggacaatttgacttcctcttttcctaattgaatgccctttatttctttctcctgcctgactgccctggccagaacttccaacactatgttcaatagtagtggtgagagagggcatcctggtcttgtgcctgttttcgaagggaatgcttccagtttttgcccattcagtatgatattggctgtgggtttgtcataaatagcctttattattttgagatacatcccatcaatacctaatttattgagagtttttagcatgaagggctattgaattttgtcaaaggccttttctgcatctattgagataatcatgtggtttttgtcgttggttctgtttatatgctggattacatttattgatttgcatatgttgaaccagccttgcatcccagggatgaagcccacttgatcatggtggataagctttttgatgtgctgctggagtcaatttgccagtattttattggggatttttgcatcaatgttcatcagggatattggtctaaaattctctttttttgttgtgtctctgccaggcttcggtatcaggatgatgctggcctcataaaatgagttagggaggattccctctttttctattgattggaatagtttcagaaggaatggtaccaactcctccttgtacctctggtagaatttggctgtgaatctgtctggtcctgcacattttttggttggtaagctattaattattgcctcactttcagaacctgttattggtctattcagagattcaacttcttcctggtttagtcttggaagggtgtatgtgtccaggaatttatccatgtcttctggattttctagtttgtttgcatagaggtgtttatagtattctctgatggtagtttgtatttctgtgggatcagtggtgatatcccctttatcattttttattgtgtctatttgattcttctctcttttcttctttattagtcttgctagcggtctatcaatattgttgatcttttcaaaaaaccagctcctggattcattgatttttttttttgaagggttttttgtgtctttgtctcttccagttctgctctgatcttagttattttttgccttctgctagcttttgaatgtgtttgctcttgcttctctagttcttttaattgtgatgttagggtgtcaattttagatctttcctgctttctcttgtgggcatttagtgctataaatttccctctacacactgatttaaatgtgtcccagagattctgatatgttgtgtcttcattctcattggtttcaaagaacatctttatttctgtcttcattttattatgtacttagtagtcattcaggagcaggtcgttcagtttccatgtagttgagtggttttgagtgagtttcttaatcctgagttctagtttgattgcactgtggtctgagagacagtttattataatttctgttcttttacatttgctgaggggtgctttacttccaactatgtggtcaattttggagtaagtgcagtgtggtgctgagaagaatgtatattctgttgatttggggtggagagttctgtagatgtctattaggtccacttggtgcagagccgagttcaattcctggatatccttgataactttctgtcttgttgatctgtctaatgttgacagtggcgtgttgaagtctcccattattattgtgtgggagtctaagtctctttgtaggtgtcgaaagacttgctttatcaatctgggtgctcctgtattgggtgcatatatatttaagatagttagttcttcttgttgaattgatccctttaccattatgtaatggccttctttgtctcttttgatctttgttggtttaaagtttgttttatcagagactaggattgcaacccctgcctttttttgttttccatttgcctggtagatcttcccccatccctttattttgagcctatgtgtgtctctgcacatgagatgggtttcctgaatacagcacactgatgggtcttgactctttatccaatttgccagtctgtgtcttttaattggagcattagcccatttacatttaaggtttatattgttatgtgtgaacttgatcctgtcattatgatattagctggttattttgctcgttagttgatgcagtttcttcctagccttgatggtctttacaatttggcatgttttttcagtggctgttactggttgttcctttccatgtttagtgcttccttcaggagctcttttagggcaggcctggtggtgacaaaatctctcagcatttgcttgtctataaagtattttatttctccttcacttatgaagcttagtttgtctggatgtgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacatttttttcttcatttcaactttggtgaatctgacaattatgtgtcttggagttgctcttcttgaggagtatctttgtgatgttctctgtatttcctgaatttgaatgttgacctgctttgctagattggggaagttctcctgaataatattctgcagagtgttttccaacttggttccattcttcccgtcactttcaggtacaccaatcagacgtagatttggtcttttcacatagtgccatatttcttggaggctttgttcgtttctttttattcttttttctctaaacttctcttcttgcttcatttcattcatttgatcttcagtcactgataccctttcttccagttgattgaatcggctactgaagcttgtgcattcgtcacgtagttctcgtgctatggttttcagctccatcaggtcctttaaggacttctctgcattggttattctagttagccgtttgtcaaatctttgttcaagatttttaacttctttgccatgggttcgaacttcttcctttagctcagacaagtttgatcatctgaagccttcttctctcaactcatcaaagtcattctctgtccagctttgttgaattgctggtgaggagctgcattcctttggaggtggagaggcgctctgatttcatagaattttcagtttttctgctctgttttttccccatctttgtggttttatctacctttggtgtttgatgatggtgacgtacaggtggggttttggtgttgatgtcctttctgtttattagatttccttctaacagccaggaccctcagctgcaggtctgttggagtttgctggaggtccactccagaccctgtttgcctgggtatcagcagcagaggctgcagaacagtgaatattggtgaacagcaaatgttgctgcctgatcgttcctctggaagtttcatctcagaggggtacccggccgggtgaggtgtcagtctgcccctactggggggtgcctcccagtttggctactcctgggtcagggacccacttgaggcagtctgtccgttcgcagatctcaagctccgtgctgggagaaccactactcttccaagctgtcagacagggacatttaagtctgcagaggtttctgctgccttttgttcggctatgccctgcccccagaggtggagtctacagaggcaggcaggccttcttgagctgcagtgggctccacccagtttgagtttcccggccactttgtttacctactcaagcctcagcaatggcgggcacccctcccccagcctcgctgctgccttgcggtttgatctcagacacgctgtgctagcaatgagcgaggctctgtgggcataggaccctctgagccaggtgcgggatgtaatctcctagtgtgccatttgctaagaccattggaaaagtacaatattagggtgggagtgacccgattttccaggtgccatttgtcgccccttcccttggctagaaagggaattccctgaccccttgcacttcccgggtgaggcgatgccttgccctgcttcggctcatgctcggtgccctgcacccactgtcctgcacccactgtccaacaatccccagtgagatgaacccagtacctcagttggaaatgcagacatcacccgtcttttgtgtcacttacgctgggagctgtagactggagctgttcctattcagccatcttggaatcgccccccgaaattggtttcttgagatggaaactactcatgctgaagatgctgtgaacattgttgaaatggtaacaacggattaagaatattacataaacttaattaataaagcaacaacgggatttgagaggactgactccaattttgaaagaagttctactctgagtaaaatgctttcaaacagcatcacacattacagaaaaatatttcatgaaaggaagtcaattgatgtggcaaacatcattgttgccttattttaagacactgccatggccaccccagctttcaacaacaactgccctcatcaattggaagtcatcaaaatagaggcaagacccttcactaggaaaatgtttccaactttttgaaggctcaaataatcattggcatttttttagcaatgaagcattttttaaattaaggtatgtacattttcttggtcataatgcttttgcacactaactagacacagtataatgtaaacataactttttttttttatttttttttttaggtggagtcttgctctgttgcccaaactggagtgcagtggtgcaatcttgggtcactgcaacttctgcctcctgggttcaggtgattctcctgccttagcctcctgagtagctgggattacaggcatgtgccaccgtgcacagctaatttttgtatttttagtacagacagggtttcgccatgatggccaggctggtcttgaactcctgacctcaactggtccatctgccttggcctcccaaagtgctggaattacaggtgtgagccactgcgcccgggcaaaacaaaacttttatatatactaggaaaccaaaaaattcctgtgactgttttgtagtattcactttattctggcagtcttgaaccaagtgtacgatatctccaagatatgcctgtacctgtcagagttctactttgcattcaattacagctattaatctcctgcaagtcattttgtctctctgaagttttttttttttttttcttaaataggagaatactatttatcaactcatttcatgggattattgtgatagtgaaataagaaactgtaagagaaaaccttatacttttacaaatctaattgcttttattatcattattgtgtatgtgtgtgtttgtgtgtgttcactgttaatctcaatgcccttcttactatttttctcccccttaaagcaaccttgttcattctcactttcccttcaggtatcagttttctaataccttcccctcatcaaagtctaagtagaaaaataagatataagctattgacatgttgaataaaaacagtgagtttctactgctaggaattccatatcttgtcttggccctatcagccttgaaactaaaataggaattttcagggttcttatggaaaggtgagtctaatggtttgaggcacacacacatatacccccattatatgatttatttcagagaaaatcatcctagatacagtcccaatacagtcagaagccttgagaagctgaaaattggaaggaaaatgtggatagtgtgtgttcctatgagaatttccatttcatcatacagtaaaagtctatgctggctctcatacatttctataataaaatgtatcatcaatatcatcaatgaaatatatatatgtatttcatgtatttatatatttcatatatatataaatgctgaattaaatataaaacttaagtatattacatatctattgaatactgatttcagcatttttggatttgaggcctgctgggagcactgtgttgactcaatctaccacattgcccaaggctggccatccttcacatagtcttacagctttctctgcccacaactccaggtgtctgtgtagctttgactggcatctctgcagagctgagggggctgtgggaatgctgtctttctccaggcatccacagaggggctggcttcaggtttagtttagtcccatagtccacttgtgggtcagagaaatacattaattaggttagctcctatgtgagttattgcttcgcaggttaaaatcattctgattctactttggtaatatgcaaggattttcaaaacattttctaagagtgtgatatgtgcagcaagcatttaaatttagatatcaaattgtttttattgaatttcaaactcaaaagtgtttctaaatattgtcattttggaattgggcccccaaaaatagtaaaaatagatgtttaggtagagaaacacatttgtgtagcaatgcctcaccctgctacagctcgttcgctgacactgcccaacaaacccactgaggcttggtgcgagaaattacctcattaaataatcttataaaaaaattgtcagatgtaacaaagactggactctctgagcttttctctataaagaatgcattgttaagttgatcgggttaaggttcagttagtccaaggtagggtttatgaataggaagaaacttgtcattcactttgtagatgagtaaagcatgtgaatttaggggaaaatatcatcagtcacttcctcaaattgtttttggaagtagcaaaatgtcaaccatattattaaataaggaaaccatacttcttaaataaacttccctagaagcagatctagagatgaggatttgatttgtgtgcaaggaatttatgaaagggagtgtgctaaggaaacaatggaagcaggacagggaaggagtcgaaggggagcaagagggagggcccaggcagaagtcctcaagctcagggcgtagatctcagccagtccctcaggtgtcctcaggagtgtcagagttttcccaactggaggagaaaaagctagactgccattttcccacccccaatggtcattggttaccagcatgtgtggaagatggcagtcctcaggcacttctggctcctggaggctctggaaggcaaagagaagtctgccaaagaatatcacagatgatggccattggaagctttccaagggttcaggttttcagaactgtttagaagagatgggaagagatttgggtcattacagcactggccgcagcactgtctgctatgtaagtgcatgactagatggaccttgagctattcttcaggtccagataagggatctatgtgtcattttaaacactggcttcatgtacttgcctgaccacaaagggcaatgtcaccaggaatataaagtcaaataaaatgggtcctgtaaaagacaatttgctgctgggttgcagtttaatccatgacctcttttgcttacatgagatcttgaaagaatattaaattaagagttatcttctatgctggcataagaagcaaataattttccataatatggaaataaaatatgtgaaaaatgttaagtttcttgaaacaagagtttaaccagaagttaataaacaactctttcttcaggaaacctttgactcatggtttatacatacttttgtattaagttgtgtagcataaaaataaaagtatagcagtagtatactaccactggagtgtcattcctgagatagccagatgttcagttattttgaaataaccctggagtataacagtaaagctaccccctcaaaaaagttttttgttattagaattcatgatattaatctaagttaatctctccattcctttgtgctcctcataacatgttgtttaaatgtctctacagtactgattccatcctattttatgttattattatcttgatggctgtattagtccattctcatgctgctgataaagacgtaccagagactgggcaatttacaaaggaaagatatttattggacttacaatttcacgtggctggggaggcctcacaatcatggtggaaggcaaggaggagcaagtcacatcttacatggatggtgcaggcaaagagaggagagcttatgcagggaaactcccctttataaacccatcagatctcgtgagacttattcactatcacaaaaatagcccaggaaaggcctgcccccctgattcaattaccttccactgggtccctctcacaacacatgggaattcaaggtgagatttggttagggacacagccaaaccatatcaatggcaaaaccgtataaggttcatctttagatcatccaaaacatttgtcactgttccagctcatgatagatgtttgaaaacatttgaatgcatgaattggcctacaatttcccttctttgaaacatcttgtcttttattataatagccaagtacatttgctctttgaataatgattcaccatacactctcctagctgcttgttaattcttaactttctctcccttgttcctttggaatctgttatcagtgtttcgacaggatgtgcacaagtgtcagagcatatgttgtctgcatatgtaccaaagaaggcatatctttctttccttttctctgcaatattcttctctttaatgcaactataaattcccagaacatacctcctattttgagccaagaatcaggctttgaataaggtttcgctcatgtagagtaggattctggatattcagcttcaatagtgaagctaagaattctacgtatcttttcctactagcttggaaaatatatcttaaactagtccttggctatgactttgccccttctcaggaatagacacagtgtgtttatgcaaaacaaacacagcgttttcaaagatagagcaagagaaaaaagagacttctctaataggctttaatacaagaatgaatttcatggatttatttcagagcaaatcatcctcgatgtggtcccaatacagtcagaagcctcgagaaactgaaaattgggaggacaatgtggacagtgtgtgctcctatgagaatttcagtttcatcacacagtaaaagtctatgctggctgtcataattttttataataaaatttatcatcaaaaatactaacaaaatgttgcaaacccaacacattcacagtcttctatagttttaaacatacactaaggtcaaagccaataggatagtcagctgctttaatttaggagtaacacgagaatgggccagcccctagtagctcctccattacctggtcatatgcgatgtccactatgattgcatcgtagttacactcctgggaaaacacacctgtatccgaaatctcccaaatagcaaatggtagctggaatagggaaataggtggctatcactgagtggaattaagatccctaagtaagtgaattgtagagaagctcatctttgatcagggtcataaaaaatctggtgctggaaggcagggattaggtgaggctgtaaaaccggatgccccaaagcaaatttgctttgtctttctttctcctcacagactcattccttatcttcccaattaatgctatcactgttctcccctggtaccaaagcttaagacctatgggttgtttggacgcctaactcttaccctgcttgtccagtcacgctctggtaattgcgtttctgctttattccggttgccttgatttaggatttcatcttctcccacttagttgagtgccattttctccttcctgacctctcatattttttgtgactttttttttccatctgagcagctagactgacctctcgtgtgttttaacgtcagtcctctcttccactgccagccatctcttcagtcccaggtttatctccatccctatctcctcccccagctccgtggcttctccccactgtctcctcctgtctttgccatggtgatggctactgtggagtggagtgttggttaggggccctggagccccacccttctagtttcgaaacccacctctgccttattacctgtgtgaccttgggcaagttatgtaatctctccaactgtcattctccttatttgaaaaattatactaattaatgcctaactcaaaagattattttgaatattaaatgagataatgcccataaagagtttagcacagggcgtgttatacagtgaagtattcacaattaccattgaagaaatttgatgattagcatttgatatcactgaggctaggagatgcagcaagaacttcagtgggtaaatttctaggcagacaaacaatattactaaaatagaaggtatatgagccatctgcccctttttacaaggtatatgagccatctgcccctttttacaaactacagaacatttaaaattaattcaataagcagaattcctggtattattattaaatatcaacttttcaattgacctggccataaaccatctgttggttgataaagacacacatcctaaacttacagaaatagtaccattattcaactttatatgccagtggttcatttctttaacaaatatgtagcgctctccttcatgctatgctagactgaactaattgttcaggacgtcagaggacaagtttagttcttgctctgagaaaacatcatctgtatgagtttgcaagggtttccataataaaataacaaagattggatggcataagcaacagaaatttattttctcacagttttagaggctagaagcccaagatcaaagtaccctcagggttgttttctggtgagggctctcttcctggcttgctgacggctgccttcttgttgtatcctcatatggcctttcctctgtgcacacctgctagacagagctctctttctcttctaaggacaccaatactatcctatcagggagcatgccccaccctccaacctcatttaactgtaattgcctccttaaaggcccatctccaaatacagacctccaaattggggagtagggctttaacgtgtgaattttgggggacataatcctgttcataacactatctaaccaaagaaccagaaaaatagaagatcaagggacacctagttcaagtttttaggtgaaccataacctacataagttaacataaaaacatttctgagagaaaaaaaagaatactatgttggtactctaactcaaagatcttggactgagaatcaggttgtttgtgttctaatcttccttctgcagtgaaattgcagtttaggcaaatcaatttctcaagtcattctgcctctctgtgactgaatcaaatgaagcctaatgatgcttataaagttgttttaagacataaaagagctctacaaggataagatgctgtcattttcatcactggctttcagctaaaagctcagcctgatatatttttaccatttcagggaaggcaatcttcctctccagttcaagtatgtagcataatatcaaagaatattgatgttaaaatgtggacttcatgatcaacatattgattagacactattttgaatatgttaagagagaaagcttcaacctacacatccctgtcaaccatcaaccaaccccaatcataaacatctttagcagaagactgaattctccttttcttgaaattccatagtgtgtgttgctttattccaattacacgatgtcttaacatgaaactgtaatgcgattttcattcagttcttaatttcagatagccagaatatatttctttataaccaatcgagaaatgtgactataatgaagtcagcattacttggtaaaaagatttaaaacaaaatgctctttctctactagtcgaactaaaacttgtctgcatagaggacatctgtaacgtaaaggaggtcaggggcatgcaatgaatcaattcaggagtcttcacaagcgcaatcattcttttctactaaactaaaattgttaagatccttttcattttgaacataatcacttttatagtttccaagtacaggaatctttaaaatctatagctagagatgtgtagataagaataatatattcaatgaacttctttttcatggggtgtaatctgtataattgtttaacacaaggaaaaccacaataaagaaatcatgcccattctctggggaaacagaataaaagcacacagggtcaaatatgcaggttctgtgtgtaaatagcactgatgaagtgcatatcttgcacattttacctttacgtgcttccttctgtgggagaataacaaactccctgcaggtctatagtagtgacaatgattaaaacttgggataaagcagaagaggatctgaaattgttagaaaaactctctgatccccaatctgtttgctctactgattgaaagataccagatttaccaacagctgaaactgatgctgggcttgaacacaggggagaatcaagcagcaaaactcagctttttctttcttgtgccccttctagtagagacagtccataaatatttactgaaggaacgaatgaatcacacagacggagcacagttgggcaagccagtctcacacgtcttccgctgggacgaggacgaaatatttataagtcgtgatcaataaaatcttccctacctgctacctttctcccttctaccccatcacgacacaaaaacctgctcccagttcctctgcttgtaccacctacaaggttttcctagttatcccatgctacttccctggggaagctttcttggccaccaaaggaaagaataaggcaggagttctcattgacaccaatgggaccaattgttttctcccatcactgctgtggttaccaccccaaccctgactgctgccttaaaatacacgcattttggtaagggtgagagaactccgttctacaaactgcttatagaccagacacatgaaatgtgcacagttttaccacactctctgagaataacataatatgccatgaagatcttcaaagcccacactattttattttccttctagttaatgatgccttgggctttagggccacagatctctcttttattttgctagttcagtttagtttccacctcaggccctagctgagatataaaggtatgcaagtagagctgtggagaaattgtgctgtgtgttctacaagaaagggtcacatttggcttttggttgcaaatatcctatttacttccaactgaaactcaataatacagcattctgttaattctatccacatgaactcaccgaccgcctcttatctatgtcagaaatacaaagtcctcctcagttcctctgaaactaattttttcatctcgattagcacatctaggagtcttcctccttcaatcatgtcctcctttgtgtcttggttttgatgatttttctcatcagtcctttccttccactctcaatcacatcagactggcatctcttcatctttcttctttctttttgtgtttgaaaccacaagtgtttttaggattccaagttgattgaactctactccatacatactccaaaattttcttaccaaattgtatttctattctttttttatggctgagtaatattctcttgcatatatacactacatttttgttatccattcatccattgatggacacttaggttacttccatatctttgctattgtgaacagtgctgcaataaacatgggagtacagatatctcttcaatatactgatttcttttcttttgcatgtatacccagcagtgagattgctggatcctatgatagttctagttttagttttttgagaaacttccattctattttccataatggctgtactactttccattcccactaacactgtttgatcgtttccccttgcccatatccccatcagtatttgtccccatacaaatttatttcttgtgtgattgacaacttaattacaatattatgacccttttctaatcagtctgggacaacttaaagtctgcagtggctttaaggagatttccttgagagcaattaattactgtgttgagccatcctgcccattttgagatgaagcttatcttgcactgtgtgaccctggccttgccagtgcattcctaaaatggaagaacagcaagtgaggcgtcagcagtcaatcacccgcctagcatgctcccatgctgaatgcttttccttttaagaaccataatcagatctaatgatttgcaagatagaaaagaacactctcatttatcttgcagagtgcatcaaggtatgtgggaaggatggagatataaatgcaaatgaccttgacaacaagctaagaaaaactagtcagaactttgaactcaatgatgtttaagaaagattcatgggttaagttgtacattagaagttttttgaagtaaagatatacaaaatagagtcttaagtcactccaaggtcaatggagtgagatacttactgaacatgagttaaaattgtttttttttctgatcatgcacattaagatgtgatgaatgaaaagtgtgctgcatagcatatgagagttgaaaggtaagtccaagacaccccctttgattggaccctttattggtacacttaatgataagtgacagaaccgcaactcaaacttgcttaaagaaaaaggaaattttaggtttcataaaattaagaagtctttagactggcactagtttcaggcacgagtatatccaaggattcacaagatgccattaggagcatgtttttctccctgcacctcaggtctacctgtctttcttgtctttatgctacattcttgtgcaaacatgttaccagcatgcctcccttgaactcagggctcctgaacctaaatttctctacatccaaagggctctgatgggcccatcttgggtcccatgccacttcctggactaaatagtgtgtctacaagatggaatattctgtgtgatggcaggcaggctcacctgatgagaagttctactagaattagggggaatagggaaaggtgctaggcagactgaaacaaaaaggaaggggaccagaggaaacatttcctacagatctgcatgtagggatctgaacaagacataagtcatctacgtggtttataggactgacaatgagtgagaattaagtggaaccttttaggttctgagatctctgtcaacgattggacaaagatgaaatatgaagtaggtttttagtttttgcataaaacaaatgcaattggttatacaatatttggggggaaagaatgataaaagtcaaaagaataaaataaaaatatgtaatctaaccaccataaatgtgtttggcaaatttttcttgcattgtatacaaatatgtgtttatgaatcagaattattcagtatctatactgtatttttgtttaaaatattgagaacattttggcatatgattaaagcagtctacaaaagttacaaaagttttaatggctaaataacagctcatctaatggatgtgtcgtagtccataatcaatgtctgttttacatatttaagtttcccattttttactttcataggtaatattaaaataaatattttgacagcacatctcgtcattttctgaaaattgaatccaactagttaaattactgagtcatagatatgaacatataaaagattttggtgtgtgttgtagcatttctatccataatattactatttttaccagcaatatgtggaacgatccttactgtttcccaaaaatgatgatttttcagctattatattgtgagatatatgaagcaagcattcttgtttcccccacaatatctactcttaaaatcacctagtaaacatttattaaattttaaagaatgggccatagcaagtatatgtttttaattctgcattacaaagccaaaagagagagtctgtgttaatgaagtaaatctctgcttattttaatatcagtaacactcattgttgaggatgtagagaaatgactcttctataaaagcatagtatttcatctggcaattgaagagatgtacatcttaaccccaaaattatttatttggaattatatccaaggagatgtttgatcaaatacacacaaatatatttgatatttatcaatgagatctttatagtatcagaaatcttaaagttatttcattacccatctctatttatttaaaatagatcctagatattcattcagtggatgcaatacagccattataaaggaatgccttgagttaaagttggctgtattgaaatcttgttccaccccagcccaccaaataccagccttgtgcccttgcacaaatatcttgtctgtgactgagttccgtaaaatttattttgagcattaagttggattttacatagaaaaaccttaccaagttctaatgtcaaaatttttataatttttattaaatggaaaaaatgttgatgtgaacaagctatcaaatagcatggctaagaatatcccatttacataaaattatatatgtgtatgtctgcatagagatccagaataacattaatcaaaatatgaattggattatttctcatttggagaacattgggtggtttttgctttcctctttatatttttctctattgcttgaattttctctataagtatttattatctgtatgatcataaaaaagttaataattgcatttactttttaaaaaagtcaaattatgtaagaacttctttagaaaggtctgtacttcataggtgactttcccaaagccatgatgccagattgcttcaggatagcatgagaacaaggtctactaatttttgttcatatatttttgttttactaatttttgttcaagtgcctgctatcagctaaaatgatcctgggcaaaaggaaccagcaatgagcttaggctacaacaattagaaaattccaggctttggctgggtgcggcggctcatgcctgtaatcctggcagtttgggaggccaaggcgggtagatcacgaggtcaggagatccagaccatcctggctaacatggtgaaaccctgtctctactaaaaatacaaaaacatttggctgggcatggtggtgggcgcctgaagtcccagctactcaggaggctgaggcagcagaatggcgtgaacccgagaggcggagcttgcagtgagccgagatcgcaccactgcactccagcccgggggacacagcgagactccgtctcaaaaataaaaaataaaaataataataataaataaaataaattaaaaaaaatttccaggctttgaagaaaaaggctagaagttctgccacaattagctgtgtgaccttgggcaaacctcatgatctcccagatcctgtcttttattttctttttatttccaattataaaataattatctgaaaccttctgtacttttaagaacataaaatgatccgaaaactgatgtatttatttatttagttgctagtaggtggttttaaccaaatctcaaaatactagccttggactaagtatttattcagagataagtggaggaattaggtggttgacgtgaatcttcaaaggatgaatttagttaaaaaaaaaaaaaggaaattagtctttaaaattatagagaatttatgatctggaaagtttgttcaagctcaagatataaatagatttcataaagtttcagataagtatgccataggttactgagattttattgctataactcttaaatttgaatcatgagaggcaatcatcgtcccttaacaccaagatcaagagccagaataaaaggggatgaaatgtgtgcaaacacgagctgtccattttgtgctacacaatagctgagtatgtgttgattctttaataagttcgaatgacgacatcaaaaatatacacagcctatgataatcacagccccgaacttggatatttctctaattatttttccttttctcattttactacaaaaatactaagaaaaatacatcctcttaggtacctgcattatactagttactatgcttaggggttacctgtattacctcatttaatccttacacttgactgctgggatgatgttattcctatttacttacaggagaaaatcaagaccagagaggttaagtgcatatacaaatccacggttggaagcaatcgagctggaatctacacacaggttcttctgattagcaatatgtcatccacagttcctgacatattgagctattgctatgtaatgaaggtcacagtgactactgtggagcatgtgagaaaatataaaattacttatctaactgatgagtctaatgaacaccagacgatgttctctacaatcggtttctttgatacagatacgtaactgacttcctttttaattgaacagaaggaacatattattgactcacataacaagggatactttcagaatgtatagtaatttgttctgtgcaagaaaacctgtttggggccacactttttttctgaagggtaaccttcaaggtattttccctgaaccattttttttctctacagattatagaggatctgaaagactaagataaagcactcccattagaagctgtgatgacagacgaacgagttgaatagtgacaggcagtgttgggtccttttcctatttctttcatgaaaatggaaccgtcgttcattcaaccaggagcctggtcaatacggtgagctcctgtgtgtgtacaggaaggggcctttgataattgcataaggcagacaattcatctggaagctctagaaaataagaggtggaaaaatgagctctcaatgtccacctgggttttgaaaaggtagatatttgaagttgtggcaggctgctttgtaattaaactggtcgctgaggtcagttttcatagcagtccaattccagatgtgatcatagcgtcatgagccatgcctttataaatgttacatttcctgggatcaaattatttgccagaatttacttcctaatttaaagagtttaaatgccacattattttgaatagtattttgctatactggtgtttttgtgtcatggaaaacagtcagagggcatggcatggaatagcaaaaaaaggaaaacctccttccaatttctgtagagcagaattcactgcattcgtatcctgctgtccagttttgattcaactggaccaatttctcttttagctactatgataaatgtagtgtttactgaaaaaagctgatcctattttctactctcttatatacctatcttgaagcgtcagaatgctcctgttatctggaaacataatccattatacatagaggttctttctcttctgtgatttgaacctagtctttaatttatttctattttgaactgaatgtaaagctgattacccatcagagaagaagactggcataatcaagtaagacaagggcaggctccttggaatttttcttggatagcttttctaatagactgaaactaattctgagactctacctgtcactatgcacagcgcctaattcccatgcagctgaattagtttgtgtgaaatactctctttctgaggccctagtcacttagaatttatctcagctctgaagcaatgactgttaataacctgaataattgtggaggcattcccctgtactaaaaattatacgcagactaaatcaccacaactcgattatgatggatgcaattaaaataaattatgtaaatgtactataagaataattagaactagaaatgttgatgagttaattgccatgtctatgtacttatgacacagaaatcgaagaaatttggaaaaaatttagattatcttaaagataaaacagatcaaaaagcatgaaaaataattcggtaatggggacaagagaagtctcttcttgacattcactcaggactttgcaaaagagatgaaggtcgcacaattcactacatggaatttagggacttgacaacctgaaggctgagtgacaaagaggcttcgtacaaactaaaggatgaattaggagacagaagtggctttactgctcaataattagaactttgagggaaatctaaggtcagaaagtaatggttaacgtggattaatatatattcaaaaaacaaacttttaaaagaataggaaacataacatcagtgtgaactcaggcttttgtccctcacttttaagctgtgtccgttgtctgaaagcattggcaaccctgcagccctaagtaccactgcagccctcgtttcagctctaaatacaatactgaggcaaatggtgtcatctaaaaaaaataaaaataaaagacctagaagccagattaaagaggctcctgcagacacaggatgagacaaattgaaaatcaaaaagaataatggctgcaactgattaaaacaaattatcgctccatcatttcataataacactcaaaaaaggttttaaaaatttggagcaatgaagcaaaatgtactagacacttttggaagctgctaaggcaccaattcatcatcatcttaaacttgatagttacagggaagagtaagcttgtattctgtccttttagtagaaattgttctttggactaaccaaaagaacttaagatatcagtgaagttttcaaacaggagaaatggtagaaataggaaagcatcattttgtaacttgcagtgaaacaaatttttaaaaacaaattaaaaggtaaaggtgtagttctgttactgctttcaagaaacaagggatatgtaaaaactaatgcaatgagggaaacatttttggatcctgattcaaacaaactattaaaaatattgtttagacattaggggatgtttgaatatgaatcatgtattagatgagaatatgggtttttaaaactaattttagtaaaagaaataatgcattgtattacataagaaaaaaaattttaattcatattgaagaatttgagtaaataacttgatatttgaagttttattgaaggtatcccagccaaaataaaatgggagcagggagaatagacaggaataaatgaaaaaaaatggcaaaacaaataatgtttatgaggcttagtgacggatccatgtggactatattttcaactcttttgcatgcttagaaattttcgtaataaaaagttttttaaaaatcaaaacactgtttaggcataaacacagagagacagacaatagaaggtaataaattaacgtcaattgccattatctattgatttttatgttccctgagatctttacataaaattcaaggttgtaaactctaaatagatgcctacacatgtagtaaatcgggtgaaaaatgagaagtagcagggagttgtgacctcaggcagaaaaattaaccctgctaacttggatggtgacagcttaagtgtatgagtgataagaagtgtcagggagactttagcatagtgacttggggcactgatcttcctgggcatcacctctgtaggggtgtcagacatgaggtagatttgaagaacaaaaacaaaaaagcatattcctagataatttgtcacatttcaaatgtttactgttcggttctgttctcaaaagatccaccagcgttaatagcagccaggcgcagtggctcatgcctgtaatcccagcactttgggatgccaaggcaggcggatcacttgaagccaggagtttgagaccaacctgctcaatatggaaaacccatgtctactgaaaatacaaaaattagccaggcatgatggcacaagtctgtagtctcagctacttggaaggcagaggcaggagaattgctgaacccgagaggtggaggttgcagagagccaaaatcatgccactgcaccccagcctgggcgacagagagagaccctgtctcaaaataataattaatcataataatattgatagcaaacagtagtattacggttaaagccagggccagcttcgtagccatccagttcgcactggttcctatgcttagaaagatcccacatctggtttagtgctgtgctgttgccatcttgggatttctagaaattttaaacaaggagcctcacgttttcattttccactcgacccttcaaattatgtcaaaagtcctggttagagtggcttatatacaaagtttgtagggagtagatttagtgaacttgatgaagttttatagttcattctcccgaaggagacttgttagtcactgaagagtcgcttcacagtatttatttttctttttaacttcccaactcttttggggacagctaagtaaacacagcctctagcagtatggtattacttgggacaatattagcttcataacaatgacacacaaaagcaacatccaatttcaaaacgtgattgttctctagatcaagaattttgttctgaaatataattttcagatataggtgtgcttgctgatagttctaaaatattgagcttgatataaaggcaaacctgtctaaacatatggaattcttttggtagtcttagccatgctaacaaatatgttttctgactacagcttttttttccccactgataaaggaatattttcaataaggaaatgatagcaagtcttgtagttactctttggtatttgcaaggtaataaccagctaacagcaatgtatcaatgattgcatttgtgtagacatcttgaccaaagtcacacagacagtagcagaaagtcacttgtcactgtgcagctggcactcttgcataataaggattaggatagccgatgttttgtcacagtgccaaagttaatcatggtctaaggacattgaaaaaaagctgagaagtgagtgaattaatcatcattaaaaacagatttaaaaagtaatcctgaaggggaacttttaagaaaaaaatactactttgaataatacaaagttctttcaatattaaaaaaatgaaagatgcttctagaagggactccttcctctaagacatcagtattataactgtaggcaggaaatcattttctagaaattaacctttcagggcaattccatcaaatcatgagtttttattgctccaaagaaataaacccttcatcagaataggattctggatccaagtctctttggcatcctccctttagtgtctttatcagagttagctacagaacattaaagttccagaatacttaagtcagtctgtctgttagacttggagggaggaagatgattatttaaatagtcagatagttgtagcatgaaaacaagttattaaacctctggttgaataacctctgaaaaaatgcaaatgttaactttgagaccgatggaataatgtcaccctacctgtttttaatatttgagaatggacacaagcaaggggacataagggtaccttcctcttgccccctgcaaactggctgccaagggacttgtaatgatggcagctgctttgggacagtcaggcaccaatcctctgcccaaatagtcatttgttcttccactcctaactctttgcttgcctgacattttctgagagattgcactatttttcttttcttatgtttttcactcattttaaagaacgcttttttctgaataagctgtttccttaaagtattcaaagaaacaaaattccaggcagaaggaaatttgcattctgatgttgtttagagttccaaagcctgatggatggctgccttctctgtagctcctccaagtcatttcagatctacaggtgcttcatggcctgtcctaaacctgtaagacttgaagtcttataggcttgacttgtaccttaatttccacctccttccatgtaaataaaataaaaaactaatgcctacattagcactggataatcatgaattgttgtttttgttctttttttttaacgtaagcaaatttaaattttctactcttatttctctcagttggctcttgtgtttctagacatactccatagttggtttccttagagcttcaggtaaaaatcttagcctggatcttaataattatacctgatggaccaagagctgggttcagtcacatattgtaaacaatcaaaagctaacttatgaacatatggcaaatgtaattctttgataagaaacaagacagcaagttgccgtcttgattacatagatgtaataggattattgtctttagctatctgttcttgaagtacatacgtagcactttatcaggaaggcccactgaaaaacaaacatgcaactctggaaagatagatttgcttcaaataattaggaaatagaaaaactgtgatgaaagaaaaatagggaatttatttacaccttcaaagtctcttagaatatgtcaagtaaaattgaaaacgaatcaaacacggaaaagaagcaaaattcttcgctgtaagatttcaggaaatacctagctgctaagattcagcaatttaattacaaaactggcacaaaggcacaatttagttgtggtgaggaaatttaattctcctaacatcagctaaaagtctgtttctcgaaaaattgggacacctgttaactgttttacttatctcaccgaaaatgtatctcttaaaagattactgataatgtcacactctcttttctttagttccaagaagttcatggcagccatcatgccaggcaatgagaggacattcctactgctttctctcccctaagctctggtttagtttctgatgccctgaacatcaaggaagagccaaatatcctggccaaagctagttcagctgtgacagttggggtagggagaggtgacgtagtaaggatccttgaccttggttttcagtaagttaattaaatatcttatgactggacatggtggctcaggcctgtaataccagcactttgggaggctgaggcaggcagatagcttgagctcaggagttctagaccagcctgggcaacatggtgaaaccccatctctacaaaaaaatacaaaaattagctgggcatggtggtgtatgactgtgggcccagctacttgcggggctgaggtgagaggatcacttgagcccaggaggcagagattgcagtgagcccagattgctccactgtactccagcctgggtaacagagtgagacactgtctcaaaaaataagtaagtaagtaaataaataaataaaattttacttctagcagccatgggcatttgcttcaggttattctgaagaacaatgctattctttttctttagatttccttccagaaaggaattcttcttagtttcccgttcaatctctcaaggtaataaggtatattttattaccttatttattgttttctatataataagcttttcatgaaggcttaaagagaaagtacaaattattattgtttttctttgacatttacatccacttactgttcctaaggacaattcagtccctcctcccatgcgtaaacctttctatctgattagatccaggttgttactgatagacataaaattattttataaaaagaaattatgttcaatgtaaaaatagtaatccattttaaattcccttcatttctgcagcctgtttctccagacaactcaaaattgtctgaatcccataagacagtttctctgagcatattgtttaatgagagaaactttagacattctgaataaaacaagggaattactgatgtcccaatgctctttgcaatgagtacctccggtttaccattgtggaggaaatattgcattgactttctaccaaaatccatgtcttatctggaagaatgcctactattcattgaaaatcatttccagacctcagataacacaaggaaccagactgccatatcagactcacaaaaatcagagctcttacaaagtatccagctttcctaataattcaaaggatgcagatgatgataaaggcaattcacaaaaatgtctgcgatcactagtgcagctcctcacatcctgtgccacacgaggatgtgggctggtccagatttaatgtttgaggtttctaagtgatgcatgtaggccatcgtttccacaaggaagccattgtggttacgaaacagctccatttgtttgctccataattatatctttgacctaacattttccactgggccatatcccacaaccccaggagttcttcattcatttgctgtaagcaacctagacagactagatacaccccgtaaaaaggatgccacagaaaagggtctcattacctttctgctagtaaataccttcaggaggcctgattagtatgtttccaaggattctttactgggtcatttctctctctctcttcctctcccttctcttcttggacgtcctcagagaagacacgatgggttactaaataagcccaaaccctttccttctcaagaaccatttctatagcaaatgttattacattatgaccttttttaaaaatgtgtgtgcccctctccatatgatgatttatcatttgtaacacactcagagtgcacaaaccatcagaaatccttatctactatggtaaaatttgagcttcacgggaaaaaaaaaaaagaattgaagaacttccaaagagttttcccctcgtctttgtgactggttgcttttactaccctaggaattaaatgtgatttttccctttaaacgtcagatttgggagtattgctccctcttctgctctcagcattcttactcaatgattagtcttcaacattctcacatactctcagccactttgagtaaacgaagatacatcattcaggagtgagaattaattgtaaacaaaatatttagatttaggaagattaaacatttttaccagagttatacattacagtttagaacattaataaatcattgtggctgagttttacaactgtttcagtttcatgtcaagccatgtagataatttttcctggccttctgctccttagaatgaccaagtcctttgaggctgaatctcaaggcaaatggagaaatttcttggttgaagtcaaaccagctgacttaggtagttcttgttcatcaatccattaattcaacaagttgccattaaaccttgtgctctgtggacagtattatcttagattttgggaatactgtaggaagcaaggcaatcatggttctggtcctcatgattctgacctctttataaagacctatagaagaaatcaagaaaacaaattcaactaaagtaattacaaattgtgataagccaaaggatctttgaactgggctttttatagcagttatattcttatgaggttattcaacaaagataactagcacacagaagaagattgcattatggattccggctgctggcattatagtatatggcttagattaattttcatgagattcccaaagaatgaaattaatcatccagtaccagagaaaatcaataaacttcaagctgctttgaaaatactaacataagaaggttaataccttaattgtaaagttatctgaaatggtattaatgacaaatgttttgtctcttagaatacacattggaaacttcctgaatgctgctgaaactgacgtgaattttttcctttgcataatttaatctttagatagtagattccaatcaagattttctgttccaggtacatctttaagcctaatcactttcctctttcctgcttttctcttcccaactccaagcacatgcctgtgcttataaaaaatgacattcaagttctgttttgaatagagtaaggctttagaggtttccttcaaaacagaaagccccgaagtgcctgtttctgtatattcctcctgtacatcctcctgtgcttcaacaatcaccattttaagtacctgccattaattcatccaacccttaggtatcaagccccagtgctgtagaaggctcaaactaggtggttgggggattattgtcacagatgctgtactcgaggaggatataacttcatggggaatatataaataataatagcaccataagttatatcttatcaggcattgagctgtaagattggagaggatggtaataattgtgtatattcaaagtaacacctgaagatcttttaattaatccacaaagcacagaatatacagttctactcacagattaatgatgatctaatgaatccattaaggctagattttcctctgtcgctggaacaaagaacagattcttcagtcaagcaccaaatagagtgggtggctatgtttatgggctatggcatatgaaaaaaaatacatgcatgttaatgcaaaagtcagtcttagtatattaatacagtattagtatattcatatactaactccatgagagacacagggagctacgatgaagacaaaagtaaacttagaatttccatcatagtctcactaatatttgaagtgtatatactcactgagtagatcatgaacacatttatttttctctaatatgtttctctctctctctctctctgtctcacacacacacacacacacacacacacacacaccattcgggtcaacagaaacaacataagaaaagtttcagaaagcataaattaagtgacatcaatggagcaaggaatatatgcaattagtaatagaaaatagtaacaaagtatagctgaaaattcatatagaagaccatgaatattaagcaaaatttggactatattcagtagtttatgtaaagccactgaagatttttgaaacagatagtgacattatgagtttgctgaaaggcaaacaggatgagttcagttgtaagcctactgaatctgagctgctgcggaggcaattagatgcactcatatctagctactgggaagtcctaactagagatgaaggctgatgagccatttccagatgcttttttttttcaatctcttcagtgcctagaacagttccaggcaattaattaactggaattaactgttaattaactgtgctcagtaattaactactgaattaatagtatttatgatattaaggatatgatgcatacataactaaacactgaatggaagaatagatggatgtataagtggggggagggagggagggaggaaggaaggaggaaggaagaaaaggaaggaaggaaggggaaggggaagaggaggaagggaaggaagggaaggaaaggaagaaggaagtttgcctcttgaatttttctagtctgaacctttctactaaatatctattgtgttgttcgacagttatttgtaaacatgaggtcagattctgggcaactttaggcatctcaaaagtttgttgtatgtgcaatcaagagtaaagatccggctgggtgcgatggctcatgcctgtaatcctagcattttgggaggccaatgtgagcagatcacctgaagtcgggagttcgagaccagcctgactaacatggagaagcccccgtctctactaaaaatacaaaattagccaagcatggaggcgcatgcctgtaatcccagctactcgggaggctgagacaggagaatcacttgaacccgggaggcggaggttgtggtgagccaagatcatgccattgcactccagcctgggcaacaagagcagaaactcagtcaaaaaaaaaaaaagaaaaaaaaaaagaataaagatccatgagcagccaatgattgcagctgtgattgaatcactttagttatgagatgcaggctgtttggtggtgaaagctgtggtgttgggagaaatgagagggagaatacgatactttacaaatttttctttttttttttttggagacggaagtggcagtaggaattagaagagcatcttagcagggcatgccttctgacagttgcaaagaagagaagcagctaaaagaagactaaaggtagaacagctctcctctctggggaggcaaagagccgttaaaagttgtcagtcacttctaaggctagcactgtgtttgtgtttctctgaagacttattacatatggcaagttctacgaactggaaagggggtcagaaaggcattgactataagggcaagccaagcccttcttgcttcagtagtttcctggggcatgactgttttgagacagctgaacacttcagtcttcactctcactacccaacacagagcagcagtgtggggagctaagtcaagttgagaagaatattcttgcttgctggactgagagcacaagcctcaaaacagagttcagaggatgttagcaagtatctggcatccctgccttctaacctgcaggctcatcttgctgataaggtgcgtgccattccagttcctgggatcagtccagtgctgagtcaaaacagaaggagctcaaatttactcttggttgcaccctgacactgtgatttctgggttccagcctttattctgtggccgtaccttatactttacctttgctgtgtccatagctttttcccttgttctcaaatctctatctcgtgtattccaaccctgtttgctatgggttattttcttaggtacttggtgtcttgccctacaccatagctcacaggtggttcttggcacctgccatctcagccaccagagcccagcctctacagtgtagagtccctccatctaggagggtcaactgctcctcagtggcccttttatttggctattctattactccaactaaaactctcctgctcagctacacctcatgtctaattttgcttccactccaaatacctaattttcagctataagctgaaagcacactccaaatacctaatttcactcttgaggcattttcaatcctccctgattttatcttctctgttatcacctggattcccagattgacatggagaaagctatgatatggctccctcctatttcctagtggaaggcaaagggtgcctgaatcacaaagttatgttaaccttaaaattgaacatagaattgtctacataaattcaaaaggttgaatgtaggaaaaaaaatggtgagtcaatataatcttggtttatctctgtaatataccattaaaactcactgagaaagatcactagttaaacatattgtaaattctggaaacaaaagctgctgagttctgctgaaatagcccaagagtaaatcacaacacctacaagatgttttatgactaagttaatttttttaaaaatcagaagtcatcatatctctgcttggtgctaactaaaaagccagaagttttggtcagaacaaatgtagttcacaaacactaaggttttggttgttcaaaataaatcacaacaccagaaacttagaaataataaatataaacatagagccctcttttgtggcttttctaaacaacttatttctgataacttcataatgctgctgaagctggtcgaatttaattatgcttgtaaagtctactcatttgtacatgggtaagtcaaacattctggttttaaacagagtaagaatagttttctaaaatatgtagtcagtcatgtcaaacctctggctaaagtactgttattttggtgcacatattctgagtttccatgaaacaaaacattcaacacctatgatattttatcatactcagcagttcaaaagtgccattcatttctgaagagcttgcagagtataagctccatgagagagtggagagagtgcttcaagatatattctctctgtacccctaccagtgcccatctagaagacattcagtaatcacatggtgaataaatacatggaaataaagtttcatatcaattaatcattgggcaagagaatgttttctggctgctttgtccattgttaaatctactatgagaaatttaaaggtaacaattaagatgagacccagaaaagcactcagtgtcatgagtcagcagaggaatgtttttgaaaaccacagtgatataccatgatgcatcccagaatgcctaaaattaaacatatcaacagcagcaagtgctggccagggtgagaaatagcgagttatacatcgccgtttgggatgtaaaatgttatgaacactttgagaaaccatttatgattgcgtataaagtaaaaaaaacatgtggttatcattatgatacatctattttattttcaggtgtttacccaaaagaaatgaagacatatagccacataagaacttgcttaatttgaaatatctcctaattataactaattcagcagtttattctaaatcaacatggaaatgaataaacaagggatgatatactcgtacaatggaatactacccagccaaaaaagggaggaaagaacaaactgctgacattggttacaatatggatgaatctctacaacaccatgaatgaaagaagcaaactcaatgtagttgacactacgattttatttatatgaaattctagaacaagtgaacctcatctatagcgatggaaatgagatcggtggtaggctggggccaagggtagacagaattgaccacaaagaggcacaggaagtttttggggttgatggcaatattaaatgtcttgattgaggaggtgacacagatgtatgcatttatcaaaactaattgaactgtacactttaaatgagtatctcttatggtatgtaaattacacttcaataaagctgattatacactaaataaaactaagacaaatttggaaagttggtacctatgtttataattatagacttttaaaatatattctattatgaataatgcttttagcctatggaatcaattcttcataaaaactcattacataattttttgatattgcttgtaaaatcattcctttagacctattgagtaataacggtgtaggtgaagtagaagaaaggttatatgttaacaagatgtgtccaggttgatcagtatcatgatttatagtcctcctctggtatccgtgagggagagggagagaagggggtagatattgagtctgattcatttattgacatcattggaactttctggattgtttagtgtgcctatggtcagtcttaatcctagccttaatcctgaacttttcaagtacttgaagcaataaattctatttttgcttaagctaattcgtattaggtctctgttcattaattcttttgtacaaaatttcgaaggaacggaaaatttaatgcattaaactacacataaagtttggtagatattttcccccaaaatactatatcttgttctttctcctgtatccctcatctgttctaggtaatcaactaatagttttttatgaataagaattaaatgtttctactttttattgaaagatttcagattactgaaaatgtgacaaaaaatttctaaaataagcatagatgttccttctatgaaaaaagtactgacaatttatctgttgttaaatcatcaatatattgtaccagataccattatttactccctattgacttgttgaagtttaactaaattaactatacttaatccatttctaccctaaacatttatttgaaatcattactacattttaaaacagttgcttgatacaaaagtattttctccatataaataagggatacctttaaattgtttacatttgtaaagtacaatatgtaaacagaattttgaataaattaagaatattttcactgtactacctaaaagcaaacaaacaaacaaaacaaaacaaaacaaaaaacctcaaacgcttctcagacttgcagtttgagctaaataaaccttctttattttggtgtatcactgacagctctgagttgactccaggacaattagaaagaaatttccgtaatacatataatttcctaaggtacaaattttgaagtaaataatggatgccacaaatgtaagttggtcacttatttcttttttctcttgtccattatcttcagatgtgtaatcatttgcaaatatatttactttcaagaaaagccctttttattttactgcttattattactgccactaaataatattattgtttatagggctgtgttctatgctttaaatgcattattatacttaattttccaaacatacatgtaagacagatggaggagattgggagtaccgagagaatgaaaggtgaggctgaatccatagtgtttgcagtatccagataggtgaagtaagaggtgaagtgtcttcatgtgagaaagaattggtgtacttttcagagaaacaaaggctttcttacaggaaaaataagccacagttatagttgcatcatttgtcaagagatttctaaagaatctttcaagataggaaatgagagaaagagaaagaaaggagattatgttttttctatgggagcctgtaaattgaactgaaatgaacagtccataaacagaatggaatatctagggtctggatcctagttccaggcagcttatcacctgctcccaggcagcagaagaacctgaactattccagtgaggaaacaatgctttcactcttgacagtcttccctaaacagtagcaaaaacttcctttcagaaattgaccatgatatcctcaaagttttggtatcaaaaggttttttatctaatgtctcatctgaaaaggttgaagatcacagaaaaatttgagtacagaaatatgtttacaatattactcatcagaaaacatatctatagaggctaaaggggttatgttctgctgctttgcaaaactcagagaagctgagtgggaaggcaaagagttcagatcctaaaatgaaaatttgtaaatcgggaggaagtgtatggctgaacaattcatattaaaatgtatcatgaggccaaactttttaatagtaatctattcatgtcctatatgtaaactctttactatattagtgcttagagcataatttgggcttaatgcatatagattgattgagtgactgaaaagataaatgggaaaaatagaagaatacttttttattctctttctgaacttttgtcattaaaatgtgtatttatttcttatgttcccactgtctttaaaatagcatttctttaaagatgattcatttgaggccacttgtaataggacaaaataagcaattgatgactgatgtgcttattaatggcctcgggtgtcacagaaaacaactgaggcttcaggcaattcatctttaatggcattaatgataccttttgaaggtgtgattactactataaaccagagtcagttgtttatttcaatttattcttcagtatgagctacaaaaaattatgaactgaaaacaatactttagaaaggcagatactcttaaaattagcaaatagctttgctaaattataatataggtcattactgaaaaacacagatgtaaaattccacttcaaagaaggtactttattttccttttccttctagtttaataggagaaataagagattcttgcatcattttaacaaatcaaaatgcaattattcatagaagaaaagcaacatgttaatctttcttaaatttcttaaatgagtacttttggaaatgaaaatgaaattatattagcaaaaatttaattagcacatgtggtgaaagattttatatgattcagttagtagatttggtcaatttatgctaattggcaagtaatacaatagaatcaaattatgtatcatcagaataaagaggaataaacattacaataacatttttcaagtatactttccaaaaggtcatttttaaagaattcgccccttctgaacagcacatactatgttcgctgggagctgaaagagtgtgtcagaattatctggcacttaaacaccagcaaggtgtctggaataactttctcacaagaacacggtgtaaatatcatttttcttctgtttgattattttgaaaaacatgcatacttcatgtgaactatagtgaagtgtctgattatccaaagaaaaagccaatatttgaaaaggtgttattcacaatagagccaaaatagaaacagggtaaaattttgatggaataagtggtagggatgaaggaagagcacagagactatgcttgcatttaaaggcaaagcatacagtaattataactatatttctaggtgaagaagctgtggatgactagtatatttttctccacaagatatctataaagaccattgtttggcttgtattaacatttttgtttgcataatctgacttgggcaagatatgtataagaaatgcttagctataaaacaatagactaacactgggagagtatgggtgatggagtcctctgggttacacggcatgctgtggcatagtgtcctcagctgcaaattagagatgatgatcgtaaccaatttctaggagtgttgagattaaataagctagtacacgtaaatcacttagtatagactcaggaaatgttagctcttaatattttgactctactgacttttttcgtttatttttcctcaacaaagaggacatctttaaagatttgttcattgtccttatgtgtgtgtgtgtgagagacacgatatacacctgtccttttgagcaagagtcaaattctcattgaggtcaaggtgtaatttgtagttcaattccttattcgtaaccattgaatgtggctctgccacaccaaggtaaacgtcttgctgtctccattatgtgcttgggttacaggttgattacacgtgatctatgataatctacaatctatagtctacactactatagtgttgttgtttttttaaaattatttccttgcctaaaagttctatttcaaagttgcaatactgcaccataggtttccctctactttctgtgtaacaagatgagaaaaaacaaaagagggaggagtggggaaatggataagataaacaaggatttttagtttccaaagaaactaaaaaagtcattatagaattaaaatatgcgctaatggcgataaagagtagaatggaactgtttgtgtatttgctttgtggctttctatattttccaaatgttttgatttactatctcagaatagacttagataataaaagtaacaaaaagaaaatgagatttttttaaaatatcttcacaatgatataaaaatatcaagtaattctgcataatctaatggatgtgttagttctctaggggaaaaagtataaaacttaatgagagatataaaagatcgaaataaatagatgaagtgtgatcatggattggaaaactgaacattttaatgatgttactcttccaaaattgatctgtagagtaaatgaaatagcagtctaaattctaacaggcttttctttggtgaaaataaataagctggttctaaactgtagatggaaaagcctagggccaagactagccaaaacattctagaagaagaacatggaagaaatctttctaccatacataaaagcttattgtaaagaaagaatcataatgaaagtgtaatttggcgtaagaataaacacataaattaatggaatagaatagaggactcaaaaattgatatatgcatttataaatgctagatttataaccaaggtagtgacaaagagtagctacagtaaaaataactatgttttaataaatgaggctgagatgaatcggtgtacatttgaaaaaatgaaattggcctgttgcatcacaccatatacaaaaagcaattcttggttgatgacagattgatgtgaaaagtgaaaccataaagcttttagaagataatataggaaaaatcttaataacctcaggttagaacatacttttacacacaaaaaagcacacatcataaggaaaagaactgaagaactgtgcatgaaaagatgctacaaataaagtagagaggaaagctatagaattaaagatattagcaacatataactctgacaaagaactctcatccctaagggggctgaatgagcctttgtggttgattcgtgggtgacatttctaaggcagggaggctacagctgcaagaacaaagtgcctttctattttgttaggccagtggatttgctttgcttcttgttggccttccacatagaggccacaggggcattgtacatagttgaaatttcgttcacattctgacattatatagggtttcatttctcctttgcagtgctgtggttttcattttttctttgtgtcttcatatgtgttttaggcaggatttgaagttgtctggctcaaacttcaagtcagatgcggtcttaaccctttttttttctgttcctaaaatctttttgtaatctttactgtagaattcttaatgttgacataaatttatgaatttgatatattttgtgttttcctatattctctgaaaattatatcacaatattcttctgtattgaaagatagtcctatataatatttctaattgaataattacaatttctttgttcaggttgtaagctaactaatttaccattcccttatcctggggcattttagattccctttttcataaagacaaaaaaaatttcagtgagagacttcttgaataaaacttacaagccataaaattatattttagataagttctctggagtaagataactaggtcaatgtgtataagtaattgtatgcttttaaaatatcttgtaattggccaggcatggtggctcacacctgtaatcccagcactttgggaggccaaggcgggtggatcacgaggtcaggaattcaagaccagcctgaccaacatagtgaaattgcgtctctactaaaaatacaaaaaccagcctggcatggcgcctgtaatcccagctactcgggaggctgaggcaggagaatcacttaaacccgggagttggaggttgcagtgagccgagatcgtgccacagcagagtgacactttgtctaaaaaaaaaaatatatatatataatatatatattattctctctctcgctatatatatatatatatatatatatatatatatatatacacacacaaaaaaaaaaccacaaaagaggtgatttttttccttttgccttgtttctcaactcacagagttgcacagctgcacagttccagtacgtgaattgacttctactttaatttatcatacctgattcagtaagtgattctgtaacctttactttcaaacatctctgacaccattgccttctttcttctccattgtcaccttcctccccagtgaacagaggcagcagtaacctaactggactctagccttgcactgaatccttcttctagcctcagactacttcacattgcctttagagacatctcccacatacagtcataaccatgtcattccacaccctaaaaactccaacggttctcacacaaaatagagccagtccttagcatgtcagaacttccacacttgattcagccacctcatcagagtcatatccacaccctctttgacctgtgatcacacaagtgaattagccattcccctaaaatgacttaattacaaaccatatcccaccacttatgagactgtgcacagtctctaccagattttcagactttctttaagaaagttatatcttaatcatatatgaataccctcatcttcaccaccccatgcctagcagaaggcctagcatgcataggatctttttagctataactaaaggactgaattgaactcaactggattgacggatgaacaatccttactcaaaagatattgaatgttcagtatttttttaatggaagtaatttatgctggtgcagaggtctctttatgacaagagcccatctgagattttgtaggaacacttagaaaaggatagaagtcttgttcattacagaaactgataacacaaactagttagttataactagaggtggtgacttacacctatagccctagcactttgggaggccaaggcggtcgatcacctgaggtcaggagtttgagaccagcccagccaacatggtgaaaccctgtctctagtaaaacaaaaacaaaaacaaaacaaaacaaaacaaaccttgaaattaaagataaatgtgctagaactagtcatcaacatatagtccaaaacaacaactaattctgctctctcaattttcaaactataaagaaactggactaccttctagaaacttccaatcccacataaattcaagccctaatctcttacctggactgtggcagtatactacctcttaactgatccccttccttcttctttgtactctccaaaatattttcagtgccccagtcagagtgatcctgttaaaacattagccagatcttgccccactctcttccagtctaaacttcctaatagcttcccattacactcagagtaataaacaaaaaattttttttaataatcaaccagaacctaaatgacttgattctcactacctcttaaacttcatctcctactaccttaactttcatttactgtgttccaatcatattgacctctttgctgttccctgaaaaatcacccacttccctacctcagcctctttgatttttgttgttttctctgcttggtacgttctcttctcagatatacacacaaccacttccttacttccttttgccatctaaaatttcgactcctcctgccacagtagttaataatgcccttttctgctttattttggtctcttggcacttaatgctatctggcagggtatagattttactcttatgcattgtctgcctcaccaatggagagtaagctccatgtggaaatgaatttttgtcatttttgtttattaatgatttcctgaaacctaggacagaacttaaggaatagcagggaattgattatgaagtcaataatgagcaaataagaaattccatggagaagaatttgctttttggttcactacatgacatagaatgagacagatatgacaacatggtttaaaatgtttaaaaactgagagggttaaaacaatagaatttcttgatggaaattgttatggactgaatgtttgtcccaccccacctccaaattcatgcattaaagcctagctctgtatttggagataaggcctttatggaggtaattaaggttaaatgaggtcataagggtagggacctgatctgctaggattagtcctcataagcagaaatgccggagagctcactggctccctgccatgtgaggacacagcaagaaggtggccatctgcacataagggagagagccctcaccaggaaccagattggatggcaccttgatgttggactttccagtctccagaactagaagaaataaatttccgttaagacacccaggttgtggtatcttgttacagcacctgaaggggactaagatagaaatgtaccttaaaactaatctaacctaagtctcttacttaaaggataagaaaactgaagccagagaagttaagtggctttctaaaggtcacaaagtcagtatataccagaactaaacccattaaccacgtggcagttcagtgctttctctacttactatgctgactcttataccactctatgtagtatatgattaacataaggcagacattcttaaaccttattctcatggaactctgttcttccaaaggctgtagcaggcattttgctattaaaagttaagggtgatggtcttttcacaatatcttatgggggtatttaactgatttttttcactacagttttcactacagttttgtgttttttgccaataaatttttcttttcctataaatacaaaagaaatatatatatatatttatatatatatttataaatatatttatatatatatttataaatatatatatttatatatatttataaatatatatatatttatatatatttataaatatatatatttatatatatttataaatatatatatatttatatatatttataaatatatatatttatatatatatttatatatatatatctgaagaaattctgaaccataattctctaaaagtaattctgtcctttggagatgtagtaggatggatacattaaatatgggtaaattttctgctggtacaattgatcctaattcaaatgacagaattaatgctactcagaattttattgtggggatcagaaaagtcaaaaagagtcccttgacttttcagagccctgcttcctggacttgtttgaaaggcactgatgtaacagcatgacacagctgctcaaaagctattatgagcctaggctgaatcaatagaagataagtgtgcaaatcacagagatctcagtccctctggacttggcactattagaacatgtgcatgttattatatctatctgttgtctattcctggatcctatctttaaggtgttactgactggcattcatgggtaatgttaaaggaatagggaatagtttgggaagtgatgacttaggggaataagaagctgttttcagaactttgaagggctgaaataatgagggaatggatttgttttgtattgtttcatgtgcaaaatcaagctctgtgcacaaacactgcagagaagtagtttttcactcaatataagaccaattagagttgttatccctggaactgttccctagtaaaagtaataaaatgtgttgaaaagtactagaaatgtaccagccatcaatccagaatatacagaggaaatcctgtttaggaagtgatttaaaacagttgatctcaaaaggctattacaacacaaagattctgcccttctatgaatacaaagaactggattatttattataacgaatatgttacaagcaagtgcaatggctgggttttttttttttttttcatgccttgtaaaggggaagagggtaaaggtagaaaggccctggatgactaaaatgaatgtaaaaggaaaaagaaaaaaaatgaatgaagaggaaaaaggaaaagaaactgtaaatgcacaatttgcctaagtcttggcctgtttttcaatgagaaactctgcactgagataaattctattcctggtggctgcccatgcacacacgtggattaatgccttggctgtcttaaaaagtcagctacagtctctgagaccctcaatttttacttagctgctgagatattcatgaatgctatataaaaggagaaagaaaaccattagaagaaatattttcaaggatgatatttcaaattattgcttatttaaataaatattgctaccttacattaaagagataataagatactaaaagcttgaaaattttttttgattctaagagcaggtagaacatacttatccttaaataacaccttttccttttaataacatctaagcaatgagatttttacctttttttcttggtggtttcttctttagtcatttgtttctttctttaatgagtccttcctaatgatgttttatttttcacacttttatctgttttctctttttattaatgcttatagtattcatttttatttttgtagtatattttattctttttctcttttgaaaagtcatacttgaataaagtacatgtctcaaaaaaagacaaggacttttgcattttatattgattccttaattttaaaatttttaggttaagaataattctgtactatccataagtattgctttatgatgactatgcttaagttgttggtatatgttataatatagcatttcaaccccaaatacagatttctgttctgtactcttgggaatttatggaggaggagaagacaaaatttaccttcttcaagtctaaaaattatcacatttgggacacataaatccccatgtatctctttaaggacagcatattatttttaaaattaaaatataaatgtctaaagtagagaaaaaataagttcaccttgtccttatatggaaattaaagatggttgcttaaagaataatttagaatggcaaatgtctgaaggtttgctgtaaattccctgagatcttatatgatgttcacaccgactcagacacatacaaatgtcatctctacagaacggccctgaagagagcaatcctgggagcccggttcccctgttgaggcccctacttgggtcagccctatagggcagcagcttgtacactgggccctgctccccttccctctcctactgacttcaattccattgttttttcaagacctttctaagtggcaggaataaaactgatgatttaatctataccaagacattaatgattaatagtggccccatatattttcccttacatttaatgtttgtattataagggctttttatgccttagctgaaagtggtggtaggaattttaggcccacatcatacacacatctgcaaataaccaatctttttctcatagctataattatgcattggcattttatttacttcctgcaatttctctaagtgcatcattttgttctatatatagtattttaaataatacatctttagcctgatgtatttttgaaatatttgtggatgctaatcctatctctgtcacagagcttatttatacacacacatctttctcctcctgccttaaaccccttggtttattcttcccttgttccagtttactctcctatggaactttttaccatttgatgagatatttttaaggaatttgcagataataggagcttccagaataccttcacctgactcatgcttcggcataaagtccccatattatcccaaaactcatctacatgtttagttttcaattttcttatagccttttgattacagtgccactgaaaatatgtcatatttattgctttatccactgctttctgaacatagacagagacactgtaatatttttctaatactttggaataaaaagaagatagattatttgttgaataaatatgtaaatactaaaacacaagttactttcttgtcatcatgctatagtcttcatatgctttacacagagtatgatttggggtaaaccctagtaaagctgaggaacatataaaatgttcaggaatcacattctggaataatcatttaatgtttatgccatgctaaaagagttgggactattatctgtggaattaaaatttggagaaaagaaatggtaagattagcccactgattgataagccagaggtagcacctgtagtttcatggaggccacagctcagtgatacctcggtccctgaactggaaaataaagctaagcttccatttgcagatgttccagaaaaaaataaattttatatttgtgtttttactgtatttttggtagagacggggtttcaccatgttggccaggctggtcttgaactcctgacctcataatctgcctgccttggtctcccaaagtgctgggattacaggcctgagccaccgcgcccggcctggaaagaaagaaattttatgaaatcaaaggagctgctatatctttttcttttgtaacaaacataggaattttcttactggaacaaacccatagttgacctcttatagtactctatgtgtggaagggagaaaacattggtacttctacaaatgggtttcaccaccttttataataaaaacagaagatattcacaaaaatagctaaaaataaggctagcatgagaaatacacaaattactctttttctattatgaaattagcatgcaatctttttttttgtaagcaatccaaccatttcaaagagggtgtaccctccagataatagtgaataaaaaattcagtgaaagaaagtaagcttatagctgctataattttcagaaccattatgcatcctcttgcagctggttttgttggtgctgctaagcgcatcctcctgggcccatccacttagtatttatgggcatcaactaaggattgaagacgggagattagaataaatgtaaatcttagtggatataagatttttgatgaaaatgtttaaacggtacttgtatgccacacaagaccaatggcaattttcatgttggtcgtaatgtttataaatttaggtatataaatgaaggagaaacgtagagtagaagaaaaaaagatctctgtctttacatataaaagggctgaaacaaataattactctttatgctttgtcagatggtttatagtttattatgatcaatgtaatctcattttttcaagctgttttttagcaatcccgaagtgcaggaagatacacgctgttgcaaaactgttaaatgactgaatcaggactccaagccatgttttctgacttcaagacctgtatttaaattcctatagtattcttggaaaatactagactcagggatgttttcacagagtaatatgttttgaaaaatgtgtctgcgaaactgccttaaaacttgctatctcctgcaagtcatctggagttcaccagaagtctaccttttcaactagtttccttatataggaattttaaaaagtgagcagaaaagcatcacactttacttttgagaaatgtgaggcctccttgaaagcataatctattcccttttaacaaatacatagctcacagtaatgcagagtatgagactaggtagagtgattttagatgtagttatttttcctatttccttatgccacaaaatcattttttcacataccttgtgtaattcctgtgaatgattttcaagggatcttttggcatgtacaattatttatcatcaaatatttgtaaatgaaagttctagaggatgagacagaatatagacagctaatcttacgactgctctgaatgacaggcacagaggcaacacagacatttctgaaggagcaaaatgtcagtctgcaaaattgcctttcctagtttgatattggtcctcactgctcagaaatgaaaacggaaaacattcacgaggcattctagtataattgccagtggctgcttcactatatacagttaattagtatatgcatccatacttttaaaaagcaatacttttacattaacaaaccaattgttaatttaaaaattaacaggttttttttaaagttttaatattataagaatatttctgaggtcagtatttatacctctacagatctacatctagccacagaaaatccaaaatataatttactttggaaataaagtttcccatctgctggtccttaagagtaattgctggtttcactttgaattatcaaaatgacattcaggaccaaaaaataagaggcatgaaactactttcattgctactgtcagcaagtgaatgattcactttgaatttgcctgaagttgtcttacagaacacctgtccaagctcattccggttccccttttgacgcttttcttcactcctctcctagcaaataaatagggtttcttagtctaacacaaggaatagaagtataagaagtggggtctgctagtaataaggcttcaggtatgtgccttaggaagtgttttgtttgtttgttgaatgtgaaagacttagccaggaagggagaataccatttgcatgtataattttccaggttctgtttaaaacaggtattcttttttctacttccaagtgaggagacaggttcctctgaatagagaaatcctacactctgcttaatatcactttctgggacaaatttggttcttatagttctccagtggttacagaatatcaaatgcagcaaggaccctggagcttcagtaactattggtaacttattagttgcctcttttgccaagataatggcaaaaaggaaataatgaaaatgacatatttttatatttctgtatggcagtgctgatattttcttagatcatttttctaatattagaggagctctttatgttgccttatgactgctgacatttcatttacttaataaaatcaagttagcagtagactgttgtagaaaggtagctggacactaagtagaagaactgggctcaagtctcagatttgtcccttttgcctgtggtaatggcaaataagtcacctaactccctggggcttacactgctcacccttgagaaaaagagattggacttgcagcttttacagtggcagtggacatggctagagcttggatagtgctgacggggttcaggaaatactaaggaggatgaagctttgcagatggtaaaattattaatctatgcaatcttcagttatggcatcacctgaagactctcagaatctccagttctatacttaatgaatgactttgaagaggaggatctatcaaaagactggatccctctgcatattgtttacaatcaggttagaacttagattaaatctcaaggaaaacaagactcctaaaagcttactagtcaaggaagcctttcatgcacctgatagaatcctccattcaggccgggcgcggtggctcacgccggtaatcccagcactttgggaggctgaggcgggcggatcacgaggtcaggagatcgagaccatcctggctaacacggtgaaaccccgtctctactacaaatacaaaaaattagctgggcgtggcggcgggcgcctgtagtcccagctactcgggaggctgaggcaggagaatggcgtgaacccaggaggcgaagcttgcagtgagcggagacagcgccactgcactccagcctgggcgacagagcaagattccgtttaaaaaaaaaaaaaaaaaatcctccatcaaagttggggtgactatgaagtagaatctctaaagggggccaggatgttgattttgttccagtgcgtgtctaatacccaatcagaagattatagacatctatctcaccatttgagtaaatgcaaaataaaaataaattactacgaaacatttgaaagttagtgaataaaataggttgaattcagtaagtgctaaggtcatttctaggttcaaatatttttgcaaaatcaggaaggtgcaaaggcaaagcacaagcgtgctaacagcaaatgtgaaaagtatgtcttgcagccaaggcattctatttgtattttgcctgtgtcttagtccattagggctgctacaacaaaataccttaaaatgggtaatttataaataatagaaatgtattgctcattgtttgggaggctgggaagtccaaaagcaaggtgccagcagattgggtgtctggtgggaagccactctctactttacagatagttccttcttgcagcatcctcacatagcggaagtggtaaagaagctctctcaggcctcttatataaaataagcactaatcgcattcttgagggtggaatcctaatgaccaaattacctctgaaaggtcccaacacttaataccattgcattaggggttcagtctcaatgtataaattttgaggggacacaaaaatttagaccacagcagcctgtttatgtcatttcctctgaaccataatcattgctccacccgctaattttactctctctctcctctgccttctcagctatctacaatcaggttgtatagtaactatttatgtgctaatcatctgtgattgtcaccttagggtataatcaagaaaatgatgcataatgttgggaaataatactgcagtttaaatcatatccatattatatttttaagcaaattaagaaatttgaaaccatgtaattagaagcagtatcttcttatctctaaatattcaaagtatggacagtgccaggtacattcacagccattctaatatttgccaaatgaagcaagcctttttcaaatgaaataacgtagttttcacttaaacaatccctagtgtgaaatcaagaaaataatgcataatgttggaaattaatactgaaatctaaattatatcaatattgtatgttttaggtaagttgggaattgtgtgcccatgtaattagcgagttcataaaattatattttaactgcttttccttcaaattgtaggcttttctgagagtttagttgctattgttgttttgtcttcattgttgtttgtgaatttgcaagcacattttaagttttccatttaagaataagttgtatagaaatttaatagacttactacaggtgtccatattacccaagcctctgggctgtttggttctctccaaatagaatgttgagatcaaaatcctttttggtgcttatattagttttctaggactgatgccacaaagtgccacaaactgggtgccttaaacaacagaagtttgtcacctcacagttctggaggccagaaatttgagatcaagatgaccacaagtttcgtttattgctatagacaaaatgtgtcatcccaaaatttgcatgttaaaatcttaacattcaatgtgatgatattaagaagttgggctttgggaggtgattaggtcttgagagtgaagccctcataaatgggattagtgcccttataaaagagaccccagagagttccttctcccctttttgccatgaaaagacacagcaagaaggctgctgtctgtgcaacagtaagcatgccttcaccagacactgaatttactagcagctgtaacttcaacttcccagcctccaaaactgtaagaaataaatttctatagtttgcaagccacccagtttatggtatctttctacagcaacatgaatggactaagacattcctcctgagactaagagaggatctgttccatgcctctctcctggctcctggtttgctgggagcccttagagttccttgatttgtagatgcatcacttcaatctctgcctttgtgttcacatggaattctctctttgtgcatgtctctgggtccagatatcccctttttataaggacagcagccatattggattatagctcaccctgaagggctcgtcctaactacatttgcaatgacctgatttccaaacaaggtcatattttgagatatttgggattagaacttcaacgtaaaaatttttggaagacactattcaacccataacaatgctcatttgttaagataaaaccaaacaaaaaagaacattttaaaacacaaagattatcttcatagccctctacaaactaaaaacatatatatatatatatatatatatatgtaacatataataacatataaaagcataaaaatatatacaggtttctcagacatacacattctcttaatattctgggctctggactaatatatatatatatatatatatatatatatatatatatatatatatatatatatatgagtttttttgagtgcaaagagcttgggtgagcagagtgggaaatgagatgaaagaggtaaaagggtcttggttttaggaggatgggaaaccactgaaggttttccagtaattgaaggttttccagtagacatttgacatcatcggatttgtgtttttttatatatataaatatatatgctgattgcaatgttagaactgataaaagccaggcttaagtgattggcagactgtggtagaagacagctgggagctggcagctggactgtgctgcagtggtggtggtggttgttgataaaaaccatcaccttcagtagctatgtgttgggtaaaatgaacacgatattgtgatgcagtggctgtgggaagagggcaggggaaacaccagggacgattcccactttcttatccacaatgccaagagagaaaacactggatacagaccagttttgtggagaaaaccatgattttatatttgcaaatataacactggagttggatgtggctttgtgagactccagtgcacatagcaagtaggcaattgtatgcttccatctggagctcaagaggaggtcttgatgagacataaattttgaggttgtctatgtacagttgatggaaacctgggtgtgggaaagttgtcaccttcagagagaaaatagaatgaaacaggaagagtggctaaaaataatctttaagacacttcaacatctagcttctaggcagaataacacacttcaaactcaggaagctctggactcaggaaagccaagagaagaggatggctcaggagggaagggggagctgagtgttgctgagaggcccaataagatgagagccaaaggagccagtgaactttgtaatatggagcttcttggtgccctaaaacttactatttggtagaataataggtgggaaagccagaacaaagtaggttgaagagggaccaggaaggacaaaaatggtgaaagcaagaatagggtaaataagcgaaccagctagaaaatataggaggctgtgataagagttggggatgcttgaattagagattttggagctggaaaaaagtgtaataacaatgacatatagtaaagatatacagatgaagatggattaagcagctgaagttaaaaaaagattattaaaaacaataagctacagactgggtgcagtggctcatgcctgtaatcccagcactttgggagtccaaggcatatggatcacctgaggtcaggagtttgagaccagcctagccaacatggtgaaaccccatctctactaaaaatacaaaaattagccaggtgtagtggtgcagggctgtagtcctagctacttggaaggctgaggcaggagaatcacctgaacccaggatggggaggttgcaatgagccaagatcgtgccaccgcactccacccttggtgatagagtgagactctgtctcaaaaagaaagaaaagaaaggccaggcacggtggctcatgcctgtaatccccacactttggaaggctgaggcgggtggatcatgaggtcaagaggtcgagaccatcctggccaacatggtgaaaccccgtctctactaaaaatacaaaaattagctggcgcatgcccagctactcgggaggctgaggcagaagaatcacttgaacccagaggtggaggttgcagtgagccaagattgcaccactgcactccagcctgggcgacacagtgagaaaatgcaatgagatacaaaattagaaatcatattctcagatgagtggcatgcatactctaggatgggcaggtcctcaccagacccaaagactctcaacagtgaggagggggtctgggaggttggagatgacagcaagatggagactgagaggatgatgtgccggatggcatgagcctcacaactgtgacctttatacaagggcttgaggagatcaggcatgactagaaacttaagcctcagttccacccacaaacctggactgctggggatggcagagagaggcagccaccctttgaaaagcctgcagaggaagcagcagcgtggggagtgcagttagtacagagtgggagggaagacttgcaagggagatatttgagagaactcttaagatttttggaatggatttcagaaagcactgtggaggcctggcacattggcacatgcctgtaatcacaacactttgggaggctgaggctggaggatcacttgaggccaggagttcaagaccagcctgggccacactgcaagacctccatctatacataaaatttaaaaattagccaggcatggtagcatgtaactgtagtccctgctactcatgaaactgaggtgggaggatatgtggagcccaggatttcaaggctgcagtgagctatgatcatgccactgaactccaggctggacaacaggccactatcctgtctcgaagaaggaaagaagggagggagggaggaagggagggaaaaagagagagagagagagaagacaagacaagacaagacagtagaaagatttcaagagttgttgggcatcagagaagtacagggctgatgatgggaatagtgatgcatatggtagagaatgaatacctgaatacctgcaggtgtgcgctttcacttcagtattacaccatgaaaatgggattgcaaagcatgtaaacatcagcactggtactgcagatggctggagaatgcatcccactcagctggggtggatgtggtcccaggagtcccaggcaatttggtatgatgtgggtgcttcagtatcagccaggtacagctcacaggatatgtctaaaggagcaactgaatttttcagacagatttgtagacccaattttgtaaatatcactttcatggaaaagtggggagaggtgacacaaagtcaaatcaaatattaattctgtttgaagcgattccaaaatagtcattgtataccacatggttagaatcattaattaatggcttaaattattcattatttttagctgtttttgtattctgtagttatagcctagagctgtactttaacaaaaagcaacaatatttacctatgtgaagtagttatgagtatgaggaggtaattttttaaggtgcttagaaaacaggtttgtaaaatagcagacttttaacaagcaaagaaaatcagtgctgagaaagctagttagtaacatctcattagtaagacttttttcattttataataattaattaggcagccacattaggcaataatgagagctagtaatcacttttttattatggaaattagactggactcattttaaaacaacacttaatgcatatgctgtaatgaatatggaaaagtataagttgcttaagcaaaatgtataagattttgtactcctcccacaaaaataagtgactaaagatgggttgaaaagcagagttacttttctcaacttgtggattgtggaagtacattctctttgtattcttgaaggactgagtttataaggtggactgattttgtattctttgggatagtattattctggacaggatgcatttcattttcttaatcctttgccactagaaatgcaacagaggttattaactcttgttatttgtgcagaatcttggatcacttaaattatttgctgcatatttaagagactcacaactaaatgtagagttttaaacatctactggagtatagattgctctcaagttgtcaatttgatgaatcctaaactgtcctagtcaaattttgcactcctctgaagaccttaaagaggtaacttttgtaagaagcagaatgtataactttaccttctgagaaattagacaattgcaatatgaccttttcaggcatagtggggtgtggcttgaatgcttgaatgtttgttcttaccacttattttccagataagctaacaaatacttagagaaatcaagatgctcaaccagagtcccacacagagaccatacttcagtgatgtttatgctctttgttgctcaaagtcatgccagaatatcttcactgttaatggcactgtaggtccttatcttcattccctaggccttacataccttctatatgcaaatgacatcaaaatttatctctcacaccatcctctttcctgagctgaagacttgtattttcaacttgctatttaatagctcccttcagaaacctcatcagcatctcgatactggcatggcctgacctgcctccaacccccctcatcatcttggtggatgcagcggtgacgcagccagttgctgatgcaaaaaatcccaaaaatcccaggaacctctttccgttctcttactcccacacctcatggagaccctcatgaatcatccagtaggatatactttttttttctttttcttttttttttttttttttttttgagacagtgtcttgctctgtcagccaggctggagtaaagtggtgtgatcttggctcactgcaacctctgcctcctgggctcaagaaattctcctgcctcagcctcccaagtagctgggattacaggcatgcatcaccatgcctggctaatttttttatatttttagtagggaaggggtttcaccatgttggccaggctggtctcaaactcctgacctcaagtgatctgcccgcctcggcctcccaaagtgctgggattacaggcgtgagccaccacgcccggcccaatagagtacactttaacattagaaacgaagtcctatcgttgccaactttaagacctaccctatatctaacttctcaccactatccaaaccacaaacaacctttcacttcctccactgcagtcacttcttggctggtcgttctatttactacatggcagaatattttattttctaaaatacaaatccagtctccccactgctcacaattctctggcatcttcttatcactcttaggatgaaactgtgactcctccccagtcttacccatgactcctctgctttgcccagacatccagccacacaggtgaatgtactgacagcttccaagctcttacctttgccccttgtgatggttaatattgagtgtcaacttgattggattgaagtatgcaaagtattgcttctgggtgtttctagaagagattaacatttgagtcagtggactgggagcgaaagtctcccagtgtgtgggcaccatctattggctgctagcagggcaagaaaaagcaggcggaaggaggtggaaggtgttgacttgctgagtcttctggtcttcatctttctcccatgctggatgcttcctgcccttgaacatcagattccaagttcttcagcttttgcactcttggacttacatcagcagtttgccaggctctcgggcctttagccacaaaccgaaggctgttctgtcggctttcctacttttgaagtctgggactgggactgagccactattggcttccttgctcctcagcttgcagaaagcctattgtgggacttcaccttgtgattgtgtgagtcaatactccttaataaactctttttcatatatacatatatcctattagttctgtccctctagagaaccctgacctactatacccttatttctgcctagaaggttctttccccaaatctttagttgtcatgtctgtttatcattcagcttcccgcttaaatgtcacctactaggaagagccttcctcaactgtcctgtgtcagaaagtccaccacccaccccagcacccctccagccctgctcactttcttcaacatatatatcactatccgaaagtattgattcatttccctatttattttctgtctttctttccaaaatgtgggcaggaggagcttggctttgcttactactgtctccttaatgcctgcatagaggaacagagttcagtaagtatttgtcgaatgaagaatagtgatacacttcttcctataatttgatttttaacctctggagattatcaattggctcacctccctgctaaaaggaaacctgatttattgtaataaccctacgttctctacgctactctatccccaaaactctgctaatcatattatttccatgttgttataattaatgttacttttatcccattttataacttgaatttcacagttgtttagatgctattctatgtttgcatggattcaatattcgccatcatttctctactgtgtcttccttatccatctcatggttgactgtagtttactatttaataactttttaaagaaatgctcgtgagagttaaagtccgagaacacttgtttgttgggtaatataaaccctccacctatgtggcagtttttatgggcatggtcattattggatcataacttccacctctgagcattttgcagacgttccacatctcctaggactgatctctggatacccacagaaatatttgctcttctttttcgataaatttcctgtaatattctcatttttaccaaagcctacaagtattccttggaagtttctactttcagcaaattcagttctctcttgtaaagttacttttctattacattattatttttaaaatgtcatctgttatttctagttgcacgttttgtctttcattatttttgtctctttactaatattaatcaactttttgtccttttccattttattttgttcatttttttctcatttgtcctagatgcctctgatgacattttcagtaaagccagtttctcctcttgctgattttcatttctgtgttgattttttcccttccatttctttccaaaatctatcagttcacttttcaactacctccattgtcctataatatcttacctgggagcttctagaccttctttgggctcctgttacttacatgacatatagtcatacattttatctgatttgtcatacctcttgtttgatatatatagtctttctctggccttctgtttgctgtctctctctctctttttttttttttttttcatttaggtagtatctttgcataggtctcatgctttctttttggtatttactcatcactgaataagggaactaattcggttatgaagataaaaaccagctatttgcactaggagagtataaggaagggacaaggatagtaacccaggacaatgcaacacagtttgcactgtactctgatgtcttcagcatactcatgcatcctctgccccagacataaatgtgccctcagctagcaggaaaactccctgtgaagctgtgagatgcccattgtgggtttcctctgtactcattgagctcttacttctcttcagttggcaaaaagaggtaacttcaggaacatgcgccatacacatgttcttctctacgtggccacatggacaagtcaggcttcagcgaaaggacacggatgtcatttcctcatcaagtctcctcttccccactgctccgtgttgcctgccattccgggcatagagcggcttggcccagaaaccacacaaatgggccttgttgttccaaggtgggtctcctagtgtttcccctaagggcaccacctaattagaagcattctttgcttggtcagctctgcctaagttctacaggggatgtggtcctctctctgtgccccttcacctgcagccttgctctcagaatctttctccacgtattatagtatattattcaggcatttccaaataaagacagagtttcttttttaataacaactttatgaagatacaattcaccactgttaattataccatttaatgctgttagtatagtcacggtgttgtgcaactatcaccacaatcaattttagaatcgtttcagtaaccgaaaagaaaccccatacccatgaataaccattttctatctccgccaacttctcagccctaagcaaccactttctgtatctatggatttacctatcttagactttgcatataaatggaatcattgcaatatgtggcattttgtgtcttgcttctttcacttagcataatgtttttgaagtcaatccacgttgtagtgtgtgtgtgtgtgtgtatatatatatatcttagtacttcattccttttattgctgaataatatatctcattgtatgactatgccacgttttatttataatttatcaactgaaggacaattgagtttacatttttgcctgttattaataatgcttctatgaccattcatctacaagtatttctgtagatatatgcttttaattttcttcatatatattgatgagttgaattgctgggctatattgtaacagtatgtgtagcctttgaggaactgccagactgtttttcaaagcagctgcaccattttacatccccatcaacagtgtataaaggtttccatttcctcatattcttggcaacatatgttattgtccatcttttttattatggccatcctactccaggtgaagtaataattcagggttttgatgttaatttccctgatgactaatgatgggcatcttttcatgtgtttatcggccatttgtttatcttacttggagcaagtcttattttgattttttgcccacattttaattgaattattaatcttctttattaatgagttgtaagagttatttacatattctggttttatcaggtatatggttttcaaaaaatttatcatctgtgtgttgtctttttacattattaacagtatcttttgacgcccaaatattttaattttgataatattcaatttatttattttcttactttgttgcttgtgcttaagtatcatatctaagaaaccatttctaattcaaagacatgaagacttactacacctatgttttcatctaagaatttaatagttttagcagttatgttcatgtctttaatccacttgaattaattttgtatatggtgtgagataggggtcaaactttatacttttgcatgtgtataccaggtgtagcagcttcatttattgaaaaatactgctttttccccattgaattgtttggcactctggctgaaaatcagttgaccataactctgagagtatatttctatttaattgatctatatatctatttttatgccaataccacactgccttgattactatagctttgcagtttttgaaattggaaagtgtgagtcctccaactgtgtttttctattttaagatgcttttggctgttctgagtcccttgaattttcacatgaaatttaagatcagcttgtcaatttctacaaagaaatcaggtggggatttaatacaggttgcattaaatcagacctcaagttagggagaagtcccatataaacaatattaagtcttttgatctatgaatatgtgatgtgttttcattcattcagatttttgctttctttcaacaatgtttgacagtttttaaagtataggtttgtgccctttttgctatatttagtcctcagtattttattatctttgatgctgttgtaaatggaattttctcttagttttatatttagattatttattgcaagtgtatacaaataaaattggttattctatatggatcttttattctgcaactttgctaatttttagttataatagtttttagtggattccttatgatgttttatatacaagatcctgttatctttagataaataattttaattcttcttttataatctggatgtatttaatttatttttcttgcctaattgccatgactagaacctcctataaaattttaaattgaagtgataagcacatacatccttgtcttgttcctgattttagggggaaggtattcagtctttcaccattaagtatgatattagctgtggttattttctaggtgtccttcaccaggatgaagacatttccttctatttctaacttgttgagtgtttctatcattaaagggtgttgaatttagtcaaatgctttttctgtatttattgagatgttcatatggttttagttctattccatgaatatggtatattagagtcaccggttttcagatgttaaaccaatcttatacattcattttattcatgagatatgatccttttcatatattcctgggtttgatttgctagcatttcattgaagttttttataccacaattcataagagatttcagtatgatttttttctggtgatgtctttttctcgtttcagcatgagggtaataatagcctcatagaatgaatagggatacctccttttctatgttacgagtttgttttgcagaaatcaccagtgaagcttgtacttttctttatgggtagttttttttttaaaaacaattaattcaatcttatttgttaaaggccgttaatatattctatttctttctgggtcagttttggtagtttgtatttttttaggaatttgtcctttgcatcttgtttaatttgttggcatatattagttcatagtttcccttatcatcttttttatttctgtaaagttcgtagtaataccccatatttcatttttgattttagtagtttgagtcttttccattttgttttcttggtgagtctagttcacagtttgtccattttattgatcttttcaaagaattagttttgattatgttaactatctctgttattttctataatttattttgtatatctccactctagcttttattattttcttccctattcttgcctagcatttagtttgctcctctttttttaatgacttcagatgctgtttgcatgacatgtgtttttccatcctgtcactttcaatctatctggtttctttgaatctaaagtgtatctcctgtaaacagcaaatagttgaatcttgttttttattttatccagtctcacaatttctgccttttaattagattgtttaatctattcacttttaatgtttttattgacatatttgtacttatatttgccattttactttttgtttcctatgtctcatgtcttttgtttctcaattgttttattactgctttcactgcattaactaaatattttctcctgtttgtcttttcatttctaattttatttgtcagctttcgttggtttcaggtgttcaggtggtaaggagaagcagagaagacattgctcttccattttaaattagaagttatctgtctaaggtcttcaagggcaaatatttcataatacttttctacccccatagtagatatgtgtgaggttcatcacaaatcctcctctcccaaacatcttttcagtttggttcagtgactgagtcattaggtgctagtaaagaaatctgggttttaattctagctctgttattaactagttgaatgatcatggaatattcatataacctctcttggacttattttctgacatataaaatgagagggttgaatttgattttatttaatttcccttttagcactgatatgctaaatttccagtaatactgtgatcatatggatctaaatacataagcacataagccaggcagagttaggcattttgcttcttgcaataggcaatcttatctacaactgattttgaagcataggatttaactagatccacaatatagtaaaataattatttggcccaaactactcactggccagtagcccacagattatccccttatgtgtaagagaccatgatttgagaatagaaggaaatacagactttgaagtgattacaaatataagctagtccaagatgcctcatgagaataaaagctttatgtggagtcctatatctatgtccaataatttgtttaaaggtattttgttagcaaatccattatccattgactgtctacagtgtgcatacctctcaagagtggcttatgtactataacaaaaacacaggagacccgctctaattggcctcattttaaaatgaaagggagaataaacacagtggcacctttaattattaatgacaattgaaggaagccttagcacaaataatcccaaagacatttctatttggcttggaattttaatattgtttttgacagatctatttacctaattatattttatctaggatagtgtttaaatgaggttctgtttgctaagcacttaccaacagagcagtagaagacatggctacaaagtgtattgcttatagcaggaagctggtccaggatttattaaaaaaaaaaaacataaaacatgttttgtgaattatccataacaaggaataccctcatgcagataatcaacaattgaatacgcataaaacacagatgacaaaaaaacaaggaagcttctctataaccaagcacagctgggcaaggatgcacagagatgctgcaggggattcatggggtgactggagtcgagacaattagtctgtaaaagcttcgtgctgatgccctcctgcagcacatttccttaacatctttaaaaatgcaccagtccagctgtttcatggagcatctcaggcttttaagacctccgtttttttgtctcattcattctctttattaccattaacaaagagtgggtcttagacagctgaatgttctacttacttaatgatcaagatcgtggagatagtttcaataatctaatggataaagaatccagaaatatcttaaagtttgtgttttcaggcttattctctgagtgtcagtccctctcaactagttcttacttagtcccaccctgataccatgctgtcaaattacttgctattaacttacaaatcacattctcctgttataattctcgttgagggaacatcagtgtcccccctaatttcacctacatggttacctttgtaaaaaaaactatctgagacacctgtgcttattcatgatactgtattatattgaatggttttagactttagtcttcctttagaaaaaattctcaacttaactttgtttcatgaatacctgtttacttctatatgttgcattttagattcccttcagaccaactaaatatgttcttattgaccatcaatgaaaaaaaaaggtatctaaaaatgggaagtatttaagacttgtactcagtcaaaccctacgtttgagggtttttaagctgtttgataacaaccatcctctgccagcatccccccaatatgtttcataaaatattacttacatggaattttaacagatattttgtcaaaataagttttagaaacacaaagtaaaataatttttttttacactttaggactcttggagctctggatagtataatgtgccttatgaatcttgaatagaggaatgtaatgtaatgcaatctcccaacatttttaatgcatatccattctgagaaatatcttttgtgtgatgttccagcataaattactaaaggtgaagagatacatatttgagctataaagactagatctttttttcctactttcattcccaaataatacaaaaactattcatcaaaatgttaacactaaaacaaatagattaaaaatttcaacataaactgaagaatatggtaatgacaccaagaagttatttaaatcttcagtatcaataattacccttcaaataacactatgttgctactctgagtacttttatattcgtgtctctatcgtggtaatacagccgtaacttgtcttcccacttagaccgaagaaaattaaactaaaaatgcgttagtagggcatatagataatgaataatgtgctcctttagaaaatattaaccatacttctgccaaatacattgttgtcacagtgcacggagaacttcatttcacaaggctttttgcaagattgatggtgtaacttgagtaggtttggcaaaaggagcatgcaaatttcagcaatataattacatcattttcccttatggataccacccaaccgagaaatagatccaatagtcagatgagaaattaaatacagtaccagctttattagtaggtcaattagcatagttttggctacaaggaacaaaaatcaccaaataaaactgacttaaaagtagggtaatttctcatctcaaataaaaagctgttcagaggtaagtttactccaggatgtcagggctctagagatacaactcagtgattctctgggtttttgtcctgtacgtaatggcttcatccttgcactggaagtgagatggctgtgttagctacagatgtaacatctagacatataaacattcagaggaaaaacagaaactccactcttacttaggagtaagaaaaccaaacctttccagtaaggctttcatgaatttccctctcattttattggctagaattgggtcacacactcattcctaaatcctgacaagggaaatggatttaccatgattgatttagacaaatcagactatcctggatgtagggataaaggtatcctctcttcagctactttagaggagtcgattttgggggaaggaaaaaggagagcagagaatgaacactgaacatagtaactgagagtgttcacactattacccagcacacagggtctctgatgaagtctaaccgtgttttcctccttgtttccctccatattgaatttatccaactagatcgcaggcaaagaagatggatgatggtaagcttgctgaagctcaccttctctcacctgcctacacatgcaaaagcagccagtgtaaaaccccaggccttcccataacccatgtgctacacagcaagagaaagaaggagagtttcaggcatgaaaataataagagaattctgcccttatctcagcagttctgtgagtcacttctcctcagggaagagcaattagaaggatagaaagaatggtagacatttacttcccagaatatattagcagagtttcctttttcttggtggaaactccaggaggaaagatgaagtttttctttttgggtaaaagatgaggtgaggggtagaggggaaagcacactagttttaggtgccatcaataatcctgtaggcattcatcctgcaatcatgtagtaaatcataacatttgtcatgcagggaggtaggtactggatgagcattgggaagaagacgtggtcccagctatggaactccaaattctgtgtctccaatgtgatatgggaagtaattataatatgtaagctatttgttatgtctacaaagcattgtaaaaatgtatattaaatttaaaaaaaaggcaagaaatctttttcctgttcagtagttccaaaaagactttaccaaataaatgaaattagtgcagaatttaggaagatgtatagattgtcattagtcaggctacaggaaggaaatcatttcaggcaaagacaagatcctgagtgaaggcccagatgcatgagagcagaaattgtcttccagaagctatgggtaaacctctatggttcaaatatggtgtctagagtgagacacattgctaaggcagaaaatcagcctgaaaggaagattgggtcaagttatcaagtttttttcacaccactcaatattatagttgaggcagaatactattttcctctctccttcctgatctttgccgttaaatctttcagtggaaattatacacagtatgatatatgcagtaagggaaatacttaacaggcctctgtcatgggcatttgtggatgagtacaaaagaaatagaagatacaaattcttcacacaataaatatatagtatgtgtcaaaattaaataagataataatataagacaatgaggcaatagtgccattgcttgtggcaatttttaaactccattttttgagccagtagtgccaaattttgtctatactcccaagtgtcagattcaatcattctgtcatcacatatttattatatgctgtgtgctggataaaaatcttcatcgttgagggaagatttgatttggggatccctcccaaagttatttgtatcaaagtcagctgaataaggtggctgatcatgataaggaatgccattatagactaagacccaactgcaaggaggaaatgagattttttttttgacctgtacactgtgaagcataaaataagaaccataaacttaaggccatttaaaaagagaattatagaaaagcattttaagcaaaggcagctcactttaaaaaaaaaaaagtgactaacttcccacaaagactcctttgaaggacacgcctcatttgggtgtatagatctccctacgtttgttgccatgagccttagtctatcatcatcatacctcaacttagcaagttctatagcatatggaggagacaaaattgcttcagccatttagacaagactgaaatcattgtgggcttccgtgattggaaaaggtctttaaaaagctttgaacccagcatggaccttcactgcaaatacagtcatgtgctgcataatgatgtttcataatgatggaccaataaatggtagtatcaaaatattataatgccatattactactgtactttttctatgtttagatatacacatagttactattttaccattgtgtcacatttgcctgcagtattcagtacagtaacatactgtacaggtttgcagcctagaagcaatgggctgtaccagatagcctaggtgagtagtaggctatcccatctaggtttgtgtaagtatgctctatgatggtcatacaatgacaacatcaactaacaacacatatctcagaacatatccccattgggaagtgacaaagtgactctactggaaaacaaaatatttcgtacaaagcctgggatgtgtgctctgtttattatcacctcaaagaagacttacaaattgggagaactaagatttgtaagagttctcaaacatagagagaatattatgtatcattattatatatcatgcatacattcgtgtatatttacttcttagaaacgtgtatcatgtatatgcatgttaaataggtatgtagtctttggcaacttctatgaagttttttttttttttttaatttttttttttttttattgatcattcttgggtgtttttcgcagagggggatttggcagggtcataggacaatagtggagggaaggtcggcagataaacaagtgaacaaaggtctctggttttcctaggcagagcaccctgcggccttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcatatgtttcagagagcacagggttgggggtaaggtcaccaatcaacaggatcccaagacagaagaatttatcttagtacagaacaaaatgaaaagtctcccatgtctacttctttctacacagacacggcaaccatccgatttctcaatcttttccccacccttcccccctttccattccacaaaaccgccattgtcatcatggcctgttctcaatgacctgctgggcacacctcccagacggggggggcggccgggcagaggggctcctcacttcccagtaggggcagccgggcagaggcgcccctcacctcctggacggggcggctggccgggcggggggctgacacccccacctccctcccggacggggtggctgccgggcggagacgctcctcacttcccggacagggtggctgccgggcggaggggctcctcacttctcagacggggcagttgccgggcggagggtctcctcacttctcagacggggcggccgggcagagacgctcctcacctcccagacggggtcgcggccgggcagaggcgctcctcacatcccagacggggcggcggggcagaggtgctccccacatctcagacgatgggcggccgggaagagacgctcctcacttcccagatgggatggcggccgggcagagacgctcctcactttccagactgggcagccaggcagaggggctcctcacatcccagacgatgggcggccaggcagagacactcctcacctcccagacggggtggcggccgggcagaggctgcaatctcggcactttgggaggccaaggcaggcggctgggaggtggaagttgtagcgagccgagatcaggccactgcactccagcctgggcaccattgagcactgagtgaaccagactccgtctgcaatcctggcacctcgggaggccgaggctggcggatcactcgcggttacgagctggagaccagcccggccaacacagcgaaaccccgtctccaccaaaaaagtacgaaaaccagtcaggcgtggcggcgcgcacctgcaatcgcaggcactcggcaggctgaggcaggagaatcaggcagggaggttgcagtgagccgagatggcagcagtacagtccagcttccgctcggcatcagagggagactgtggaaaggggagagggagagggagggggagggggagagggagagggagagggagagggagagggagagctctatgaagttttatcaacctgcacttttaaggtaacgtgtaggttaattttcacttctcaaaaccctcacttcagatagaaaaaataacttcggaaacagcaataataatagtaataattataataaatagtctaaataattgaaatgaaacctaataaacagacaaaggaaatgatacaaatggaataataatgaacaagagaaaaatttacgattgtgaaaattagattgtaaaatggctttagaggaaaagtactgtaattcacattcctacagttatttgagagaaagggaccaaaccagtttaaaaatgtttttactgagaatttaaaaacaccctttagaaatagaaattcagtttctgactttatttagcaaaaattaaccagcaaaaaccttatgccccccaaaatgtgacctctttctctgtggatagtccagtgtttttcagcctagagcctaattctgctcttgggggacagggtccatgaagcgcaaccctgtgttttgtattcatagaaatgcagccagcaaacttgggtattggatgaactgggcattgtgggtcactctgcccgtggacctgctggtggcaccgcagggaaaaggttagaaactgcatgttctctgccaggcagaggctctactcatgttcttctagggagtcttgccttgtcatttctaccagtcatagactgggagatttgctgaccttagagatagtaatatatttcaaacctcaagaggcaagaatgatatgaaacaaaggatatccctggatttcctctggggctgcgaaagggagtctccacctggctctggaaggctatgtcttgtttccatccactccatttaactcccacttcttggcctgctttgagactgtcagctgggggccaattactgccatttagagaagtggatgctttaatgtgaatacttgtctgcaggaaccacacagagacagctgccttatctcacaagaaccctgtgttgtttatactcagtaatctgccacagagctctctccacaatggggaaacgaatccaatttattctccctattgcctgcacttaatttctttgactcgtttacatgtctgtctttttaagttgaagaaagaatacgaatgtaagttcctctgtggctaagagcatctttgactgtgttcttaacagtctaagacaatggagcaatagtactattgcctgaggcaacccttctgagtttttcaatttattaccaaatttttagatgaattatgatctagtctagttccagatggtgcatctagatctttataaataccagaagcacttacttgaaaagctgccagatctataaagggatctactactatgacttggagttttttcatacattattgtctgttttcataaattgataattaataggttctctaaaagccaagctgttcatggtttaaaaacagctgttagccatgaaaactgtggtgacatctacttaccaaggtatttccagagagacatgtagaatcacactggaaattctgtaccactccctggtgctcttctgggcagggagagtttactccacaatgccacaaaatcttatcagattactctccttttgaaaccttccaaagacttcacactccatctaagataaaactcagaggccctgagcatgaccttcaaggtgctcacccactctcttgcttcagtttttgtttttttgtttgtttgttttatttttagacagggtctcactttgtcacccagactggagtacagtggtgcgatctcggctcactgcaacctctgcctcccaggctcaagtgattctcctgcctcagcctcccgaatagctggggttataggcatgcaccatgacacctggctaatttttgtatttttagtagagatggcgtttcaccatgttggccaggctggtctcaaactcctgacctcaaatgatccacccagcttatcttcccacagtgctgggattacaggcatgagccacccagcccagccctgcttcagtttttaacctcaccacctcccacaccaagctatgtccacagttgcctttttctctgttcttagaaccctacattgatgagcatcagggcacttgtctcacctcataatccagttatcctctgaggcagaatagaaatccagacctggaatctcctcttgtttctgctttccaacagcttcctctcaatcaaaatgacaaatgattcaatatcatttttttttttttgagacggagcctgagttttgttgcccaggctagagtgcaatggtgtgatcttggctcactgcaacctccaccacccaggttcaagcgattctcctgcctcagccttctgagtagctgggattaccagcctggcctcgaactcctcacctcaggtcatctgccctcccaaagtgctgggattataggtgtgagccacaatgccaagcccagtatcattcttgattaattagttgcaacttaaaggagtgaattttctaaatataagattatatcatctaaaaacaaggataatttgatttctccccttccaatttggatgagctttatttctttatcttgtctgactgctctgactaggactttaagtaccatgttgaataaaagtggagaaagtgggcatccttgtcttgttccagatcttagaggaaaggcattcagtttttccctgctcagtatgacattacctatgggtttgtcagatacagcctttattgtgttgagctatgttcttttgtaccctattggttgagagttttttatcatgaaggaatgctgggttttatcaaatgctttttctagcctctattaaaatgatgatatggtttttgtccttcattctattgatgtgatgtatcacttttactgatttgcatttgttgagccatccttgcatccctgggatgaatccacttgatcgggatgactgatctttttaatgtgttgttgcatttgatttgctagtattttcttgagaatcaaatcaaaatggattgagggcttcaatgtaagacctgaaactatgaaactagtaaaagaaaacattgggggaaatgcttcaggacattggtctggacaaaggtttcttgagtaagaccttaaaagcacaagaaaccaaagcaaaaatggagaagtaggattacatcaagctaaaaatctccacacagcaagggagacaatcaacaaagtgaagtgacaacttacagaatgggagaaaatatttgcaaactattcagctgagaaggattagtaaccagaacatataaagaacacaactcaatagcaaaaagcaactaataattgtatttaaaagtagggaaaatagctgagtagacatttttcacatacatatgcccaacaggtatgtgaaaaaatgctcaacatcactaataatcagagcaagacaaataaaaaaccataataagtatcatctcacccaagttaaaatggcttttatcaaaaagataaaataataacagatggtagtgaggatgcagagaaaggggaacacttgcccactggtggtgggaatgtgaattagtatagtcattatggaaaacagcataaaggtttctcagaaaactaaaaatagagctattaatactatatgatccagtaatcccactgctgaatatatataaaaaagaatgaaaatcagtatttcaaaaaggtatctgcactcccaggtttattgcagcactatttgcagtagccaagatgtggaagcagccttagtgtctacctacatatgaatggataaagaaaatgtggtacatatacaaaatggaatattattcaaccataaaaagaatgaaattctgtcatttacaacaatatggttggaactggaggtcattatattaagtgaaataagccaggcaccaaaaggcaaatattgcatattctcactcatgagtgggagctaaaacaattgatctcatggaggtagagagtagaatgatggttaccagactttaggaagggtagtggggaaggaggaataaagaggtgatggttaatgagtacaaaactacagttaggtagaaggaatgagatgtagtgtttggtagcacaatagggtgactatagttaacaataatttattgtatatttcaaaataacttgaagagtgggattgaaatgttcctaacacaaattatatatggctgggcattgtggctcaagcctgtaatcctagcactttgggaggctcaggtgggagaatcgcttgaacccaggagtttgagaccatagtgggcaccataatgagacccctatctctacaaaagaataaaaagttttaaaaaattagcttggcatgagggtgtatgcctgtggtcccagctacttgagaggctgagctgggaggatcacctgaacccaggagattgaggcttcagtgagccatggttacttcactgtactcgagcctggatgacagagcaggtccttgactcaaaaaaaaaaaaaaaaaaaaaaacgaaaacaaaaaaaagaagaggaggaaatgatatatgtttaagaacatggagatccccattaacctgatttttatcattacaccttgcatgctgtatcaaaatattgcatgtgtcccatatatatgttcaaatattatgtacccatagaaattaaaaataaaaaaaattaaagctaaattttaagttttcactgtgttctcagagcacgtagtcattctatccatctatccacccatccatcaatcgagtgcctagtacgtaaccttaaagtgattatatttcttagtaagcacctgctgtatactaaaggtaaaagttattggtctctgtgcatatgtggttgagtttagcagataaggcagaccaacaaacaaatcactatatgatgggggaatagatcaggttttctagaaacatgagtgagagcttctaatatgccctagttggtgatgtgagcgtcaggacagtttttctaagagttgttttgagttaagcattaaatcatgaataaaagatagtttgggttgccagatatttatcaggctttcattgatgcccccttaacatttgccagtcatatgggaagtactcaaaaaatgtttgagattcattctttagtgatatgttcactttcttttttaaaaaaaaaaaataaaaagtagtttgagacttctgtgattctctgtaaataaattttgacttgacatgtctgggaccttggcactgactctcctgggatacctcaattcccctcctttcccctttcctctctctatatatactatatatatgaagtcccattgtcctggcctctccatatggcctctttctgtaggatactggatgatattctgtacctctttgcaatttgttagctgagagccaggaaagtgaaagcaggaactgctgggacccataacatcgaggcccggaaagggcagcgtcacttctatagcattataatgatcaaagaaagtcacaggccagccaagattctggggaggagaaatcaattccatctctcatgtatgtagtggaaaagggattgctggtggctatctttggcaactatctactgcattccctcctcctcaaattaccttattctttctatcctcccaaagactaccatatgtatatttgcactcattctctagatttgacataaattggttgacactaatgacacttccctgtgtctaacccttgtccccatcatccaattctttctgcccttacctggcatctgtaattaatttctttgcctccaatgttacttctctgtttggtagtgcaattgaagaccacataaaaatgctgctagaatgcatctcctttgttagcagatttagtattctaatgtgaaattccttctcatcctttaaaacccagttaaatctgacttctataaagtccttattgactatcccaaagaagaggggatttctctttctaaaatttgtagtaatgtgtttctggaatgtattctagttttgactatggttaggaatacacatgctttacctttctaataattttgaaaactcaaaggcaggcagtaggatatactcattttttaaattttctaaagcaccaagatgagcccattacatagaataagttgagtttttgttgagttgtcagggatctgggaagaatggtttggcttttaggagaggttctcagccaaccaggaaggaaaaaaaaaatgattcagtgattagtgacaacagctttacttctagaatcctcccacctactactggcagcacgagcaggcagcttgccttcctgggacgaacctagatgaggtacaatgtggctggaaagctctctaatactgatctgacatggcatatttcagattaatctgttttctctccttgtttccagtttcagcacatactaatgccatcttgaatcttacttttcctccctggccctcagcttccccatctgtaaataacaaaggctactatttactaagaacctgcatcagtgccagacacagtgctgggcactagtgctaatcctcacaataatagtgaaaggtgcattttttttatttcctccttttaaatgaatatcagatatggaaaggaaaacaacttgcccaagccctctcagcacaactggattgaaactcatcccccatgagtagcatcagggtcaggccagataagctgtaaattcccttagcctttactatgcatctccaccaggatgtaaaatacaatctgctgtttgtcttccaccttctcctagaccagcttttctgcgtcattatttttcttttttgtcttcagctgcagtttctcttatcagttattggctccacaactagcaagtttattttttgctccatattgtattctggtgtgttatgctacaatttgtatagggaatgagacacaatatggtttgctaatgagaaaatctacactgcagagacagaacctatttgttctcagttacttgaaacgtatgttagaatgtagaatctcttcttcattcccgtgtgaggtgctgaggaaggctggaggggttctgattcagtcacatttgattttggagtcaaggtcttggcttcaactcatattgagttttactggaaactgccagctttgttttgggtagacatttgtaaatgtgacagaacagatgactcatctcaagccagctctatgcttttattcaatgtgtgcttaaaaagagtaaacgtggatgttggaaagtattttcttgtaagtactttgtatggcagatgccaagtactgctaaacctaattatttaattcttcttcttaaatagatattatttagttttaatttttaaaaaccttcaactatataattgatatatatcatatatatagatatagatatatatcaataatataattttactttttagcacaccagaagcatattattttggaagatcataggactcagagctctggataggcaaagtagacttggatttacattctctgtgatcttaagaaatctactttctcccttattttcacttttctgtactaaaaaaaacagctgtactaacatgaataatatgtacctcacagggttcatgttgaggacaaaattattaatagataatatgtcaaagagcttgccatataatcagtaggttctttcctgccatggaaaaatttttttagtcagaataggtctcagccaacctctttcatgttccagaatttaatgcatacttgctgattcaatacaggtagaaagtttaatattaatttttattttgttggctttctaaaaaagcagtcttttcacattagaataagtgaatgaaagagatcactaaaatcaaaagttgttacaaatgttattttgattgctatgatttcaaatgcagttttatcttcttataaagttaaaatacccaatttcgtttttaatttatttggaaacaacaacacgactggttgaatactctgtctaaagtaatctctaacaaagaatgactgaagttctactctaccaatgaaaagcaagaaccggggttcctcctttctctttctgtggtatgggagctacatgaaggcagaataaaagagtcagactaggctgggaatcctgttcaagagaggcactcagttacagtgtacatgtcagaattgattgataaagttactaggaagtaggcatgtaaccttagttagtcttgttctccagttttcaataaaatgtggactatacctttgggggttgtgttcatttgtttgtttttaagacagagtcttgctctgtcacccaggctggagtgaagtggcacaatctcagctcactgcaacctccacctcctgggttcaagcaattctcctgcctcagcctcccaagtagctgggactataggcacgtgcaaccacgctcagctgattttttgtatttttagtggagacgcagagtttcaccaagttgcccaggctggtctcgaactcctgagctcaggcaatccacccatctaggcctcacaaagtgctaggattacaggcatgagccaccatgcccagcctactacagtatttttaaagaagagcagtttcacagtgtcaccaaatcatggctttcagatccagagttacaaattgcctcccaactcagcagttcttgaaaatataatattaccgatgtttggctcatgaagactccctagaagcccagtgtcccctagggaggaagtgccaaattgaaaatttttaaataatcgttactgtattttatagcaaataagtatatgattatcaaatatgcttaaaccctttgggaaagaggagcttgaaaacactgtatccatcctttgacagatccatttagcctaattattcaatgatccccatacattttactcgcattcttgacccaaataattcagattatatttgtatgctttttgatatccttaatgtaaaaaaaattcttgattctttttctcattcattcaacaaatacttgttgagtgaagaccatattctccatgagcaaataagtagaagaatctccatgtgggtcctgcattctaatggggaaagagaggctgataaatactaaacgcaagaacattaagtaggtactatgtcagtaaacaaagtatagagtagattagaaggaaaaaaatcaaataatagcaatgttaggggcgaaggagcctggagttgtgaggatggcttataattttaaatagagttgtgggaattggcctcaggaaggaggtgacatttatgagagagttggaagaggtgcagggattcaccatgtgactatgtgggggaagaacattcagatagggagagcggccagtccagaggctcaaggcaagtctgtgtctgagatgttccaggaagaggaaggaggccggtgttcaggagtaaactttgtaacttagtctttcttttctcacattagactttttcgttgttgatgttttactttaaggaaatttatttttgcaaaaatatgtactatttggtttgttaaaataacatctaactcttgaaagatcatttaccttgatagaggcattcatctattctgttaggaagaagcacaggtcagccggagatgtttacagtacagagttcttatataagtaggaaaaaaaaaactgtaataatttaaaaagtaaaaaaaaaaaaagtcaatacaggacctgccccttcctagacaatcacaacgtgtccactcattctactttcagctgccccctccccaccctatccgttcaatatcctgccactctggcaccatcccagccacaaggcctcaggtcctctctctgctctcgctggttttcagagaggcgctcctcagagagagtttctagcactaaaggataagtgattgttatgacaatatacttctttttaaaaaatgcttgtttcatcggagaattttggctggctatgggtaatggaagagatttcacataaaagttgagtccccttctcacaaagcaaatgagcacatgatggatcaaggtgctctgctggtgtagactaacatatattaataatacacacatacctattaagagatctgtgtcaaggaatatacatgtagtatatattaaagacatcagaatataagacaataaattaaattaccttatagtcacctggcttctatggagcaaggagaatttaattaaaccacagaatctgagagaacatttgatccttggttgatgctaaaaaattgtttcactatttgaaaatagtttcaaatcatttcactatttgaaaaaaaaaaaaagcaagttcagatgggagatggactcatagcttatactatgtcgaaatgcattaggaaagattagtttaagatttcatgccaataaaataactttaccaaaaactacctttatggagtactagtctcaccaggggaagttcaaaacatcacattttttaccaggaagttgatgcattcccttggcaagtcaatgggatggtttatgcctagaatctcagagaagaagaaagcctttttagatgaaaaagatagtcatatgtctccaaaccctcatgtgtatttatgtagtggagaggaaactaattgaagcagaaggtagctagatttttaaatgtaatcattaatagtctcacagttgtgttgatagcatccaacagggttaccttctgggcagaaacacagatcactcctactgttcttggagaaagaaaaaggaggaaatgaacacatgctcactgaacctcctagcaaaaaaagtctctctagaaatatatggtccactcccaagctcaccctttaattctccaatgttacttctgtaaaatagcagtcctgtgatattactcactgaacagatgaaattaaaatatttatattctgcacatgcacgcacggaggaaaatctcacttcaattatagcagttaagaagtctgaagtaattttcccagctagcatttggccattccattgagattgaaggaatctggtatgatgatggttcttattaattcaccctctcttcgttttaaaagaatattatagttcctttgtgatgtaaattgtttgggcaatatgatggtgcactgccttgtgactaaaaagtcgacaagctcaaaggacaaagtattcaggaacaatagctaacatttactgttcggcactttttaaatgttctcggtaagataatttttatttctgattcacttttctttttgcctttccaaaagggatttaagttaattactttttctaatgtgactttgatatttcagtcccctcagatcttccaaggaatttacaggtgaaataccattctagttcttttattttcctagaaactctgatattaaatatgggtgtcacactggaaaattccaccagaataaaaagctaaacaaggcataaaatttacattagtaacatcccattaaaccatcatctagaaagcttttgttacatgattttcatcatttattaaattattttggtgtcttttctggtcttttttgcctgtaggactgaaccttgttatgcatttgtctccatcaaaatggtgtagctgcatttggcattattccttcaacattcttctttattttttccacagaagatgaaattagcttggtttaataatagtcattcctgattactctctctgtggaaaacagcttaagaggcacattattcaattaaagaaagtatttgcctcgccctttaaaaccttcattttatataacctattgattgtgaatccaattagtcttacatattaaacttttattacttttagtatagcacttttacatgccatcgggaaactcatcaccatgtaaaatgcatgtagttcctgactttcaaacaagaggtatttcagaagatcactgctaagtcagtgtttcaaatttgaatatacatgttcatcctataaatgatctatattcagcctataaatgatgacatgattatatatatagtcgtcctacaaataatcatcctataaacaattattgggttcctggggtaacagcaaagcaaaataattagaacatttttgttaataatatacctagtaataataatgtagctgggaaaataatgaacaaaataatatagctgaaatagtagtcctacgttttagggacaaggttagaaagaagagagcaccaggggttggagggagagagtggttcctcatatacactgtgataactcagatagtctgcagtcaggaaacaattggtaatccattaattagagagtatgatgcccttttatgaagtgatagtgtagacacaatagcaatattaattagctttcctattgcttccataataaattagcacaagcttagtgacttaacccaaacttattatctcacacaattctataggtcataagtctgagttgattctgctggtttctctgttctgggtgttaggaagatgatgtcaagatgattaacagctgggctgtggaaagaatctgcttccagtctcattcagtttgttggcagaatccagttccatgtgaccataggactgaaattcctatttccttgctggctgtcaacagggaaccagcctctagttcttgcatgtgggccccgacatctcagagccagcaaacatggaatccttctcaagcttggaatctctttgactttctcttcttccacatccttcttctgcttcaagccagagaacactctctacttttaagggttcatatgattcaatatgtcccacccagacaatcatctctctattttaaggtctgtaaccacaatttcgtgtgcaatgtccattttgccaccatggaatacaacatattcacatattccagggatccaggtgtggacatttttaaagggccattatgctgcttatcacaaatgtaacatgttttgagttgttcttcaagggttcaatccacgaatagcttgtatgcacaaaagcacttgtacaaaagatgaccaccagggctccgcgggctgcctgtgtcacagaatcgagtgatgtccactggcctcacagttcagagctcaccagtactctctttcagcagttcttaatcttatttccaaagatacaccccagatatcctttccttgtgtttacatattctcagactctggctgctgtgttaataagtggtgttgagactattgcttaatgtacagtgaaagagttaaagtgattttgtataaaaatgcaacgatctgtttcactaacattgtcccaagcaacagcatgagcagtcgttttttatattactttaacagaatttcccatccacacaggagaagttcatcctctccattttcttaagagtagagagtgtctttagcatctcaaggtttctgtggatcaccaggagccctgccttggagaggctccagtacacaggtgttactgagctggagggcttgagagaggggaccattctgaggatgggggatggagaaagaatgttaccaaggtgaacggaaaggtagcaaagacgggtatgtacgggaaggtctgagattgctgtttggaattgatttttcaattattaattttttcatgtattctgatatgatgaaaaaaatgacagaacacattaatcttatggaaatgtagggtaaaaaagaggatttgagattggaattattctggaaacctggatcttgagctagaattttaaaaataatggagatggttagcctacagttcggtttctgcttgggaactctttttcaaaaattctctggaaattattaaggcaccaactacttgctctgaaaattgataattaaaggggaaaaaactaaatatttattctgactttaaagggagttatatttttcagtaatcaaaataatcacttgatgatgaatagccttttttatggaaatattgcagttcattaatgtgtaagaataaaactcaccattttgcaatgttaataaaataactgatcaaagcaacgttcatcagtgattaaatcctttggataaaatattaaaaagaactagacaatagagggactaggttttcattataactagaatttggaaccctagaacttattttttctcttaagataatgtaacataaagcagactgcaccatctatgaagcatttctgtcaaaagttgaacctaaatctaattgagcctttatcacttacttccagccaccaggaaatagagagggaaggaagcagttaaatgacaccacaatgaaacaaacagagaaatccagaatgaaggacattttataggactactgacacagtttctgccaaaagttaatgacatgggaaaaaaggagaggggaagaaggaggagcacagctgtaaatttaaaaaagaaagaaagaaaaatgacttgggagatttaccaaatacagtatttgaatcttaattcgagcatatcaactaagaaaaagacatttttgaaaccgttagaaaaattttagtatgcactagacatgattccaagacattattgttaatatgtaggtgagataatatcactgttatcttgtgagacaatgtttgtgcttttagagatggatactgaagtattttaggtatgatgttacatgttgctgggatttgttttaaaaatttttagcaaagacaacatatatggcgcagtgtatattgctcagttgatgggtgcaccaggatctcacaaatcaccgctgaagaacttattcacgtaattaaatgccacctgtactccaataacttatgggaaaaaatttaaaaaatagcaaagaaggccgggcgtggtggctcatgcctgtaacccagcactttgggaggccgaggtgggcggatcacaaggtcaggagatcgagaccatcctggctaacatggtgaaaccctgtctccactaaaaatacaaaaaaaattagccgggcatgatggtgggcgcctgtagtcccagctacctgagaggttgaggcaggagaatggcgtgaacccaggaggtggatcttgcagtgagctgagatggtgccactgcactccagcctgggcaacagagcgagactctgtctcaaaaaaaaaaaaaaaaaatagcaaagaaaaaaattaagcagatgtggcttatttttgctggaaaattaatgaatctaaatgatgagtttatggggattcattatatcatcttttctgtatacaattggtagttacagaatttttcattaatttttttttaaaaaaatcagttattcccacataactgtatatcttaaaaccattgttttctacaaagaggtataatattattgtgtggttgctctgtgatggtacgagtaggcatccttattttatcaagtattgtcctcttaaattgcttggtttcttatcatggtggtctaatttctttgaggctctgtatctcaggcctatgttcattgataaagttcctttctctttgaaattcctattaatagacagtcttcaatcaagaacatattagttctgctaatacaatttatatgaaattttaccctactccataatttgcagaagctaatagtgtactaacaagggagcaggagcaataattgatcatatttgctttcccttagagagaagtgcagccatcagtcttagaagactgatgtaatgagtgccaagtgatggatgccccgtgcactcacgattgctagatctcccatgggtgtcctaaaaggaagcacgtggtctgttgggagatgcagacagcagaattatttggaaataggtggagccactgtcaatgagagacgtttcccctatctctattttaaaaaatgcaattctatcttaatcccttccttttttcctcaaaaatttaacaatgctaattctaagcttgtgtgcacttttcccagtggttaattataatccttttctttattaggttttattttgcagccttaaaaaataaaaagaaattaacaaaatggcttaaaggcaaaattagagcaaatctcattttcttaggagactctgcatttcatttattgttatagttcttacttcagagacagggaaggaagagaaggtagcttgatagtaaaataatatccttcaaggtaaattccatgaatgttaagtcaagcagaacttctatttttgtagcattctagagacattgaatccagtttcttgatgtttcttgccgcatttctcactctgttctacagagcaatttggtttacaggtaatttaagcttgggataaagctctggttaattcagtttctggataaaagaaagagtaattcaacttaaagatcaccatagaattttaatcatagagatgagaaagcaaggaaaggcataaacctcgttagtggtataatgggaaaagaattgtctcagatagatggttctagctcttgaagttttgctgtaagctgtaccagcactagaaaaaaggtacaatgggaaatgcagacctttagttttgtccaccttcctgatgttgcctttttcacttcagcttttcaacaacgttgctgaaaaggtctaccagtcagtgcccattatatatacgtttctcttcctttctccaatcccatctaaataatgaattctgtattccagatcttgatcctcattttaaacattcatttcctttatttaaattttacttatattgttattactttataccttaagatattatattttaattatagtgtttttattgaaatgtaatttttacatcatgaaatgcagactctaagcacacagtttggtaaattttgacaaatgtatacacctgtgtatcccacacccatcaagataatagaacattttcatcaacctagaaaattctgtcatgccaattcctaggtcatcagtgcctttcagttcaaaggagaatgtagatctgatttccatcaacagattcatttcacctgttgtggaattttatagaaatagagtaatacagaatatactcttcgaggtctgactttctgcatcagaaaaatattttagagtttactccatgttgttaaatggtatttcattaaataacacacctcagtttattcacctgtttttcagtttgtggccatttgggatgtttctagctttgaaatattgtgaataaagctgctataacatttttgtataaatctttttatagatctatttttttaaaattctacctaggagtggaattgctaggtcataaggtagatatatgtttaaatttataagaatctgataattttccaaaggagttatacctatttacatatccaccagcaaaataatatagttctagttgcttttcccttaccaacatttggtgcagccgtcagagttttaattttaatttggtccattccagtgggtgtacagtgatctgtcattatggttttaatttgtatttccctgatgattaatgattctgggcactgttttatttgcttattggttattgcatgtcttttgttgtttaatgtctgttcaatttgttgtttaatgtctgtttaatgtgtctattttttcgttgctgctttattgagttatataaatactttattctgaatctaagtcctttgagatatatatttgaatgatacatttcctgccggtctatgattttatgatctgcctatttattttcttagtggtaatatgtcaaagaggagaagtctttaattttgattaagttcaatttaaatatttttctttgtggctagcactttctctgtgttatctaaaaaagctttgcctccccaagttcataaaaaatattctcctatgttttcttccaaaagtttcataattttagcttttagatttgttactgatcaatttcaaattaatttgtgtatctggtgtgaggcaaggatcaatttattcatattagattattcagtcatttcagaaacatttgtgaaaaaaacttaaaatgactttccttaatgaattccctaggaacctttgttaaagatgaattgaccatatagctgtgggttatttctagattatcttttctgtcccattgatttatttgcctatgtttatggcagtgttacagtaccttcatttctgagttttatggtaagctctttaggtactaatgtggaagtatctttaaaacagagtgctgaatggaaaaaatgtacagattaatatgtctagcttttgtctaaaaaaagagaaaataacatatgttcatgtatgcttgactttgcattaaaaaccttggaagaacacaaatgatactaaagacatagttacctgtggcaggtagcagtatatagttactagacatatttgtgacaggaatataaagaggaataggaatttttattatatttttaaacaacatgactatattaattatgaaaagattaatttttaaaaagagtaagtgatataggaaatgtattctttctcagagtagataaaacattgagtgggcaattcattgaaataatgttttctaggtcccattagatattttttgggccttgaaatttttaatatctgttttacttgacaaatatttattaagtgccttttatgtatcaagcaatggtaatacagaaggcaacaagactgacatgttcctcatccccatggtatgtatattccagtggagggaaaacacaataaatcataaacaaataaaaaagatattttcagaatgtgataagtgctataaataacataaacatgacagaaagaggcaagatgaatgtgaaatggaagtcctggagaaggtcttccagtgtggtaacttaggaactgagattggaatgccaggaaggattcagagatgtgaagaatttgggtgttggggaggaacctgcaaaggaaaaggccctgaaaagggaaatggctgaagagaaacaggaaagaaggcaaggtggaagagcacggtgaatgtggtgcagaataaaattgcggcgacaggtagggactaaatcaagctgaactttagggaaatgatgaggaatttgggttttattttacatgaaatgaaaaactactaaaagttattggaagttactgaaagagtataatgatctgatcaagattaaaaaacaaaaagcattcattttattgggggaaaaataacagattaagaaggggttggcagtgagaaaggaagaaaatcagaagttacatcacataagccaagaaacaatagtgtttaaaaaagaagaaatgtcccccaaatgttccaactgaggacagagaaactgtccgctagatttagtctcatggaagtcttctatggtctgacaagagcaatttctatggagtcgtgggtagagaagatggactagaatatgatggaaagtggatggactctctattttatactcacctccccacctcactcccaacacatgaaagtgaatgagaaataaagaagtgaagaaagaagatttagatgactctttcaagtgctctatgtaaccgtagatacatggagatgttgtgtatatccaggctggcatatctgtgtgttggtttagcaaatacatatcaaaaattcttacatgaaaagctcctttataacaagatgttctcacttttttagtgacaaaatcccatgaataaatccaaaaagagtctattttatataaaatcccaccctgttggaagtattgcaagtttccactgaaatttttaatctgacttctagatatatttttggagtgttgtctattttgtcagcctgccagattatgtcaaaatgttgatatgtaataacagtttatctcgtgttcctttatccaccctatttacccacctcagctgtgttaactgtccttgactgattccactgcatcattaatactgccatagggaaccgtgccctgatcattcatactgccactaataggatgccaagtggatgtttcaaagttggatgctgatgattatcattgcgatgtatatgacatcgctaagacagcattttcagtcaaaaatatggctgccgtttaaggtgtgagctttttgcctttttacctagaaaaacaatgatatgtaaatttcttattataatttgtattactctactcttatttgctatttgtcaactctgcaagagacaagggttggtacagaaaatatcattttatcagaaggaaaccttgtcttctacagtaggtactaccttcttgagctgattctggataataaagcttgcttcgcaataatccagagttttccaaaccatatatttgactccctttactgactgatatgcaaagttgtgtttaactatatggaaaattgtgaatccttttcatccaagtctacacactccacttgcttttcccttctaccttgaattcatgtgcattcccccagttttctgcctttgtaatggaggcttcagttcttctgcagccacagttgcaggaaacccaattgtaatcagcagctgccctgctgctaaaagctattagtgccaatgttgttaatgaccgacccagttgaatgtgctgatttaaggggtagacttatttcttgtcactccctagggccttgttcttaaatgagatttctacgttgtttagttgtttactcctctagcataaggagtattaaccactaacaaccacacttcgtatatcagcacgttgaattgaaataatggggaggttaagacatatcactacctttgaggtatgaagacacgcgccctgaaaaaacttggctcctacccctaatttttgcctaaagaagttggataccactgcaatttgctctgaagttatacatgttattgtcttcaagggactataggatgagaagggtacagttaggtttcttttcagaactaaacacattagcagtaacctgcaaaaatcaataccaattacttgcaagcaagggcttaaaaaaaaaaaaaattactgaagctacagaatatgcccataggtgaatggcttaaaacaaagaaaatactggcatagctggtactctcacaaaatagaagcaaaagtagtaaagttctcttttatttattttggcattttggtattaatttgtaaaagccaacaactgttatatttaaaaagaaaaataaataaagcagcaaataactcaatataagaaggctattttactgtctccctggcatgactaaggtttgtgttgtctttctagcagacatcaaggcattcagaaggtgtatggggatggcttatctatataaaccagtaaaccttttattcaatacccagacattctgcatgccaatattatgtgtttagtgtctcgagattctatttagcagaaattcactttgaggggcttggtgaagccttcagaggtttaactgtgtagtctctcctttattcaaaaggctgaaataatatttttccggtttctggaattcttaagcttgcatttcagattaaactatcgcagagagtagaatttcttccttccttgtcttctagtagtaaagatggggcacatatctgtaagatgtggacccagaaactctactctcaagtctggctatgatgacgaagtcttgagaagctagtaagccttgctacctcattcaagtccacggtagagttgtgtatgaatgtatggagaggtgggggaagttccaaatactacagaatttccccatagttaacagccctgcttaccaaacaattgaggccatgtggaaatggtacctatcattaaatctcacatcagaaggaacgagttttggcatgtctgtatcgccaatatgagtatcaaaaaaggtaactgtggatcttcttggacagtcattttcctggacttcagtttggtcctccctggtcataaaatgatatgattcttaatacttgaaaaaattgtcccaaaacacaatatcacccaaaaaaaccctcttttaccagcttcctttttttttctttaattgcagagcctcaaatcgatatttaagaagtaagagaagtgaatggtggtcacacaatgcctgaaaaagaaagctctgagtagttgtctgggggacactagaaacaaaagaagtgtgtcacgtgataccataatggcatccagcactttccatatagggaaggcagacagggaaaagaaaattttgcttaacgtggattgaggaagtagtggactcaagtaatggaaaggaaatgaattttacagtattctgaggtactggtaaatttacttgctacggattatactgaaggtaaaatgctgcttaaatagagtctaagattttatgtatcaaatatttacctaatttttaaagcattaaaaatgttaggattcaatagttatagttactttcatcctttgaaacaaaaataattcttgtttcaattttatatgttgagctgttaaaagaaaattgaaagaggcaaacaatatatacttatttgtctctatgggtttgtgcagtttatagatatcctgagcagtgcttctagtgagcgttcttagtagcaccaggttggttgttaatggagtattgacccagcaatttactggggcaagcccttctgctctactcagagttgatgtgttttatattacaattgcatctaataccttattttacaacttcaattaatatagttgggtagaactcgaagaaagtttataacaaagctatgaatagagtaattcattattataaaagtgtactttgagaggagaaactaggattgtttttcctcagaaagaaaacactgatgtatgataatagtattctccaataaaattaaaaataaacatctaaagagacataacatttctgttgagaatagaaaacctgcactcgctgtctgcaaacactgggataatatctttcacaaaatgtttataatccagataaaaagagaagatatatatgtgcaaatcaagagaagaaatgaaatagagaagaaatgagagaagagatgacaaccactaaacaaagagtggagagagagaagtgctctgacagttggagggcaacagagatctctctgcactgaggaggccaaggaaggctttttaaaaagatgatatggggtgtgggtgttgaagatagaaggtgggatgtaaaatataagaaaaagggcaaagtttttgcacgaaaccttaaggtgaccattctcacttcggttccttggtttttgtggagggatagtaggtagtaaaattagggtgagaactttgaggatagattgagggtagtaatttacatcaggctaaggagttgtaggcattctcctataagccaggcaatagaaggccatcagaagtttacaagctgggatataatatgacttttataaacagcaatatgccagttgtgtgaaggatgagtttagagaaagactgaagctgagaacactaagaaaatgttttaacagtgatagggaaaaagtaattggatattttggctgaactccttaatagaaataatgaaaggaacacaaaaggaaaacacaaaatctagttcaatgaatacttaaaatttataagtgatagtataatcctataatttattctgaattaagaatccataattctgattctataattggaactatcccagaattctatgtcctatttgacattagtttgacttaaagattggcttatgtctcaatcaatcaatttgatggtgaccaagaatttcctttcaatttacagtttaatactggccagagaatggaaagtaaaaagccatagcacatgctatatatatgatccatagacttatcaaattcaaatttaatggggagtctaaaacagctatttggcatttataccccaggttttttctaatattttatcagagatatcaaagagacttcaaactcaattcactgactgatataaacagcaagctatttcaacagatagagaacgctgggataaagaaaaagggcttggaatttttttgaagtgaaaaaatatgtgtaaaaaatgcatttctaatagtcacaggacaaaagtggacagaatttcccattacagtaaaatttaatgaattcagttggttcttttaaccatcatatggtctcatcaagaaataagaaagaatatcattaagtggatatccccctttacataaaagctgaatacattttttttttttttttttttgagacggagtcttgctctgtcacccaggctggagtgcagtggtgcaatctcggctcactgcaagctccacctcctgggttcacaccattctccaacctcagcctcctgagtagcgggactacaggcacccactaccaagctcagctaatttttttctattttcattagagatggggtttcgccattcacaggataaaatctgaatacataatacattttaaggactgaaatcccttctataataactttagtaattactcactgttgatgaaaaatatcctaggccaaaagttttctctgtttgccccaagcagatggagtaagggctctgagtcaacctgacttccctctgcatggtgtcaagcactctgtggcttcatggccttgcaatccagttaatccctaggaaccaaacttacccaagtggttgtgtaagttgtacataataaatgtaaagtgcttagcatagcacataaaatgtaaagtgcttaacatagcacataacaaaaaaaattgttgagtaaacgaatattttgctctaaatagtgtgggccacaagatctactaaacaaattagattgtaaaacttctcaagggatatcctcggtgtatttggtagaggaaagaggaaagagatttgtaaaatgattgaaatatgttacttacctttaggattttttttcttgccaagctttgggttttgaacttgcggaatcttagagtcacaggaagaagaaatagatagctcctgtagtgctggctatagtctcatagagcccaaaaaggtaggaaggagatgatttagaaagtatgagagggtagaatgccagggaggtttctgaccagttgttttccaggccaaagcaagtaatgcaatgacttcttgtattaaacccatcatttatttaatcaaagataaagcatatttctattatttctataataatagaaattctacaagaaaggagagaaacctttaagttttccctaaagaaagccattcttcctattcttatgatttctgatgctagctacactgctttcaaaacacacgatcctttagggtacagaggagagaaaaggaattcgtttaaaacatgattttctatgtagatcatcaacgaatgaagaaagaaactagaaaaaagggggaagaaatgggtgaatgtagtatacttatttcagatatgaagatgtgcttccaggtacagcactagaggtacaaattcattctagagctttgttcactgctacttactatctctggaactacagtcactgcagaaccagggcattgaagcccaaggttaatacagattgtagggagcagacaaaattggatcgaagtccagatttccttgttttctaactggaaggggcttgggcatttcatttaataccactaagtttcaatttatccatatgtaaaatgagcctcatagaggtgttataaggaatcatagattactgcattcttccattctatgacataggcacatttcacattttaattgggatgattcttaaaatcaatggcacatcttttttggaagtgccacataaagtcatgaggcatcaaacaataaattctatcttaatttgataaaatacatgaaggtaataaaggcaaagtgcctctgacaacatctggcatctaataagcaccagcaaattgttttggggtgatgctcagtgctgttgctattaccccatgctacaccactcagggaagcatctctttcttcataaatgttcactgatactccagctcaagtgaatgcagtctagtgcgtattttgtgaaagagtaattaaagtcttaaatgtcctagtttctctaatcatctaaaatatcatacttttaatataaaaataataataccttaaaaatgaaatgatacatctttggaacatttatcaccttcaaaggacttgcaatcctcctacataataatggtactatattacttagttcttgggtatgaagagtctgtactgcacatagcactctgctaggcacgagttttccttgttttttctaatacaactttgatatgacctaatttcaccaccaaaaaaaccagcaccatatggcaagttccccatttcccctaaaataatttattgagcctttagtgtgtcccagtgactgaactctttatgctgaatttttctcaagatttcttcaggacatcagaacataatgcagattttttttcaggtggccctctaccaactggatatgaaattggatcagctggaggcaagaacagatggggttgagcagcagatggaaagatcctgtttaggatatgcagaatcactctggcaaaatcaatcatgccacaggagttagtttcagtttggtgaaagaaaatgaactcaagtagacaactgagttaccgggaaattaatacgagctcacactttagaaagtcttgattaagtgtcaataagacagatgagctaatgatgttgaattaaaagtcttaaatgtcacgtttgtcagtgatcataatagctctccatatttagtgcttaccctttaccaggcatttcaggtacagatctcattcaatccttacaaaaaccctgtgagacaggcatttttccgatatcacaaatgcttaaatggaagttctaagtaaattgatcaaggtcataggactctaggtaacagaaacaggattggaacttgtctggctagctggaaagcccacacaaatcatgaacactctactactttccagtgttaaatgatgtgtatacaagaacaattggaggagcatacggtcaactttcagatatcctaaggtcctttccacagtaacaattggaacaggcctgtgatggtcagagtgaccaccgggcatctgcttgaatctttgtggggaatacagagcagcgaggggggccacatggtccccagtaaagcagaggtcacaggtgtcacatacaggctctggtgaatcccacggagtccctgtagaaatctcacatctgcttaccccgagaaggtctcccagaatcctggagctgccttgctccagaagtggatctccatagcaaccttaggccaaaagagtctcatgcacccgttctagtccaaacatgctatgatggactttgtttccatggggcattcaatacatatgtgaatctgagattgtgagtggcttggagtacgtactgtctcagtccattcgggttgctattaaaaaaaaaaaaaaaacataaactaggtggcttataaacaacaggaattcatttctcacggctctggaggctgggaagtccaagacctgccaaggtattggtggatctggtgtctggtgagggggagttttctgttcatagatggctctttctagctgtgacttttcatggcagaggggaaaatgcactctctggggcctcttgtataaggtcactaataccatatgtaaaggctctgcatctcatgacctacttcccccccaaaaggccccacttcctaacatcactttgggtgttaagatttcagcatattaatttggtgggggtcacataaacatccaatccactacatctactttcttcaaaactgtaggcaagctgtaaagaagggaaaatcatttcagcccaagtattcgccctgctttaactttggagcaaaagcaggaaatagaaggaacttatcattcattgactgcctactatttgccaagcatggaaagaccatataatgggttggagggaaaataagataaaagtctgagcaacagatggaaacacatctgccaggtgccatgctctgtacgcattacttcattccatacagcattctcttgtattagtgagttcctgctgactgctacgttactttttcttctcagccaaatgttcaagaagcaggtactggttatgagtaagcatggtgaaaacccattttctaagaaacagaagagatggcaagtgtatcctctcaaagaattaaattttgttttctgccttatttttctcaaacaaaacaagcttttaccaattgcattaccatagccttgctatctatacataggtatcacagaaatcttaatctttgagttttcaagttagaggaattcttattaagcatgagagttaataatctcctgagacacaaatatgcctggtaatatgagaacaataaatgtttgttgggtccaaacatgaattaaagctgtatatgttatgccttaaagacattaaattaatcataaattatagtgattaattacattaaaacagtagcattatgaatacacaagatacaagtttcagtttaaggaaaaaccatattttaataatccccaagtacgcctgtattctgagacactaaaaataattatatgctactaactataccttgaaaacgcatacactcttactgaagacacagaaatgaacagaacagaactaaaaattgaatacattttgtgacacatgatttttttcattgtaatatttctgaaatttggatgcatcttggaatctatgacatcttatagttgccttcagccaggtggcagtcgtgatgtcacaagcaatgcttgcatgtaggagaacaacgtgtaagacacatgtcagcatcttgcaagaaaacctcagagtcaattacagaccactcttattattcctaggacctacttgttttgaaagaagatgggtgagacaatgtattatatatgtttaacatacaggaagcaaaagtaaaaaaagaagtctagttctatgtcattgccaaatgacttaagagtctagcaccacagcattttagttgcttaacagatttaaatgttacattgcgcttgctttggcagcacatatgctaacactggaccaatacagggaagatcagcaaggcccctgcacaagaatgacacataaatgcataaagattccatatttttttggaacacaaaggataaatgcttcaggggattgacacccaattttccatgatgtgactgttacacatggcatacctgcaccaaaatatctcatgtaccccatgaatatatacacctacaatgtacccacgacattaaaaataagttaacattttttaaggaaatattacctcatcttatctcttgatggcatagaaatttatattttaaaactgttatatataattatataattttataatcatacaattatatttttatatttttaaataaatatataatttaattatataaacatttaattaaattatacatttaattatataaacatttaattaaattatacatttaattatataaacatttaattaaattatacatttaattatatattaactatgtaatttaattgtatgtttttatatatttattatataatatagatccattatctatatttatacatatatctatatacataatatatttaatatatattatttatacagaattatatataattaggcttaataactctgagtcaaaaacgtgattcaaagagtcaaactctacatgaaaggaagtttcagaaatatctcacccaattaactttgcttatattttattttaagtatatttaattatatttcaatatatttttatatttcaatatattatattgaaatatattatattgaaatatattgaaatatatatttttacgtttcaatatattatatttttatatttttatataaagcaatatataaaattatatttcaatatatttcaatatattatatttcatattatatttcaatatatttcaagatattgtttttatatttttaaataaatattttataatttaatgacatataaacatttaattaaattgtacatttaattatatattaactatgtaatttaattatatatagttatatatatttattctataatatagatcattatatttatacatattttatatgttatttatacagaattatatgtaattaggcttaataactctgagtcaaaaacatgattcaaagagtcagactctacatgaaaggaagtttcagaaatatctcacccaatttattttgtttatattttatttttgtgtatatgcaataaataatttaaaaatttataatcaagctgaaaagagttctttcagcaagcacaaaattttccagtgattaaaatttactgagtccgtttatttggtggtatttttcttaggttttttttttttttcatgaaacaatgataactgctagcatcgtagatacaacaaaataggggtataaaaatatgcgggaacatgaggagatggtatacaaatctacagaggcatgaaacaatagaaattagcgccaatctggaagttaggagatagagatcccaggcttggttccataattaaggagctgcgtgatcttgagcaagtcacttaatctctccgagcttcaaccataaaataaggagctgtgatagataatttccgagctccagagagcagtgatgtaagcaatcaggaaaatagaaccttccctcgatgctccaaggaagaagggatctgatgtgggtcactatgtgcttatgaaagtgacggaaaggagtcctgaggttgaggaaggccagtcactgctggcctcagcttctctaatggctaccgagggattagacattgcctccaggcaggtcagaaactcaaggaaacttccccacaggtcacagcagcctccggtatctattggtgaactgctaaaggctactaaaaaccctttaggttccaaactctgcatgtcagcaggccactgccccaatacacacttctctgccatccaaatctcccacaggagtttcttactggtcgcatccaagacaaagctctgttaggcaaggggttctgggaaatgtagttcctacactgccagtccctgtgctgtaggagagatcatagaatgaggtaggaatggggctgagtgtcacagacagatatctggtaccccagctggggagcgagggactatgatggcaacgcaggtgaacaagagggaggggacggcatgaagacagattcagaagtcatggagaggaaggtacacatctgaaagacacctcaaaggaagaattgaaagattagatatgggttactttttctttccacactagtgagtcaatataatctataaatcaagtctctttagctcctctgctgactatcatgttctttttccctagctctcctgtaacagggaacaatacaccctttttcttgtagtgcaagaataatgatttgctggcagaagctccgtgaatcagactttgcactgaacatgttatattgtttgggaacccagctaaatttttccatgactgctttaaaagtgatttccatttaaagctaggtggaacaaattcctgctgctggctaaatcttctttttcttttccaatgaacagaatctcataaaaaggactattgctcttttgtacttttctgtgatgcattttgtgttggggtctatggaggaagccatctaaaactacagagtgttgtaaaaataccctcgtaattctactagaattcaactttttaatagctgtctttcttctccttttatatctccttttcaattatttctttccctttggtactctgacagactaatgtttctgggtctttcatagacacctacatcgaccaaatggatccatctcccacctttgagatcctcattaaactctggcagagtttggtggctacatgaactcaaaccccagacgtatggagaaagaatcactttcaatagaaaacctaacatcaccagtacttacaattctgactaatttttgtcataaataaatacagtggacgtcatttatgtccattttgagtctgtatctatgttatatcacactttgcctaataataatgctgctgtcaatttaatgagggttttagcttacataaataacaaacattcagttcagtggggtttatcttaaactgtacagaggtgcttgttttattataattcaactgaatcagaaactttctttctctccacttgctcacactggcttctaaccaactcacgtttctttaatgacaagtgctaaataaacttcacctggggactgatctgccaataaggataaaaaaaagaattgccccggctaccaaagtatcattgtttcatctccaatgaaacattcccctgtaaaaccatttctctctatgcaaggacttggagtaggaatccagccacagaggtcagggaaggccccaccaccaccatccccactgactcagaaaaggattaaaatattttaaagaaggaggaccagaggacaaaacgtcagcatggtcaagaaaaagtgagcagagccatgaatcgagtgatgaagttgtagattcatagaaaacatgtaaaggctatcatatatgtagaggtaaagtgtcactcctcgttttaagggtgaagaaatgaggcttgcaggagttaagtgtcacacagcagatagtggccaagatagtggccaagccaggctgagtcccatgtccaaatcagtgtactgcttgcttctctgtgcacctgtcatctttagtggtggtgaatggatgagcagtattgaggttaataccctaagaaataacacagcaataatgctcaagtgtaatctagtaataataatgattggaaatcaacattactgtagtgacttcaattgtgtgccccaaaaagatatgtccaagttctcatccctggtacctgtgaacatgaccttacttggaaacagggtttgtgcagatgtaatgcagttaaggatctgcagattaagatcatcctggacttagaaatctactctaaatccactgactggagtcctcatgagagaaaggagagagagctttgacacacagagaagcaactcatgtgaagacccatgtgaagagagaggaagagattgaagttctgtggtcacaagaccaagaatgccaggagccatgagaagctgaaagaggcaacaaacctcctcccctggagctgtggagggagtgcagtcctgctgaggcctccattgtggacttctggcctccattgtggatttctggcctccagagctgtgagccaatacattctgtggttttaggccatcaagtttgtggtcagttgttacagcagctttaggaaactaatacaactatgaaaatacccaatctaaaaagcaatccaggaagaaatttttgttgtcctagtggtttgttgttgtcattgttgattttaacaaaatatagctcaaataacagtactttgaacttttcagttaggaataattacacacgtaacggctcccctaaatgttttttagcctaaagactctgtcaacatttaatattatataaaaggctctgtctacctccccagcctcgtgtcctcccagccttccccttcccccagtattccagccacactggtcttctctttggttccagaacatgctaggacccttctcacctcaggcttctatgtgctcctcctttggctggcacactcctcccccaccatgcaccacctccccagtcaacatcagctccaaagtgcaactctacgggaagccctcctgcccctttataatagatcagccccacacatacactctctttgtaaactctcctaacaccctttccctcttcttcacagtcatgatcattgtttgtaatttttcatttatatttctggattgtctgtctttcctgctggactgtcactctctgacggcaggcacaggacattttgctcatcatgacatttcatgggtagcatgatgcctggcatatagcagccactcataaatatttggaaaataagtgagtgatagtatttagccttggatggagctcttgtctgttattcaaacttatagctgttctgtttccaacatataaaattgaaattgtagaaaaatctgtacatagtcataatttgaaaattaacttattttagtaatgtcttaatttttctcctctgagtttctaaatgaattcatgaaagttctgctttgtcccaaaggcatttcataaataagtaagcatagctaaaagggactcaaacctgttacatttcaccatgccatccgagttcatggataggtgaatttgccctaattagtattatccatttatataatcaataagcatgttgggtaccgtattagtccattttcatgctgctaataaagacatatccgagactgggcaatttacaaaagaaagaggtttaatggactcacagttccatgttgctggggaggccccacaatcatggcagaaggtgaaagtcacgtctcacatggtggcagacaagagaagagagcttgtgcagggaaacttctctttataaaaccatcaagattcatgagacttattcactatcatgagactagcacaggaaagacccacctccatgattcagttacctcccactgggtccctcccacaacacatgggaattgtgggagctacaattcaagttgagatttgggtggggacacagccaaaccatatcattctgccccagcccctcccaaatctcttgtcctctcatttcaaaaccaattatgccttcccaacagtcccccaaagtcttaactcatttcagcattaactcaaaagtccacagtccaaagtcttatctgagacaatataagtcccttctgcctatgagccagtaaaaccaaaagcaagttagttacaccctagatacaatgagggtgcaggcattagataaatacatcattccaaatcggagaaattggccagactgaagaagctaaaggccctatgcaagtccaaaatccagcagggctgtcaaatcttaaagctccaaaagatctcctttgactccaggtctcacatccgggtcacactgatggtgggctctcacagccttgggcagctctgtccctgtggctttgcaggctatagcctccctcctgactgctttcatgggctggcattgggtgtctacagctcttccaggtgcatggtagttctccatgagcaccccgcccctgcagcaaatttctgcctggacatccaggcatttccatacatcttctgaaatctaggtggagggtctcaaacctcagttattgacttctgtataccttcaggctcaataccatgtggaagctgccaggacttggggcttgcaccctctgaaaccattgtccaacctgtaccttgaccccttttagtcacacctggagcggctgggatgcaggacaccaattccctagactgcatacagcacagggaccctggggccaccccacgaaaccatttttctctcctaggcctctgggcctgtgatgggagggactgccacaaagatctcttacatgtcctggagacattttccccatagtcttggtgaataactcggctcctcattacttatccaaatctctgcagccagcttgaatatctcctcagaaaataggatttttttttctatcacattgtcaggctgcaaattttccaaacttttatattctgattctctttttaaactgaatgcctttaagagcacccaagtcacctcttcaatgtttttctgcttagatattttttctaccagatactctgaatcatctctctcaagttcaaagttccacaaatctctatggcaggggcaaaatgctgtcagtctctttgctaaagcataaaaagaatcacctttgctccagttcccaacaagttcctcattccatctgagactacctctgcctggattttactgtccatatcattatcagcattttggtcaaagccattcagcaagtctctagggagttccaaactttcccacattttcctgtcttcttttgagccctccaaactattccaacctctgcctgttacccagttccaaaattgcttccacattttttggtatcttttcagtagggctccactctacttgtgccaaaatctgtattagggttctctagagggacagaactgataggatagacatatatataaagggaatttattaagagtattgactcacatgatcataaggtgagatcccacaataggccacctgcaagctgaggggcaaggaagcaagtccaagtcccaaagctaaagaactttgggtccaatgttcaagggcaggaagtagccagcacaagagaaaaatatagaccagaagactaagccagtctagtctttccacgttcttctgcctgcttttattttggctatgctggcaggtgattagattgtatccacccagattgagggtggatctgccttccccagtccattgactcaaatgttagtctcctttggcagcaccctcacagacatacccaggaacaacactttgcatccttcaatccaatcaagttgacactcagtattaaccatcacaggtacctaatagattccaaagattgtattttaaaatatgttttaatctatagaagagaaaaagaagataacaagaacagtaatgagaggtaaatcacagtgaggctgggtggcggtaaaggaacatttccagaggcagtcactcttgagctgagtcttaaagagtaggagaaagtgagtaaagaaagccatgaaggttgttttaggtcagggtttcttatttttgacatttttcacagaataattctttgttgtcaggggctgtcctgtgtgttttaggatcttaacagcatccctggcctctgtccatgaggtgctagtgtgacaaccaaaatgtctcctgaagatttctcaatgaactgaaaacagaactgcagtttgatacagcaatcctactactgggcgtctactcagaataaaagaaatcattatataaaaaggatgcctgcacttgtatgcttattgcagcactattcacaatagcaaagatatggaatcaccgtaagtgtctaatggatgattggataaagacaatgtggtgtatatatgtgtgtgtgtgtgtatatatatgtgtgtgtgtgtgctgtgtatatatatatgtatacacacacacacacacatatatataccatggaatactactcagccataaacaagaatgaaatcatgtcttttggagcaacatgaatggaattggaggtcattatgttaaatgaaataactcagaagcagaaagccaaatacctcatgttctcacttataagtaggagctaaatgatgtgcacatatggtcatagagcatggaataatagacactggaggctcagaaagggaggagggtgggaaggggaatgagaaattatctaatgggtacaatgtacactatttgggtgatagttatcctaaaagccagacttccccactgtacaatatatctgtataacaatactgcacttttaccccctaaatctataaaaatttaaaaattttaaaaaacgaaaacaaaatgtcacctgacattgcaaaatatctcccctggaatgcaccttcttcccagttaagaaccactggtgggggcagaggaaggagcctatctgcagttgggggtgtctgagttactgcagcatgtccaggtagctctaggagagtgcccgggagggagataggagagaaagtacaacactgctcttacacagggggtttcatgtcttatgctggggagtgtggaatttcatcctgaaagcacttatgcagaatcaaaggatcttaagtaggaagtggacatgggctaatttgtgcttaagaaaaatcactctggtcacagtggaaaggaaggatcgaatggagatcagaatgaatttgaaagaattgaatgtaatccagaagagaaatgattcatggggacagaaaggaaaggaaagggaagatagaaaggtactcacatcacatctctaagaccttgtctagaatgggatctagattcttggtttggatgatcagaaagtagaatcataaatcttctccaaaatccacttggaaattagccctcatgactttatgaaaaaaaaaatcaaacccttgaactcagaaaaattacttgtaaagttggttaagcataatctaggtgacctcatgatgtaataaataaaaatagccactacctccggcttcaaattcaattaggccttcagcaaagattatttcagcaaattgtcaaaaatattagtttttaatcaatgtattagaaaactgtagtaaattttcaccccctgcccccaagcaatgtctagacaagtgagacagagagacaaaatgagtaattgaggccatttttcttgcctgattgttcagaaaattgcctcatttctttgctttattttctgagtccacataatgataacagaaaaagttgtatgtgtggatattttttacaatctgaatctttgacagtgttgagagaggtaatcgccaacaaacacactatcacagcatttgccagatcgtctgttttctttcaggcttttgtcagtatctaaggcaagtcctttgtgtgagaactgactagataaaatgtcatgagcacctcctgtgagggaaagaccgagactgagatctcagtcataaagagactccccagctacaggtgctacaaggtgtgcaaaggcaattaacaatttggggcaaagcgcaattttcatagactctgttttgcaaaaaaaaagaccctacgctacctatttcacaaagttattcacatttctagctcatgaggaacacaggatattcaggccctgctaaaggatatgaataggtcatccaggttttgattaagagattgtttgaacaagtcccaagtgggaataattcaaattaaagcaagaatgtgtcaatacatctgaaatgttgaagaatgcaaaaatagtatttatacataaatataaaatataaatggaatttttatgtgttgatcaattatgtatttttaaatatttggcttcaataacaatataagaaaaatgaaattcctactaatccatagaataatgtgtactttcttttaagaaatcaccaaccttaaaatcactaaaatatgatacatttaacaaaatggtagattttaaattataaaccaaactgaattcagaaagtaaaaattatgatacacagtttatattggtcaaagttgccattaattgtttattatcattaaaaataaatacatatgtttcacttcacatgtgttacacaggtgcttaatattttattaatataaatgcataattcatttgctcttcacaaccacaaaaactagatacatgattattcccattttgcagataaggaaattaacacccaagtgaaatactttaccaaaggtcacataggtagtaagtaacaactgtgtgatcagaggagagcattatctccaaacttcgtgagagacacatataagcaattagtcccttacagactaagaaattttgatacagacaatttgttgcagattcataagatagtacagccagttctgtgaatcacagtgttatatttatttccacatattctatgttaataatataatttttaattccatgtattttaagttttcattcaataactgctataagtatatgcagctctgagaacaagggggaagagaataatttcagccatttaaaaatagcttttatatttagatttaaatatttcagttgcatttcttttttttttttttttactttttacttttctttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggcgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctcaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccaggctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttacccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagctgacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtgctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaagtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttatgtctctatttccttcagttctgctctgattttagttatttcttgccttctgccagcttttgaatgtgtttgctcttgcttttctagttcttttaattgtgatgttagggtgtcaattttggatctttcctgctttctcttctaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggcttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccatcactgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcattttagagtttccagtttttctgttctgttttttccccatctttgtggttttatctacttttggtctttgatgatggtgatgtacagatgggttttcggtgtagatgtcctttctggttgttagttttccttctaacagacaggaccctcaggtgcaggtctgttggaataccctgccgtgtgaggtgtcagtgtgcccctgctggggggtgcctcccagttaggctgctcgggggtcaggggtcagggacccacttgaggaggcagtctgcccgttctcagatcgccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgttgccgccttgcagtttgatctcagactgctgtgctagcaatcagcgagattccgtaggcgtaggaccctctgagccaggtgtgggatatagtctcgtggtgcgccgtttcttaagccggtctgaaaagtgcaatattcgggtgggagtgacccgattttccaggtgcgtccgtcacccctttctttgactcggaaagggaactccctgaccccttgcgcttcccaggtgaggcaatgcctcgccctgcttcggctcgcacacggtgcgcacacacactggcctgcgcccactgtctggcactccctagtgagatgaacccggtacctcagatggaaatgcagaaatcacccgtcttctgcgtcactcacgctgggagctgtagaccggagctgttcctattcggccatcttggctcctcctcccttcagttgcatttcaagtatctttttctgctaagaatttggcctgtctgaatttcaaaaggcatttgggcttcaaactttagttaatggtaaaaaaaaaaaataactaaatatttaatttcctgaaatagttccaaattacagaaacagagagaaagcttaaataccatagaacaaaaattcatagaatagaatttatgaatcatgattcatacacaaaagaccaaacctctcaatgaataactgtattgttgacagtttgggaggaattttaattttgtttttttttctcaaatagtgagatcagagtcggaaaagccttaacatctccatattagagattctgtaactcacatcacttatgccaggctccagctacgtactctgaaaagtatattaaatcagaatgaaaattgttcagtaaaatttctcctagaggtatagtaaatatgattgatttaatacatcattgagattctactggaaaaatggcataaaacagcaacattctgttgccattttataactttcatttttgtaaagtgaccattagcataatatagtaatatcattatgacaatctgcacagatgaaaatatctcaaggccaatattacattttcatcaagtaaatgaccatgtgtttcaataaacacgattatgaatgttaatataccaacagattgagtattttcatttctcagcatcattgtttgtaggggaaaacaaattaatcatctttgagataacaggagtgtagacttttagaacatgatctgtttcactacaactattcttggtttgctgaataagagtcaggattttactccagactgtcctcatctgaggtcatcttatctgtccccttctgaagtaatcttgtcattatgtaaatacctatgcagcattatcaatttagagccagataatttaagatgaatcacgtctttattttgataagtatccacaggacacccatttgtacagtagaaacatgcaaagaaacctcttcctcctgcctgttctattgtcttggacaattcctgaataagctgttctccagccctgcacacctgcgagcaggccagggactctgtggacccagccatgccctttctgtcaccaaggccacatttgtggtcaggaggcaagtgagatggtcatcactttcacttaagtcctttttagcaataggcatgttaggcattggaatggatgtgcaagcgaaatggacacaaaccaaaaatggaagaggcaacctgtctatggccttaccatcccgaatatgcctgatctcagaagctaagcagggttggtttggctagtacatggatgggagaagagataactagctgagacttcagtatctagcttataggctgcttcagccttcaagcacagcttaattatatgtattactggggaagatccttttctggaaagaggcaacattttaagaccattcaagattaacctttacttgagcaaaaagaaatgtttctactttcaaatgctttttggtaaaaatctttaaaaaataataaatgcttcaaagagaataaaacagctaggaatccaacttataagggatgtgaaggacctcttcaaggagaactacaaaccactgctcagcgaaataaaagaggacacaaacaaatggaagaacattccatgctcatggataggaagaatcaatatcgtgaaaatggccatactgcccaaggtaacttatagattcagtgccatcccaatcaagctaccaatgactttcttcacagaattggaaaaaactgctttaaagttcatatgcaaccaaaaaagagcccgcattgccaagacaatcctaagccaaaagaacaaagctggaggcatcacactacctgacttcaaaccatactacactacaaggctacagtaaccaaaacagcatggtactggtgccaaaacagatatatagaccaatggaacagaacagaggcatcagaaataacaccacacatctacaaccatctgatctttgacaaacttgacaaaaacaagaaatggggaaaagattccctgtttaataaatagtgctgggaaaactggctagccatatgtagaaagctgaaactggatcccttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagccaaaattgacaaatgggatctaattaaactaaagagcttctgcagagcaaaagaaactaccagcagagtgaacaggcaacctacagaatgggaaaaaatttttgcaatctacccatctgacaaagggctaatatccagaatctataaagaactcaaacaaatttacaagaaaaaacaaacaaccccatcaacaagtgggcgaaggacatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactaattcaaccattgtggaagacagtgtggtgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatatccatcaatgatagactggattaagaaaatgtggcacatatacaccatggaatactatgcagccataaaaaatgtcctttgcagggccatggagaagctggaaaccatcattctcagcaaactatcacaaggacagaaaaccaaacaccacgtgttctcactcataggcgggaattgaacaatgagaacacttggacacaggaaggggaacatcacacaccaaggcctgtcgtggggtggggggaggggggaaggatagcattaggagatatacctaatgtaaatgacgagttaatgggtgcagcacaccaacatggcacatgtatacatatgtaataaacctgcacgttgtgcatatgtaccctagaacttaaaatataataaataataagaataataataaattatttttctgatttgtttaaaaaaaatcactgtattccttggctgcagcacagcagcaaatgtagctagtataagaactacttatcctgggtcccaaaatatagttgcttgaaaaagtctatattgcgaccttaatttttagtgctttgcctctttgggaactccagtgtgaagagaggtatgcacaacctcacggtcctcaggttgttatcacatggccgaacactttacaacatgaattcatgaattatgtagttaattattacatcaaagaagatctcgccgcacttatcacaaacactcttagttatagccccacaaccttaattgttattgccaagaatttctttccatccactcttcctattttgcaaactacaattacagaggaggtatgaatgaaaagttttctgtatcattccaaaaatatgttaagatgttctgaaaagttctgattccttgatctacgagtgacttagcaacatgattagatgagacaaaacccatagctacacatctttctctagaagtcttaatgtcgactcttgacaaaatttcagatccattcaaaatttcaaatacgttaaaataaaaaaattaacactctaatgttgagattgagtagactatacaaagccttccttaaagattacattttttgcattttctagttttcattcattgcaagaatgtttgtaattgctcagtgaatggctaatttcaaatctgtaccaggtaattctcacatctctgtcatctcacggctgacacctattgattttctttctttttctttcattcactttgagatcttcctggtccttgacattgtgagtgactcttggttgaaacctagacattttagatattattttatgagactacggatcctctgctggttgaaacctagacatttaagatattattttgtaagactatggatctgctgctgtcatcctctctctgcttttctttttcttctccacttactcctacccctttaatccagtgctcaagtaggaccagggaaacattaaaagttggcccacagatggaaggaacattgtacttcatgtgtcacatttaaattctccaggaagaaagggcttgtcaataaagtgtctttttaagtcacagatggcagtaaggctgtgctactcccaccttttctttctattcattgtctcctaatgtcatttattttctgaagtatctaagtagcaccaccactatccaagactgacagtctccatttatattcaatcataactcactagtgaagattaattggggaggagacaagtctgaattagaaatcaccaaagtagtattttaaaagaagtgcagatttattgcattcaattctagacctaattcagagacatggctagaactgttacgaaggaaatgtcttaaacggcctgatttaaagcatagagacaacccatttgtacattagtagaaagtaatgtgttttaaatctttaacaatggttttcttgagtagattaactaccgctttaaaaatcctatttatttatctcctacactaagtaaatttcaacacaacccttttctgaattttcacaaatactacaggagaggaatctaaattagaagctcgattatatatgttatttctgtttaaaaggcactaattaagctgctttgccctgtgagcactagaatttgggttggcacagtcatttcataatctgaactctaacacaattatttctggatgaaccattgccataaaatttaacaggctatattagctgttggttggcattgatgatctataaatactaacctttatctcttgatattttttctcattcttttttatggttaatttagaatttcactgattaggcatttgcttatataaagtgctttgttaagactcaaaacatttttaagcatgtttatgctgcaaagtgaatgagtgttgcaaagtttgacttagtgtagaaagattgtaagactagaagttacttttagaaaacctaaactatcttgtagaaaaattatctcacggtttttaaaaatggcgttcaaaattcagagagaacaattcaagcttgttgctagtggaaagttaacagtggtttagatcagttgtacacactgtgcaagatgtttatgtgctgacagcttgtgtgcctacctccacatcaattcggccattataccagctaattcttctatctaggattcataacataaaaatgtgcttcctctttctgagggaaagttgactatgggtagagaagagttgccgttatttcaccttgaagaataacaatataagctcatgtgcaatgaaatagcagacttattggaaatgattactagcttcttgaaagcaaagaagtatatattttttaacttcataaggatttagaagttgatcattcatcatccccttctgcactctgagtgctgaaccaactgaaaaagagatggaagcaagtgtcagacagaaatcaaaacagtagctcagactgtgtttctcttgtgacataggcccttcaaaccctactttttgaaagagtggctaggatacatgaagtcattacagtatcaactgcatacccacaacatttagaaaatataaaactccccagcccctacttcaaggttatgttctcagaaccagatatatagtgcagtctagccctgcatcatccagcacagtggttcctagccacatgtgactgttgagcactcgtaatatggctactgtgacagaggaattgaattttcattgtgttttaattaatttaaaattatatttaaaaactgattctcaattcactattggaagactttgaagtctacttgaaacaatttcaggtatgtgcatctactttttcaaccataagctacatggaacctaagtataaattagttatttctaattagaataattaattccattaaaatgaaaaggccaaattgagatatgctctcagtacaaaatacataagaattttgaagacaccgcccaagaaagagaatataaaatagcccatttataattgtttacatgttgaaagaattgtattttggatatacaggattaaataaaacacgaaaattgacttttaaaaattcatctgtttctttttacttctttaacacgattactagaaaatgtttaattacatatgcggctcacattgtatttctattagactcactctactagagtgtgatgtagattcaccctctagttggtgtgtaaaagtcatggtggagatttcattgtatctaggggaagaagaacaaactaatgaagggggagaaggagaaaaccttctgactcccaggaagccaactggtctgggccagtttgtgtctctgcatgacttctgagcctgaacttaagtggaagaaatctcccaccaagaagttacttacattgccaggtgtttgtttcttctcagacctaggattactgagctctgagtgtcatcttacctggatgcttcttctcctactcttgtttattaaaagctgttacttctctaggctttgattaacattaactattaaaattacagtgtaggctcggcatggtggctcacacctataatcccagcactttgggaggccaaagtggacagatcacgtgagatcaggagtttgagaccagtctggccaacatggtaaaacccggtctctactaaaaaaaaaataagtacaattgcaaaacaaataaataaataaatctgcagtgtaaaactctcttttactctctattttcctattgcaacataattcagctttccctgggtagccattccttaatcctaggtgagaaaaaatatatattaaagatgaaacatctactaatgcccagccctgcaaaaaacttatactcccatttctggtggaggcaacattgaaggttggctctctggtgtctaaaaagatgttctgcccatgtcgatttgaacacctattttttgtaaaaggccttgccctttccacatggactatgaaggacccacagaagtgaaactgtgtccccagtctaaactccctgggagaacctctcctgactcaataaagaattggtttttctgcccaagaacagagctctgcttgattagtttgaggtcgaggagaccacctggatcaccaagataaatgctttttcttgctaacccaacgcagaaacaggtacatttctcagttcttcaaccggccgaccctgctgcctcctggagcccatatagggtttcttgttcagccatagttctagaccttggctgcattttggaatcacctttctagtctcgagcataaaataaggcccagagcccaggccagactcactacatgagcattttcagctactaaggagaacttgaagaaaagaaattggccaagcagcggactcatgtgtgccctggcacttttcctatctcactaatcgcccttctcatatcataactcacccttctcatgaaaaaatagaatgaataaatgtggacggggaaatgccgaaacaccctcctcataacttgcacacgaatcctcctctatgttcgaaggcagggaaagagagaaaatggtaccaaagatagcctgtgtgcagtacttgaggcaaggctttgcatgtttcaagcgcccaatacttatctgttgacacaaagagtgccgtaattatgttagaattagtttggctttttttttttttctgctctagaaacattttgttcgtataagtcaaaaattagaaagaaagtttggaatttaatttcttatcaggcaatagccaagggaaaatatttctgttaaaggagtaatcatacagaacagctaaaattccaggaataataaaactcaggaaattttggggggagtggggtggttaggttttggaaaatatttgtcagtaatatttgaaaatccagatcttccttaaaagtctacagatttgagtgtacccctcacccaaggaaatctgtctcaagagacagaatcagtccatttttcagggttccccaggaaagtttgtcacagccagacataaatgtgatgaaaggcaggaaagggagagacagaggctgggacaaagaagatgacagactttattggtaacattaggccagaatgataaccataacccaggctgtgttttcaaagttgttgttgtaaactaaatgttttggtatatttgtcagaactttttatcttggttagtttaattaaaataaagtcggtagccaaaataaaattatgtaaaggttaatcaggatgtttcctgtattttttgacataaaccaaattaagtagttatttttctaacacatggaattcttacatttgtctccgtgcaagatgtatgttaatgttagttgttttactacatttgaaattcagtcttttaaaatgggttttctctgttctcctccaaggctatttgagcatctaaatatctacatattacatggctgttggcaaaagttttcaaatgctattcactcaatttgaaaaaaatttgcacttcttataaagctagtatgaatgtgactctaaaatctcaccaattggcactaatcaggttcatcatcaaaataaacctgataaatattaaaactaaattgttgagttggttttgtaatgtcaggattttcaagacaacaaatggccaagaacttggcgtcagaggaagtcctgctttcggttgattcttgatgctgattgagaacaggcctcctaagcactgatgggaatatttgcctctaagaagtacagcccatttaccacttagaagctaaagttcagaaataaaactctgacacaacaaaatatcaataaagccagatagagcactagaaaaattcgtaaatctctaatatgaatatacatctctaatacaaattacattcaagcaacagtgatttgcctcggctgcaagtaattatgtacctattgttaaaatagtgtgagtcacagcaagaacatggacaatatcaattcccttcagagactggactctgtgaagcctttccagttctaactacacagtacgatctttttaaaactatcagctttgcactcatttcagacccaagtatgttgaactggatgaggtattactttcaaggacaaggactggacgttaatcaaaatgaaaatactctttttttcttttttgagatggagtctcactctgttgcccaggctagagtgcagtggcgtgatcttggcttactgcaacctccacctcctgggtgcaagcaattctctgcctcagcctcctgagtatctgggatgacaggcgcctgccaccatgcccagctaacttttgtattcttagtagagacagggtttcatcatactggccaggctggtctccaattcctgacctcaggtgatccgcctgcctcggcctcccaaagtgctgggatgacaggcgtaagccactgcgcccggcctaatcaaaatgaaaatactttcaacatggaaataaagctttccagtgctaaagcttctgttttcttagagcaaaagagctccactaagaagaaaactgaatgttattgagatgttgtttaataagttcctggtatgtagattgaattgtgtcactgccaaagaagataggttgaattcttaactcctggaatctgtgaatgtgaccttatttgggagttgcagatgtaatcaagttcggatgaggtcatactgaagtaaagtgggccctaattcaatgactggtatcctcataagaaagacatgtagacatagccacacagggagggcgccaggtgaggacaaagttagagtctaaaagctacgtgtacaagccaagaggaattaaggattgctggcaactaccaggaactagtaagatgcatggaaatattctcccctagagacttcagagagagagcacagccctgctggcacctgcattttggacttttagtctccagaactgtgagaaaattaagttattttgtttgaagctacccagtttatggtaatttgtttcggcaaccctgggaaacttctatataaggctatgtcagaactcctcttatctcttaggaaaccaaagttctatccttaagcgaatataagatgtaagttcacagataactcagaatgtcctcccgcttctcaagaactagtcctgggtttgcattatccttataaatgccctaagatgattttttcaagcatatgttaccaagaagtagggaagtttcagcattaacaatacatagcttcgtaacaattagccatctgtttataatgctgttagggatcgacagcatctcaatggaagcagggaaaacaacagaaatatcatatctgccaagttctagtcatctgttatgttacatagtaatttgtcatctcatgagatcaccaaggagagaaaaaagccatgccgtgctacaaaataaactctgtaaagcaggtagtttaatagcaaattaatgatgtgctgacaagatcaagaccaaaaaaaaaaaaaaaaaacatgtcatattttctgcagtgcagctaataatgcaagtttgtaagctgtctcacaagaaggtagtatttattttttccaaggagctatttgaaaaccagagagttaacatattttaagacagttttcctcaatgtcagtttattttaaatattactagagttcagatattatcttgctatcactcttaatatccatcttaattatgggagtccctgtggtaaagtctaacctctttcaatctcatctcttgacttgatgattcatttcaaagaatgtgttagtacaatggggcttcttctcaagagcaaagtaactttgaataaaatttacaaaagtaaaagaaataaagcagatggcaaatattgcccacagaattggttatagtatcattatccattaagaaatgaattttgtacaatagatgatttaggtcttacttatctgtctctcataaatatgtatatatgcaatattaagatagatatactgatattgcaaactggcaataaaaaaggtggctttaatatttcgtatggtttggctctgtgtccacacccaaacctcatcctgaattgtaatttccatgtgtcaagggagggacctggtgggaggtgattgggtcatgggggcggtttcccccatgctgttctcaggatggtgagtgagttctcacaaaatctaatactttgaagggatttggagactgggtgcagtggctcatgcctgtaatctcaacactttggaaggccaaggtgggcagatcacctgaggtcaggagtttgagaccagcctgaacaacatgctgaaaccccatctctactaaaaatacaaaaattagctgggcacggtggtctgcgcctgtaatcccagtgttcaggaggctgaggcagaagaatcgtttggaccaaggaggtggagattgcagtgagcagagaacacaccactgcactccaacctgggcaacagagtgagactccgtctcaacaacaacaaaaaaaattagccatgtgtggtggtgggtgtctataatcccagctactcgggaagctgaggcatgagaatcacttgaacccaggaggcagaggttgtggtgagccgagatcacaccactgcactccagcctaggcaacagagtgagactctgtctcaaaaaaaaaaaaaagtgtttggcagtttcctccttgctctctctctctctttcctgccaccatgtaagacatgccttgattccccttctacttctgccatgactgtaaatttcctgatgcctcctcagccatgaggaactgggagtcaactaaacctctttctttataaattaccgagtctcaggtcattcatggcagtgtgaaaatgcactaatacaatatttggaaactctatgcaacaatacagggttcatatattgtccagcctgaattaaagtgctatgtgttatctctcctatcaaactatctttaagatgatgacaaagggatttcaggtgacaacttggaatgaaagatactgacccactgtttgctttcctgtagcttttcctcaagtggataaaaacaattacagctttttttcactagtctactaaattgaactcttaatatcaccccagctgcttttcttgtaggtgttcctttctatgtcaaccacacttctgtttgtgataaggattttcacctcatctgatgaaaagagcagtctactgtgagaaagaactaagcttctactcccaaagcacaagcagtttctgtcaaagcaggaatacaaatatggtcccttggaacctagcccattgcctttccaacataatggtggttattgagccatcagaccatgctttcagcagatacttgaacttccactgtgtatgaatcattatattagtgtaatagagctgtagagataaataagacctagcccatgcttataaatgcctcataacacaaaggacagagaaattatgcataaataaatgcaaaataaatgcagataaatctccatggctgttcagttacacaggcatccaacacatccattgagtatttaccacataccaactttgtcctaaagactgatgatgacacaaattgaaccagatttaggcaaccaccaatctcacaaagtttgcaatccaattagaagagaaaagaatttaaaacagccattgcattatagaatcattaatgcaatgaaaggaagattcccaagtactaagagaaggcaacgctgggacacctagcctaatctaaagggcccaaaataaatatccttaaagtggcatataaattaagacattaccaagtgtggtggctcatggctgtaatcccagcactttgggaggctgaggcatgaggatcgcttgaggtcaggagttcgagagcagcctgggcaacatggtaaaaccccatgtctaataaaaatataaaaattacctgggcatggtggtgtactcgggaggctaaggtggaagaattgttcgaacccaggaggcagaagttgcagtgagccaggatcgtgccattgcactccaacttgggcaatagagtgaaactccatctcacaaaaaaaaaaaaaaaaaaaaaaaattaagacacgaaggataggagttagttagccaatatggtattttgtggtaatgcagctataatctaatcaccgatgaaacagtattccagcaaaccacttcaaggaagctttgaaaaccgaccacatccttttggcctgtccatcatcaaaaaagataatagcccgacaaaccatgggttataaaatgcctgacacataactgtgattacagcattagaggtttaaaatgcaactaggaaaacttgaaaatataagcaccaatttcaaatcactagtcatttgcatcaatttcaaccattcccccgtactcctccaagcattctatttggcttgtgtcgtatccaagaccatccgaaatcacagaataaatttcctataacatgcatctttcgtgtgcataataatgcatactaacaatttacaatttgttataatgtcctataatgtacttctttattgcatctgtgtgactaaagagggcagtcgggagaaaatctaataggagaacttcctagggttgaggttcttcagcttaaaatctttataactgggaccccttacattagcactcagctttggccagtatgtctgagaccactcatatatatatacatatatacacacacacacatatacacatacacacacatatgattgttttgtcattgtaccttgtaaaaaggtatttgttaccaaaatgataaaaggaagtgaactttaaaaaatacatgtcttattactgtcatttggagtattcctcaaaccactgattgtatatgatatagctacctctaggaattcaagctcaagttattcacaacactaaagatacaaactgatttccaaaggtattatccaagaaattaaccgtttataagggaagcaaagtatctttccatttcttttatatttttatatatatatattttaagttctagggtacatgttcacaacgtgcaggtttgatacagaggtatacatatgccatgttggtttgctccacccatcaactcgtcatttattttaggtatttctcctaatgctattcctcccccaggcccccactccctgacaggccccagtgtgtgatgttccctgccctgtgtccaagtgttctcattgttcatttcccacctataagtgagaacatgtggtgtttggttttctgtccttgtgatagtttgctgagaatgatggtttccagcttctccacggccctgcaaagaacatgaactcatccttttttatgactgcgtagtattccatggggtatatatgccatattttcttaatccaatctatcattgatggacatttgggttggttccaagtctctgctattgtgaagagtgccacaataaacatacgtgtgcatgtgtctttacaggagcatgatttataatccttttggtatatacccagtaatgggatcactgggttaaatggtatttctagttctagatccttaaggaattaccgcactgtcttccacaatggttgaactaatttagactcccaccaacagtgtaaaagcatttctatttctccacatcctttccagcatctgttgtttcctgactttttaatgatcaccattctaactggtgtgagatggtatctcattgtagttttgatttgcatttctctgatggtcagtgatgatgagcattttttcatgtgtctgttggctgcagaaatatcttgttttgagaagtgtctgttaatatcctttgcccgctttttgatggggttgttttttttcttgtaaatttgtttcagttcttcgtagattctggatattagccctttgtcagatgggtagattgcaaaaattttctcccattctgtaggttgcctgttcactccaatgatagtttcttttgccatgcagaagctctttggtttaatcacatctgatttgtctattttggcttttgttgccattgcttttggtgttttagacatgaagtccttgcccatgcctatgtcctgaatggtattgcctaggttttcttctggggtttttatggtttcaggtctaacatttaagtctttaatccatcttgaattaatttttgtatatgatgtaaagaaaggatccagtttcagctttctacatatggctagccagttttcccagcaccatttattaaatagggaatcctttccccatttcttgtttttgtcaggtttgtcaaagatccaatggttatagatgtgtggtgttatttctgatgcctctgttctgttccattggtctatatatctgttttggcaccaataccatgctgttttggttactgtagccttgtagtatagtttgaagtcaggtagcatgatgcctccagttttggtcttttggcttaggattttcttggcaatgaggggtcttttttgcttccatatgaactttaaagtagttttttccaattctgtgaagaaagtcattggtagcttgatggggatggcattgaatctgtaaattaccttgggcagtatggccattttcatgatattgattcttcctatccatgagcatggaatgttcttccatttgtttgtgtcctcttttatttcattgagcagtgttttgtagttctccttgaagaggtccttcacatcccttgtaagttggattcctgggtattttattttctttgaagcaattgtgaatgggagttcactcatgatttggctctctgtttgtctgttattggtgtataggaatgcttgatttttgcacattgattttgtatcctgagactttgctgaagttgcttatcagcttaaggagatttggggctgagacgatagggttttctaaatatacaatcatgtcatctgcaaacagggacaatttgacttcctcttttcctaattgaatgccctttatttctttctcctgcctgattgccctggccataattcccaacactatgttgaataggagtgatgagagaagacatccttgtcttgtgccagttttcaaagggaatgcttccagtttttgcccattcagtatgatattggctgtgggtttgtcataaatagctcttattattttgagatacgttccatcaatacctagcttattgggagtttttagcaggaagggctgttgaattttgtcaaaggccttttctgcatctattgagattatcatgtgttttttgtcattgattctgtttatgtgatggattacatttattgatttgcatatgttgaaccagccttgcatcccagggatgaagctgacttgatcatggtggataagctttttgatatgctgctggattcggtttgccagtattttattgaagatttccccatcgatgcttaccagggatattggtctaaaattctctttttttgttgtctctctgccagccttcggtatcaggatcatgttggcctcataaagtgagttagggaggattccttctttttctattgattggaatagtttcagaaggaatgataccagctcctctttgtacctctggtagaattcggctgtgaatctgtctggttctggactttttttgattggtaggctattaattattgcctcaatttcagagcctgttattggtctattgagagattcaatttcttcctggtttagtgttgggagggtgtatgtgtccaggaatctatccatttcttctagattttctagtttatttgcgtagaagtgtttatagtattcgctaatgatagtttttatttctgtgggatcggtggtgatatcccctttataattttttattgcatctatttgattcttctctgttttcattagtcttgctagtggtctatcaattttgttgatcttttcaaaaaaccagctcctggtttcattgattttttgaagggtttttttgtgtctctatctctttcagttctgctctgatcttagttatttcttgccttctgctagcttttgaatgtgtttgctcttgcttctctagttcttttaattgtgatgttaggatgtcgattttagatctttcctgctttctcttgtgggcatttagtgctataaatttccctctatacactgctttaaatgtgtcccagagattctggtacgttgtgtctttgttctcattggtttcaaagaacatctttatttctgccttcatttcgtcatgtacccagtagtcattcaggagcaggttgttcagtttccatgtagttgtgtgattttgaatgagtttcttaatgctgagttctaaattgattgcactgtggtctgagagactgttgtcatttctgttcttttctatttgctgaggagtgttttacttccaattttgtggtcatttttagaataagtgtgatgtggtgctgagaaaaatgtgtattctgttgatttggggaggagagttctgtagatgtctattaagtctgcttaatgcagagctgagttcaagtcctggatatccttgttaaccttctgtctcattgatctgtctaatattgacagtagggtgttaaagtctcccattattattgtgtgggagtataagtctccttgtaggtctctaaggacttgctttgtgaatctgggtgctcctgttttggttgggtgcgtatatatttcggatagttagctcttctttttgaattgctccctttaccattatgaaatggccttctttgcctcttttgatctttgttggtttaaagtctgttttatcagagactaggattgcaacccctgttttttttttgttttttgttgttgttgttgttttgctttccatttgcttggtagatcttcctccatccctttattttgagcctatgtacgtctttgcatgtgagatgggtctcctgaatacagcacgctgataggtcttgactctttatccaatttgccaatatgtgtcttttaactggggcttttagcccatttacatttaaggttaatattgttatgtgtgaatttgaccctctcattattatgttagctgtttattttgctcattaattgatgcagtttcttcacagcatcgatggtctttaccacttggcatgtttttgtagtggatgataccggttgtttctttccatgtttagtgcttccttcaggagctcttgtagggcaggcctggtggtgacaaaatctctcagcatttgcttgtgtgtaaaggattttatttctgcttcacttatgaagcttattttggctggatatgaaattctgggttgaaaattcttttctttaagaacgttgaatattgaccccaactctcttctggcttttgggtttctgctgagagatccgctgtttgtctgatgggcttccctttgtgggtaacccgacctttctttctggctgcccttaatattttttatttcatttcaaccttggtgaatctgacggttatgtaccttggagtggctcttcttgaggagtatctttgtgatgttctctgtatttcctgaatttgaatgttgacctgccttgctaggttggggaagttctcctggataatatcctgaagagtgttttccaacttggttgtattctccccattacttttaggtacaccaatcaaacgtagatttggtcttttcacatagtcccatgtttcttggaggctttcttcatttctttttactctcttttctctaaccttgtcatctcactttatttcattaatttgatcttcagtcactaataacctttcttctacttgatcgaatcagctgttgaagattgtgcatgcatcacaaagttcgcgtgccatggttttcagctccatcaggtcattcaaggttttctccacactgtttattatagttagccattcgtctagccttttttcaaggtttttaacttccttgcaatgtgttagaacatgctcctttagctcagaagtttgttattatcaaccttctgaagcctacttctgtcagcttgtcaatgtcattctctgtccagctttgttctgttgctggcaaggagctgcaatcttttggaggagaagaggtgctctgatttttagaattttcggtttttctgctctggtttctccccatctttgtggttttatctacctttggtctatgtgatggtgacctacagatggggttttggtgtggatatcctttttgttgatgttgatgctattcctttctgtttgttagttttccgtctaatagtcaggtccctcagctgcagttctgttggagtttgctggtggtccactccagaccctgttttcttgggtatcaccagcagaggctgcaaaacagcaaatattgcagaacaacaaatattgctgcatgatccttcctctgggagcttcatcccagaggggtgcctgcctatatgaggtgtctgtcggcccatactgggaggtgtctcccagttaggctacacaggggtcagggacccacttgaggaggcagtctgtccattctcagagctcaaacactgtgctgggagaaccactgctctcttcagagctgtcagacagggatgtttaagtctgcagaagttgtctgctgccttttcttgagctatgccctgcccacagaggtggagtctatagaggcagtaggccttgctgagctgtggtgggctctacccagttcgagcttcctggccacttcgtttacctactcaagcctcagcaatggtggacaccccacccacagccaggctgctgccttgcagtttgatctcagactgctgcgctagcagtgagcaaggctccatgggcatgggaccctccaagccaggcatgggaaaggttctccttgtctgccggttgctaagaccttgggaaaagtgcagtatttggtcagaagtgtcctatttttccaggtacagtctgtcacggcttcccttggctaggaaagggaaatcccctgaccccttgcacttcccaggtgaggcaacgcctgccctacttcagctcaccctccatgggctgcacccactgtccaatcagtcccagtgcgatgaaccaggtacttcagttggaaatgcagaaatcatccatcttctgcatcgatcacactgggtgctgcggaccagaactgttcctcttcggccgtcttggaatggagctctatctttccatttcaatgcagccactttagcagttctcttaaagctgaaaatatatagaaaaagataaaacctttcaacagctacagtgatcctgaagtaaattactgtgtatatgacacagtgcattatcaaattgttgctgcatcagcatgtcattttcaaaatgaaaacaagtctattaaagtgcatatcgaaggtataaagtaggatgatagtgtatagtttgatcatgagatattgcttgcagtgtaagtttcatagaagaaaaatggtttgagaaaatggatcaaagggaaatctccaagttgacaacaatgtgttaagagaatgagaatttcaaagtacaactactgaaaaagccaaatttatgcagacaaagtgaaaaagaaatgaatcaaccctggaagagggagaatcagcacatcaccgtcaaggaaaacaagtacaagaataaatggatgttaatttcagctcacaagacagtagtaatttcaaaataactaaggaagggaagtgaaaaaataaactgcagtgtcataactgactcttgatccggagggatgtataagtgtccctgaataatgactgtagttgtggttttgcttttctagcctccttgcttgataaaaaagcctatggaatgatgtaaaacatagattgcagataataagtttgtgccaaggattggctggtttagctcaatttcatatcaacttacaatttaacctagagtattttacatcatctcatcagtttatccatttaaattgattatcttgatcttcttttattttttaagatcatccagtaagtatgtattcagcatctaacctgtactaaatattttgctaaggttgagggagacattaaactcacaacactcctataagatggacattattattacttccatttaacaggtgaatgactaaggcaaagtcatattagatgcccaaggtaacacagctagtaaatggcagaattgttgtgttagttcaggtcctccaagaagcagatgccaagacaagaatatatgtgcaagagatttatggtattgatctatgttgaaaatttggtgaggaagttgcaggagcctaactgagagagactcaggccataacgctggtctgaccctatggaggaaagagggaaggaaggaagattgggtaggaaatttcttagtctctggtgcagttctagaaaattttggcaaggctcatgggaagtccttgagctaaagtagcccatatgaggagccccacatcttgcagaaatgggcctgcctgagtatctctccctgctcagcattgcctggggcagcccatggaaagggtggcccagaaattgatgtggtggtggatcccaagcagctgaccatctgtcattcacactcctgcaccaggaagttgagaggccatgttactggtcccacagctgagatctcaacccataaaccttgtggcagagaaaacatgctcaaccccaatgccaaggcaatcctggcattcaacataaaatcagagaatgcaaatctttatatgccgcaattcataaattctttgcatttttttagtctgcttctgcttatatcagagatagaacatccaaggccaacaatacacttcttgtccttgagaacaggtggaagtcacctaggaaaatggaacataaggaggatgggatcctcttgtggcatctgttgtgaccctaggagagacattgtggatggcgaggggatacaaattctggcttacctccgtggtctgaggatagggggatcctttcagagtccctcctatccctcaggctaaccaagcatctccccctaccctcaactattacctggtcccaggtaagaaaggaaggaggctttccagcatagccttacttttggctgggcttggcaaagaaggtgtttggagtaattatggcccctcggtcacccatgaactcagaccaaccatcactggcctcccttccagatgatctctatttgagcagtttggtaatattttggaaagtacatttcactcatttaatgggaaaataatttaaatatgatttagatatgtattgaaagaatttactagatattttaaccatgtgacttgttgttgttgctatttgtattaggggaaagatgccagggaaattaggtaactagtctaaagtcttgcaaaagtaggcaggatttgaacttaagtctgtctgacctgaaggccacattccttctcctccatggccccctgccccagatattttactgggctcgggctttacaaaatgcttgtacatgtgctatttcatttgaactgtaatattagctactattttccagtccagtattatgggacttaaagacgtcagtgccagaaggtctattggttcttttcccctcctgggactcctcctctgcctcagttgccctcattggggtatcagcccccactacagccattacaaccggcttggcacgtccacaggggctgctgcccactgaagtgggtacaatttctttatccacccattcttctccattcctttctcttttttttttttttgcccctttttttaaccctatcttcattcttgagttcattcctgccctattactcctccaaagcacacatgctatccactcttcttcactttgagactatgtgagtcgtggccgaatagttcgggaatttattttgcacaatttgcacaggccagctcctctcacatctgcttcaatgatctctgtctttatcttcccagttctggtgtctttccttcagctctggatttcttgctttggttggagccactacctcgacatgctcctgggtaatgcttttttcgtacgtgttttaacttttattcacatgagtgaaattgatttttaaattaccactgtccctagcaggaaaaagccagtggcagagccagaaagagaatctactcctccttggcccaccctacattctttgactatcacaaatgccctgtggagaaagagaaacctgcccaccctgtgtgttccaatttactgaaataacatataaggcatgatttggttattttggaattcctcaatttctgatgttatcataccacagaattttgggactatttatcagttgagtgttaacatatcagatccaactttgtaattcttctttttagcagttgattatatttttgaagcccacaagcaccaatttcagggaaaatataagcctaaaatcattcactagaaaactacagaaccgaataggagagtaaatattatttaacttatgcttatgatttgatgtctttatttcttttttattgtgaagcagaattacctttgcctagcattctactgactcaccagtctaaccaatctaccttctgagggtggcagcaagatgggcaaatctggagatgagctctttcaacaaataaacatcatgatagattcctggaaggatttttggtgttttggccgtaactttctagttcaaattgctcattcatgaatcgtcacaaaatgacattcaaaaagaaagtaaatcttgattcaattcattatactatgaagcttttgacttaagaattagaaaaaaaacctttatccaacaaacacccttttttgggggcgtagattacttcctcaattccatcttaccacagaatcaaatattcccaagtatcaagtatccttctcatgtgaaattcttgctataaatgccaaacaagaggaaaaaagaaaaatgtacaaataattaaaacacaaatatatagcatgttagtaggcattgtgtgaatgaaaaaatagttcatgtctctttagatttatgcacagataagagataccattcaatacatgtgctgatcaaagcctaaatatgaacattcaataaagtaaaagtgctaacaaaaatttgagtttggcattaggtcaccaataatgttaattgattgtacttatacataataaaagctaacattttaaatctatcctgatagacaggaataggaatccacgctccagcttgggatcaagaaaactaaaattagtaacactaactggactccttaccactaaggagctctaaccagaaacgtttgttaaaataaaaagatagggagtgtatactagtatgcctttggacttagctaagaaaaatgtaaaatataaaattgtattagtccattctcattctgctaataaggacatacctaagactgggtaatttataaaggaaagaggtttaatggactcacagatctacatggctggggaggcctcacaatcatggcagaacacaaaggaagggcaaaggcatgtcttacatggcagcaggcaagagagcatgtgcagaggaactgccctttataaaaccagccaatcttgtgagacttattcactatcacaggaacagcacaggaaaaacccacccccatgatttaattagctcccacagggtccctcccacaacacatggggattatgggagctacaattcaagatgagatttgggtggggacacagccaaactatatcattctgcccctggctcctcccaaatctcatgtcctcacatttcaaagccaaccatgcctttccaacggacctccaaagtcttagctcattccagcattaactcaaaagtccaaaatctcatccgagacaaggcaagtcccttctgcctatgagcctgtaaaatcaaaagcaagttagttccttcctagattcaaggagggtataggcattgggtaaatacacccattccaaatgggagaaattggccaaaacaaaggggctacaggctccatgcaagtccaaaattcaacagggcagtcattaaaccttaaagttccaaaatgatctcctttgactccatgactcacatccaggtcacaatgatgccaaaggttggctcacacagccttgggcagctctgcctctgtggctttgcagggtatagacccccatctcagctgctttcatgggctggcgttgaacgtctacagcatttccaggctcacggtgcaagctctcagtggatctaccattctggggtctggaggacggtgacgctcttctcacagctccactatgcagtgccccagtgggaactctgtgtggggggttccaaccccacatttcccttctgcactgacctaggagaggttctccatgaggggcctgtgcctgcagcaaacttcttcctggacatccaggcatttccatacattctctgaaatctaggtggaggttcccaaacctcaattcttgacttctgtgttcctgcagactcaaaaccatgtggaagctgccaaagcttggggtttgtgccctctgaagccacggctcaagctgtactttggctccttttagccatggctggagcagcttggacacagagcaccaagtccctaggctgcacacagcaggggggccctgggcccagcccatgaaaccatttttccctcctaggcctctgggccagtgatgggaagggctgccatgaaggtttctgatatgtcctggagacattttccctgttgtcttggtgtttaacattcagctttgtttgtttgtttatgcaaattcctgcagtaggcttgaatttctccccataaaatgggtttttcttttttattgcatcatcaggctgcaaattttccaaacttctatgctctgcttcatcttgaatgctttgctgcttagaaattcgttctgccagataccctaaattatctcactcaagttcaaagttccgcagatctctagggcaggggcaaaatgctgccagtctctttgcatatcaagagtgacctttcctccagttcccaacaagttccttatctccatctgagaccacctcagcctagactttgttgtccatatcactatcagcattttggtcaaagccatttcacaagtctctaggaagttccaaactttcctacatcgtcctgtcttcttctgagccttccaaactgttccaacctctgcctgttacccagttccaaagttgctttcacatttttaggtatctttatatcagtacaccatttcccggtaccaatttactgtatttgtttgttctcatgctgctaataagtacatacccaagactgggtaatttataaaggaaagaggtttaatggacttacacttccacatggctgggaaggcctcacaatcacagtggaagggaaaggaggagcaaagtcatgtctttccgggcaggcaagagattgtgtacaggggaactgccctttataaaatcaacagatcgtgtgagacttattcactatcatgagaacagcccaggaaaaacccagccccatgattcaattacctcccaccaggtccctcccacaacacatggggattatgggagctacaattcaagatgagatttgggtggagatagagccaaaccatatcaaaaatgcttccagtgaatagacctggggaaaataaaacaaagtaatttttaaaaatgcttaacatgaccaggcacaatggctcataccgtaatcacagcactttgggaggccaaggtagtaggataccttgagcccatgagttcaaggccagcctgggcaacatagtgagactctgtctctacaaaaataataaaaataaaataaataattatggttttaaaaatgcttaacataaccctttctacttcagcaggagggatagatttacattttgggatgttttcagcatcagattactctgggtgaccctaccttcagaagcagataaaagtggtaacaacacaattaaggagtattcttcagtgaataaaatatttgagagtacagaggtaaagaataaaagttctgtggtcccatctagggctaaatgtcaacaccataaaaatcatactgaatcactctgatcctatcactgcagaactgaaaattattccatttattttatacacattgggacccaaataagttccaacttatataaaagaatgaaaagtaaatcctgacaacctaccggaagagaacactctgccccgtgctttccattctccttcgaatgcgtgagtgtctctccctgtctctctgtcctgctctctcacgtcactttcttttctccatctttatttcactcttctttggtgtctcctttgcttactgacatgtattgggcttttttcttatgcattgtcctcctcttattgcttattattattagtgctgctgtgcgaaaagttttgtttctttttttatcatttcaaaagcagaggagaaaaacgtttaaatgtatattgctcagccaaaataatgtttatttgcatgggaacttcgatttgtgtgtgtttgtgtggtataccagagagaatggggacagcaatttttcctattgtagaacgagaaaaggaccaacccctcttcaataacaccagataatgggtaaagtggctgaagttagttattatgtgctttaccaaaccttggaatcaaattgtaatacaaatattattgttattccttcctttccctccacatttttttttaaatagcagttagggggagtgatattcccctactttgctctgtttggtcaatctctggctcatcataaggtagagacgatgttttctaggaagcctgaacgtagggtgcttattattggtgtgatgtttagtttgttaattcccaccagcctgagaccaccaggagcacaccacagaaaggtgggtctgtgggcttgcaagaacaggaacattagaggggggtgtgcactgtggggaactacggggcatccttgtaagggaatgtggagaggaggatattataggattggggctggtgtcgggtgatttcagggagtgaagatttgttgtggattgggtggtgctcaggaatggatgcaaattgatagcaggagggcccacgtggggctgtttgtcattgggaaaaaagtggtagccagtcaggttagccagatgagggagtttttcggttatttttgtggccacacatggttttggtgttcagacacaacgaaggcttttttgtgttgtttggccatgatcatggagtgaacctgtttgattattgctgatagtctatggaattgtattatgttcaggagtctagctgttacctcagtctggctggtacctgcaaactgccagctgccagagcctttttgtttttccttctttctcaggtctcagagtaaatgttaaccaatcggtcagtccatccatgtgtaatagctgctatgcccagcactgagctaaacattatgaacaccatatggggactttctcattaataaaacacccacatttaaaaagtaatggaaaagaacataaaagaactagagaatacttaactaatatttgaaaccgaagtaaatattctatcactcatccattttgtgccctagaaggttctaaatgaaaagttttggtaaaacccttcatttatttcatagctaagagaaagggtactgtttgaaaattaatttttataaataattgaattgttcctcctcctagataagctcaagacactttgttaaatgaacacctgacaaaggctttcattttttctaattacaaattagagatactagctgggttgtgtctggttttttttcattgtttttgtttgtttgtttatctttgttgttgttgttttttacctcttgcagcagttgaaatgcatgtggtctttggttctgtatatttaagctctagtttattacttctaatctttaaaagatattaaatcatttaaattggcagacaccagtgtttgctggctgctcgaatattaccatttaataccctacattggagaattaaagcatggtgccctgctataggcaaagtttagaagagtcctgcctgtcatcttgatggtttccaacactgagttttctaattactatattttggtagggcgaaactgagtatgctgatggtttttgcagctatggtagtaacatttttccagccatctttaggtatgtttttcagtggaaagtttagcattggaagtttagggtttttttttttttctttttcttttagtggagtgatgtataggtattctattttattactcattggaaaattatctatttgtacagtgcctaaaacagctgaacacctagtaattgttcagtaaatgatgatgatgatgatagtgatgatgatgatgattttctcttcaaattaaggacaatgtcaaattaattcttgttctctagcttctaatacagtatttgactcagcctccctaccagccacttgactttgctaattacttatgttgtaatcatttgatagtaatttgaattattctttttttttgagatgtctttgtattccttgaaagaaagttattgtttgttatatatcaaaaatttttagcaatctttagggtcttttttctctgaaaactcaagtttatttttgtctttttatcaaatacttttatagatttaggaaataacttattctagtttaataaattatacttggcccgttattgttactccctaatctttctttgtttctgatggggagaaaggatccttttagattctttttaagtcactctgatttcattctggaaagaataaggcaacatacatcaaatccttttgagaatattcaacatgagatagttttcttttaagtctgacagtggcaggccataatactactgaataaattcttaccaaactgaagcttctgggctcagtttcaatgttttatttagtattgttctcaccagctttcttctgacagggctcaatgaagatgttagttaatattcttgcacattgcatttggatgggtttgctctttttggtactgactctgttacggttttcacaatgacacacacttctgttggtttattactaaccatagttgttattgaagagaacctctctttcggcctcagtgatgtagtaaacggtaattttgcaatccttacaaattcacccttatacaatgtatggtacatttctgaacatggtaatttttaagtgctttcaacttgcaaagtagcaaattgatacacaggggatttccgacagcttcttctccagactgaatgtcactcatgggattgtgattccatgtgaaataaggcaacattggccggaggagctgccatctggactttgacgacgaaggcatcatttacacagggctggcattcagagccagggtcacaaagcagctctttccaggagcaaaatgaagttgtcaagcaagtatttgctctgactctgccaggcaccattcagatatgacaaacttgccttcctctttttattacagcttactaattctggagaaagatggaaatttttttttttaatgcgtgctcttccaaaggtcaaaacaattttaaacaagggcaggcacagtcctgcaataaaaattcagcaatctagttgtgcaataagtccgtgtaggggctgagggaagtgtcatgtttacctctctggaaagggcactgtaatcaaaagactgatggcaagaggagctttgaatttgttgttctatttctcccacatctgcatgaaattgtgtctttgaaactatatattatggagatgagtgatactggagagaaacacatgctctgaagtaaacagaaaaatacagcagcataataaaatgctttgcccacttttacagcctctgtggtggccatgaaataggagatgccaactgatggggatgtgagtggagctgtttgaggggtggatttttccccattactacacatagatgcttgcatctttccctaactgtgtatttccttaggtgggtaatgacagtcagtggaaaagccagtgcctgctgttcaaacacagtgtggaaaaaatgaaattgaaaacagtggtgatgagatccagttctccaatattcctctcctagacagactaaaacctttcttctcccgcagcgttagcgctcactctggtcctctcagctgcaaagcagatggatttctttgagaagtggtcagaatttccttgattcaggagctggacctcacgccctcctctagggctccatcatcaccacacaggcacacggccacacctgagtcccatacacagagaagggtggtcatggacaaaagaaacagtggacaaagttttgtgtatgacaattcctggtggctccaatagcaggatggatggatttgggctattaacagaggtccaaaatcccaaaaagtgaccacatgtagatgagacagtcatgacttttatgtgcatttgaattgggcttgagatacctaagtggggatgcctaatcgacagttggatatgtgagtctgagtctcagaggaaagagctgatttaaacgtacaaatgagtgagtcctgtgtctactgaaggcctgaatatggatgagacagcacagaaagcagaagaagagggagcatagaaagacgggacttggaaagtgccaactttttcattgtttgagttaaaaaaaaaaaaagttaagactaacagaaatagcaaccagagaagtaggagaaatcaggaccagctctcgggacataggttaagtgtaaagactgttccaagacaaaggaatgacagggacaatattgagcatcaaatgctgctgagaggtctggtaaaataaaaaatgcaaagatctattggatataatgaaatggaaggaggagtagaccttaacaaagaccattttcatgtgatgattggagttgggtgtgtgtgtgtgtgtgtgtgtgtgtgtgtgtgtgtgtgtttccaagtaagataatcagtcttagatgccagtgggaggaatcctaagagaaataaagaataaataataatgtacatctcctgagaagatggagaaagggtagaaccctaccataagaccaggaagtggccagaggtaggaggaaaaactgctgtaagagacaggagaagatggtattcctacagacagaatggtgaggcatttctctctgatatcctgtatttttccatgaatttaaaaatgagatcagttgttgaagaatgaaaaggaagttcctgagagcatagacacaaatagatacatgtgttttgttgaaaggccaaagagtgaaaccattggaattgagtatatgtagcaccaccaaatgcagaaatctattaaattgttaagaatatggaactggagttcacaggagggagagagagagtgggactagacttatgtggcattagcattaccaaaggtgtgtattgtagtcatgggactgaattcatgaagtcatttaatatatactgaattattatgaatcctagtagctgcagagaatatatactgagttattgttatgaacctttgtagctgcaaagataaagtgagatggcttccacccgctgagtagtcgtcggtctagaaagaagctgacatttacacaggaaataggcagtgtgaccgaggctccaataagcaggacaaggttttataaatgtttgtaagaaaatgcacctctctttgctagaagaatagaatagttagaataggaaaacaatgtttgtatctatacataaagaaaaagcaggccagcaccgtggctcacgcctgtaatcccagcactttgggaggccgaggctggcagatcacctgaggtcatgagtttgagaccagcctggccaacaacggtgaaaccccgtctctattaaaaatacaaaaattagccaggcctggtgatgggtgcctgtagtctcagctactcagaaggctgaggtaggagcatcgcttgaacctgggaagcggaggttgcagtgagccaagattaagccactgcactccagcctgggcgacagaatgagacttcatccacccctcatccctaccaagaaaagaaaaaacagtggcaaacttgatgaagaaatgagaagaatatttctgttaccgagaagaggtgtgaataatgttgttacaatatatgcaatgtaaagaaaatagacatgtggcaatataatccaattaggtcacttctgaaaacataatcagaaaaaaaaatcatagaatcatgaaataataaagccagaaacagagatcatcaaagtccatgccccatgttagacagcaggaaagagcctgaggaagaaatggaacgttatgatcataatggaggtggaatagagtccagatctcctggctccaatttcagtgatcacctcactcactgatctctatttcacagccactcttgcactggctggaatatgcaggatctgtaatatccttgggaaggaacagaattctctggggtccactgtcaaatagtggacatctgaatcagctgcttcaggtgaggtggtgctcagccccctgcctctgtccacagatagagaacagagttactttgtgagcctctaggctgtcaacattacccttgcagatctgtaggatttatgctatgctggagacataactgccgacctagtgggaccagagtggaggtaggaaggcttccgagtctctctttgtaaagcctgtgactacgagccaggctttaacagaatccctgctttactccctttttgtgggttatgccatgtacctctatagtctcccaagaatctgtcaagatatcagcttttattactcattaccctaaacctaaagaagacagacaggacagaacccaggaaatccaataagtggatttcccagaaatgaaagtgcatagaacctagaaatccttatatgtgaattttcttgtgaataaaaagtataatagaaaaacaatttggtttgacaaatatatacagaaatcttttgtttgtgtgtatgtgtgtttatttaagattcgcctgcttttgtaaatgtaatcagctacatacaatttttaaatttctcacttccgtaaaattgtctttccttgggtcatgattctgaacactgatataactgtacagcatgatagatagggtaggtgtagaaaattgtactgaattgtcattgagtgttggctataccagggtctcccagaatatagaaagccttgtgctagttagaaaatgggctcctcttctctgcaggccaattagtttcagccagcctcatgagctgactgcatactgaagtcagccccaaatcctgccctcccaaatcaacctgcactaccatatcttaagagtagactgtcaaaacaagtccctggtttactcttttttttgagacagtgtaagacacaagtagattattgagcttcctgaaaagatagattcagagtaattaaaatttgattttaatgctgctaagaaaagaatagagatgtgatataaagttatgacacaaggaatacaaataagattatcacttatggatgatggctgtttgaaagataagcccaattatgaacaccaatacagattctgcaaatgtatgttcagagatggttatataagtggcataattgctgtaccttttacatagaaaaattgcagctattctttaatcaactgacactgggagaaactgattaggtgtgataaagttgcctcaggtgaaatccaatttcaactgatagactgaggcataaagaaaggaaaaaatacaccgaaacaccagaattcaaaatgtgcgcatgatttttaaaatttattttctcttttttctttttttaaaaatgtgtttagatatgaaaaaagaaatagaataatgacttgaattcgtgcatctgaaaaatgtttattaaccacctaactatggacaggtgctatttatcagaaaccaaaacaacagctcaactctactggatcataaactctagtgggaggggacaaaataaacaataaacaaaacagtatctaatattagaggtggataaatgcaaatagataaataaagtaggataagggttatggagtgaagcaaagatgctctttggaggttattaagtgaaagccagcctaacaaaatggcatttgaagaacatctaaggaaggaggatgaaaggtccttgaggatattaaggaaagagaatttcaggtggcaaaaatagtccctgccaagccctaaagtgggaatgtgcttgggtgtttaaggagcagcaagatggcagaccggctggaacagcgtgagcaaaagccttgaacaatgaaagaggtcagtgataaataaggaattcattcttcacagaaaatggggcgatgcatccaggcaggttataaagattaagagttgaaatcagagaggcaggtggttttgatgttttgagatttgcttcctaataggcatcttaatcaaattattcatccagagttgcaaagcagcaataaccaaaaacatatctgaatattgagtaatttgtcacattcattacaatcaaactgatatcatttgcctcgccagaaaaaaaaaaaaatgactaattgacataatgtgaagagctttgaagaattgcatttaataccagcaggttaatcaaaaggctaacgaaacaagttttagttaaatacatacaaggaaaaatgtattctgtgtctttcctgctgttgtcaggaaaaaaagaataagggcaaattttagtgatttcactgtttatatgtgtcccttttacccacttgaaaaatctgccacttattattgttattgaattttccgtcatcttactgctcttctgtgagattggaggactttgaatttgtgccacttttattaactgcttgtgccatcgagaaaggctttagcatcttagtttcctgggaggaagaccgggtaatggatgaataatgtgtgactctgccagtttgatgtgttataaacaaaaaaaggatttgtgcccccactaaatagcaggcttgatatgagacctcaggttttgagctgcataagcagcgtcttgctctgctgttgaagaatggatgcatttttcagatagtaagtaacacatgactgtctggagagtaacaagtattgggttggtgcaaaagtaattgcagtttttgatgttactttcaatggtaaaaaccgcagttacttttgcactgacctaatagggttaaaggtcaaggctaagtattttaatgtcatcaattttattttctttcttaatgtgttaaatagtagaaaagaagaggccaggtcagaaagtctcaatattaaggcttatttgtctcccttgtccttttctggactctcctggtcgtgtcttcatcaaattgggttaagaaaccaaactcagcttgagatattctccaaggcaatgtttatgtggagttggttcaggccccagcacgttgggaagaagtagtaaatatcataatagtgattgtagttattgatcagtattggtccaatcatcagagctttgatctttccttctttgtcaatttcttttacttttgactacagattcattcagaactccaccccccgccaccccgccccatcttgcagaagccacactttctccttcatcaccctttggctggtctgtctctctctccttatgttcagaaggcttttctgttttgatcattcatgtttgctttcttatatcaccttaacctcttaaagcttgatcacctgaaacatgagtctgccgctcagatgattctaatcctcaaatctgatgatgtcggccaacctttacccttggaacactggaacatttacctttctgaaacactcaccgctcgtttacctgctagaagctggagtacagaatcagtgtccaggtggaactcccagtctgtagggaagatgagcacataaagtaactgcaacacaatacatgaatcagaggaagaaatgcaataactaagttctgcatgaactgtggcttaacacaaatagggaacaaatactagtggctgtgggaaatgagaatgaaagcagatttcagagaagtaacattcttcaaatcacgttgcctagacccttcccattttgtagctgctttcctaaattctttcttcctctcctgttgctgcagcaccctaagaggtggggccttagctagccatgtgccccattccacagactgtcccatgctcaggcatcagttgtcactgtggatgactcacagaattaaagatgcggttctggctgggcgcagtggctcacgcctgtaatcctagcactttgggaggccaagacgggtggattgcttgaggctaggcattcaaaagcagcctggccaacatggtgaaaccctgtctctaataaaaatacaaaaaaattatccaggtgtggtggcaggcacctgtaatcccagctacttgggaggctgaggcaggagaatcgcttgaacccaggaggcagaggttgcagtgagccaagatcatgccactgcactgaagcctgggcaacaagagggaaactccatctcaaaaaaaaaaaaaaaaaaaaaaaaaaaagatttggttgtaatctctctctctcttgaagtcgtaagtcccatctcttgtacatcctcatttccaagttgctatgtcagagggcttctcaaccagggtgctactggcatttgaggtgtgacatttattgtgcagaactatctaacacattgtaagacattcagctttcatgggacctgaggcactacatatcagtggcaccttacacatgtttccgaatcatacctgaggaggtagtgccagccccagttgagacccactggcacatcaaattcaccctctataaaattaaactgaaaaagtgttcatttcccccaaaattaacactctcctactgacatttctttcaaaatgttcagatttgcgtaatcgtgaaaccaagcatttaccactagctgatccatcaggtcaacacatcctactaatgtccttttatagtatgttttccctctgtctgttaggcagaatgtcacatccatgatactccaagtctttatcacctaatttgtagaatagttcctctatttactgttgcctttcctttatgtcacattgtataataaaatatcaccttgaccatgcctctcccttgctttaaaacctacagtaacagacttcgactatacaattaaggccaaatagatacaacaaaagtgctcccccataaacatttttaaaatgcataaggccaggcgtggtggctcacgcctgtaatcccagcactttgggaggctgaggtgggtggatcacctgtggtcaggagttcgagaccagcttggccaacatggtgaaaccccatctctactaaaatacaaaaattagccagatgtggtggcaggcacctgttatcccagctactcaggaggctgatgcaggagaattgcttggacccaggaggtggagattgcagtgagctgagatcatgctattgcactccagcctgagggacaagagcaagacttcgtctcaaaaaaattaaaaataaaaataatttttaaaatccttttaaatgtatgattgagcatgcaagaaattgaggaagatccttgaggcctaaaatgaagaaaaatcatgaaccaaggttataaatgaatgccaaagccagaagctgacctaaaggcttctgtcagttccatgcaaccagcagcttttctttcagtggctatatgaggaagaagggtccatgccaagtaataaattatatcaaatatccctgtatggaaaacaaaatccagggggttagactctcaatgaaaaacaaaactgaaaatggaaaaatccactctacaaaagaagataatgtaaaaattttgattatctgaactttagctcagagtacaaagaagaaattatcccttgaagctatgtaatagaaagccagttctgatgcatgtttacagcctaacttcacagcatttgaatggttggagaaaactcaagctgaaaatatattttaaagaggtcccagattggtaatgtctccatgtatctgagaaaagcaaatgcagatgatctgagagagacataccttctactgaacctcacaggattctcacagacatatttccaagaaacatgatctcaaaagaaaaaataatcaccaaatgtatggggaaacaagatactgtaattgtgaatcaatagagataactaatagcattttcagtcctacagaatcttcaggtattgaaattattggattgaaaaaaattttaaagagaaaagtggatatactattaaaaataatgggtaacatttgaaaaagaaccaaataaacattacaggaataaaaacataatagataaaattaaaagcttaatgttagagataaatagcagtttctacccagctaaagtaggaacaatgaaattaaaaatagattctgaagaaatttcccagaaatctgcccagtgagagttgtcaaatatgaaaaataaaatattaaaagcaaggagattagatcacaaccaatcaatacatctctaattggagttgtgaaagaagagataagagtggtgaggccttattttggtgaatgatggctaaaaattgaccagaaccaaaaaaacatgcaaattaagattcagattaaggcatcatagtggatgtaagccagaatgaaagcaatccccagctagacagaaattacagattatttacaaaagaattgaaattaaactgaccattgacttcttgacaatggaaccctgaagaaacaaactattgtgagaaaataaccattgaccttgaatatgccacccagaaaaaaacacatatataaagtctaaataaagactttttaggacaaaataatgataacatactaccctctgaccctagagaaaaaaagatctcataagaatagtctgagatagaaaaaagagggaacaaagaaaatagtaaaatgtcagtaaatctatgcaaacattgacaatattgagcaataaactttaatttgtgatatttaaggaaaacaagatgaagctaaaaaatagatgaaataccttatatgtaaggaacagaaacaagctataaaattgctgtattgtttaggaagagaataaatatactatgttgagacactgttaagttaaatatgaaatttaaactttctagggtatctactaaaagaatgatatttaagagaatgcaaaattctaaaccagtagaaaatatatggaatgaagaaaaactatcaattcagaaggaagaaaaaatacttaaacattagtaacaataaaaagcaaacaagagagaaaaaaaggtacaaatatttggaaataagtccaagtcagttatcacaataaatagactagactctccagttaaaagataattttagacaattaaaaagaaaaactatgtgctgtacacaagagatattaaaaacattaaggacaccacaaagtctgaaagaaagatgatagaaaacaaggccaggagattacaaattccaaaaagctattgtgagcctattgatacgaatgcaaatgaaagagaaaaaaaaattacaattcagagcattacaatagcataaaaatttccaaattactgaaaatacctaatgctaaacttgggaagattgaaagatatagtattatagaagaagcttttaatattgatgtctcagtaattataggtcagaagcctttaaaaatcattaagtgtacagagcagcagtatccaaaagaactttctgaggtgatcaaaatattttctgtacaatatggtagccattagcacatatagctagtgagactgaaaaactaaattttaaatagctgcgtgtggctattggttacctactgggcaacccagataggattaaatagcataattaataactgtgagtcaatgcacacatagtactattagaaaataaatattttttcaagcacatgtaaaatgtttttgaatattgaccacagactcgattctttaaaataaatctcaacaaatttcaggttattggtatcataaatcctgttttctatgaccaattaaattttaaaaatcagctaaaaagacacttttacaaaaaaagcttaaagcaaaacatataattagacattttaaaaatacttctaaataatccctgcactgtgggagactgaggcgggcaaatcacgaggtcaggaattcaagaccagcctgaccaatgtggtgaaaccccgtctctactaaaaataataataatcaaaattagtgcatattatcaaataatgatgacagcataattcaaaacttgagggatattcctaaagtggtattttgatagaatttatagtcttatgtgtatagtaaaagcttagaaaggctgaaaattattgatccaagcatccatcttaagatattagacaaagaagggaattcttgtacacttttggtggggatgtaaattaggacgaccattatgagaaacagcatagaagttcctcaaaaaataaaaatagaactcccatatgatccagccatctctctacctgctatgtattttttaaaactgaaatcagtatgtcaaagaggtatctgcattcccatgttcattgcagcattattgatagtagcccagatgtggaatcaacccaagcgtccatgaatggatgaatggataaagagaaagcaggatttaaacacagtgatttctggaacacagaagaacatagaatacattatgttgagtgaaatgagctaggcacagaaagacaaataccacatcatctcacttatatatggaatttttaaaagttgcactcatagaattagagagttgaatggtggttaccagaggctagggaatgggaggttgcagagttgttgatcaaaggatataaaattttagttagataggaggaataagttcaagagatctattgtacaacatgatcattatagttaatacagtgcattgcattttgaatattgctgagagtacacaaaaaatgataagtacgtgaggtaatgcgtatgttcattagctccactgagccatttcacagtgcatacatatttcaaaacatcatgttgtatgtgttaaatgtatttaatttttatagatcaattaaaaactattttttttaaaaagaatagactaaaggattataggatatatccaaaggaagtagaacaaatgaaatgcatgtaaaagcaggaataaatgaacaagaaaatcaaccatacagtaggtaaaaatcaacaaatagatttttttttttttttgagacggagtctcactctgtcgcccaggctggagcgcagtggtgagatcttggctcactgcaacctctgcctcccgggttcaagcgattctccttccgcggcctcccgagtagctgggattgcaggcgtgcaccatcatgcccggctaatttttgtatttttagtagagacggggtttcaccatattggacaggctggtcttgaactcctgacctcctgatttgcccgcctcagcctcccaaagtgctgggattacaggcatgagccaccacgcccagccaacaaattgattttttgaagagactaacaaaatcaataaacttctggctagactggtcagaaaatagcaggaaaatatattagtagaaatgaagaaaagggatataaacacaactatttcccaatatatttaaatatttaaatgcaaagagcaaattcatttaaaaaaaacaacatctacctggaatataacataaattagaatataaacttatagaaatggatataagaataatcttataatgaaagatactaaattatatgagcctcagatagtttaccaaataattccaacatagccccccctaccattctttgagtccagtattaacttgataccaaaaacataatgatagtacaacaaagggaagttataggccaaagtcattcatgaatacagtggcaaaaatcctaaacaaaatagcaaagcaaacccaaccatatgtatgaagaatgatttatcacaacaaagtcgatttttttaaaagtactattattagaaaaaatctctgaacgctaaaaggagaaaaaacttttatcattttaataagagcagacaaaggattgaataaaatttagtattgattcatgcaaaaaaaaatcctaacaaatgagaaatgacaaatagcttccttaaacataaagatgaactattcttaacaggtgatagcagcatctcaactcaatggttacacataaaagcgttttctttaaaatcaggaagcacgtaaagaccgtcatcacaacttagtttaacattgaactaaatggatcatatccactgcattaggacaggaaagaagacatatttttataatagatagaggttggaaaggaacaactgttgttaaaagaataagagaaacaaaaagaatcaaagaaacaaatagcatatgtttccattccatcactttggtattaatcacacttgtttctggagaccatggtgtaaaggaatgagccaggattactgaagggtcctgcagtgccagtgaccacaagacaagccagaaccaagttaacttagagtgaattggcctattctttaatactgctcagaattacaaactcccatataatctgtcacttaaattccattcaaattaataaaatctaattcatttgaataagacttaaagtgatttgattctactgcatcaaattctgctcagtggaatcagtccttgattgaaatctattaagttcaattcagtaaaataaatttaaatattatgcaatacaattaatttttaattaattaccatttcagttcaggtccattttgatctgaacttcaattctacatttctaaatttggtccctattcaaatcaataaaatgcagcaaaatccagtgtaattctaaaagatacaacctgaagctaatcaactgcatttatttctattcacccctaatcagatgagtttagtgacattcaatcacagaaagataaaatgctcacctttaactaccaaattgaatgtttacattagaacttcagaattaccaggttttcccaaactcacatcaccatctgcagtagggactccacaggattttatcttgactcattctttgtttggcttatatattaacatagaacaatgtagaattggatggttaggaaacaaaagagaatattgctatcctgtttaataagctgaaatcataggtaagttgagataatagacttttgcatctatgagaatgccaatacatgattttttattttatttttaaagttcttaatttaaatagtaaaagacaggaatttttgactccagaccatggttataaaactgagaaaaaaagtattaaaaggactgtattattcagaaaaaaataattgggaattaaattgagatgttactatagtaacaccattatcacctctttgtatcttaccaagcaaacaaggtcctggattggtatcccaatggcacccagtcatctgggcctctttgtttctttatagatgttcccaagtgtccagtgaactccacctaccactgtccttttcccaggtcagtatatggcagactggtctgatggtaaggatcacagggacactgagtctcaaactcttcctctgagattcttattctacaggacaggggatctatattgtttacaagatcttagtggaatcatagggaaattgaaaacccttccctatacttacctcccacccgtgggtgaaaaacaaaaaaatcagaagttattactccacggcttcacctcccccacttcatcctcctgtaaggatcctgagacttcagctaccatggcccagatcttggaagtgattctgtgcggattttccacatgtaaaagaagaggaagctgtctgtatttaagccagagaactttaggactagtagcctgtttccatttccagtccctgggggaggggttcccatcaggtttagctttaagcccctatattcctggaagcgtacacatccatactggggaaaacaagaaaattctggccggcttgatcttccaaattacagctatcagatgatttggaggactctatagaggctacagcacctccaaattccttctctgctccatcccatcctggagattattataaaagcttttacctttcttgttatctaggacatttgcactggaaggaaagtttctcacaggtgcaagaatgttttgaatggtctagaattgcaccaattaaggatgcctatacttagtaagtgtatcatcaccattcataacttaatatggattttgtaatcagatcagagtgctcagctgaaatttacttataaagtggagaaaaaagatttggtagtggtaagaaaggaagagagaaggaagtaggagatttttctgagcatgagtcgcttagaaaaaatcctgcactgcaagggccttcaaataaccaaatgttaccagagagcagagcctgggaaggactgccaatgagctgccggcaggggacactgggaacaatagtgaaaagcgtgtttgtgctgcaagggtacctgttctatttcctcagctgaagagcccccagggactctttaacagaatttgtagataaggttgtaattgtacatatgataaaactagttctcatcaagccaaaaagatgcttttacgttttcattttggagattatatacccttgtggtgttgtttttaatatcctatagaaacagtgggaatgaaagaaattaaatgtcccagagactgtgctgggtcttatctcagagggcgccaggatcatatttatttaagcagcctgttaagttactctgtgtagcccagaagttccgaagaacacattttgaaaatcacaggtatgcacctcattttcatcaagcagtccccaagcattcgcccttgtgcttctgaaacaacttcttgttattggtgaaaataaataacagaaatctattggtttctttttctttctttctttctttctttctttctttttttttttttttttttttttgagacagagtcttactctgtcgcccaggctggagtgcagtggcacaatctcagctcactgcaaactccacctcctgggttcaagtgattcccctgcctcatcagcctcctgagtagctgggattacaggtgcacaccaccacagctggctaatttttgtatttttagtagaaacggggtttcatcatgttggccaggctgattttgaacccctgacctcaggtgatcctcccacctcggcctcctaaagtgttgggactacaggcgtgagccaccgcgcccagcttattggtttttttaagtaagtcttggaaaactcctttcctttctagcctattttctttctccctttcccagtttaatcatccacaccataataaacccttcaccataataaaacttgatctgaagtgagtacaaacagtatagtgattatatttaattcatttcatatttggctgttttaatacaatatgccttactttgataatttagctctagttaacttagaatgccattcatcattacctaaccttgttgcagtgaccatagctacttaatatagttaaatacaatcttcatattctgaggttagagaagttcttgaactcttggaaatagataattcagttatttctttcctcaccactttttgcccttgtcttttaaaaaagctttccatttttattgcctttaactgctattccccaaagccaattaacaggtaaataatgatttgtaaagctaaaagtagcatttcattagcatagcactggaataagggaattctttgctcaaaataaattgaaccgttctcctcttgctgaatataaaatacacaacaaattaataatttattttagttacagtgatttaaccaaattagccaatgctaataacaaagtctacaatttcctttctctctggaatacgtttttcttattggcattcttttgcagtagatgtggaaagagctaagttaagcattttgtgctgtattttaacttattttcctaggaaaaagaacagaacaacatcaattttgcatcagcctcactgggggcattcgttatatgaagactaaagtattgtgacttgagaaagagtgagggatgggagaagaagctgggaaaccaggctgctcttgccaggtcactaacttgccacctccttgcacctgtactccttgcacatggaggaaatatttcagatcatccccttaggtcccatcctgttgtgtaataagagtccctctctactgtaagctgagggtctgccatatgagattagcacacagcctggatcccatgcacagctcagggcttctactggaacacccaccgtaaccgcccaaggagttcaccttgcccgctgcctagacagagtcgattcatcaagacaggggagttgcaatagagagagtaactcacgcagagccagctgtgcaggagaccagagttttattattactcaaatcagtctccccaagcatttggggatcagagtttttaaggacaacttggcgggtcggggggaagccagtgagccaggagtgctgattggtcaggaatgaaaccacagggagtcgaagctgtcttcttgcacagtcagttcctggatgggaggcaccagatcagatgagccagtttattgatctgggtggtgccagctgacccatcaagtgcagggtctgcagaatatctcaagcactgattttaggagaagtttagggagggtcagaatcttgtagcctccagctgcatgactcttaactataatttctaatcttgcggctaatgttagtcctacaaaggcaatctagtcaccaggcaagaaggaggtctgctgtgggaaagggctattatcatccttgttttaaactataaactgtaagtttctcccaaagttagttccgcctacacccaggaatgaataaggacagcaaggaggttagaagcaagatggagtcgattaagttagatctctttcactgtctcagtcataattttgcacaggcggcttcaccactgcccaaacaattcaacaatgaaacttcctttcctgggcttctgagcactctctgaaggtacagtgggaaccagctgtctctcttcttttcccctagagtatgttccttgtagtctcattctgaaggtaaagctgattgttatcttctccttttactgagaatgtcctaatttttacaaagaatactgggccacacacagctctctgattcatgcaaattattactgtctgcaatgaaaatgaaacacagtgttaggttgtttctactgatcactcaaaggaacaatcataaattgggcagagattctgagatatataatctttcattggttatttgaggtatgggcaggacaaaggagtcatctgctagacaaacctttaactccacttttacaggtgcccgatttgtttcttctcctccaccaagagtgttagtgtcctctagtttccaaaaacagtgatactaaccaaaaattcctttgagagaatttagcatgaggtcagctttttgaatgcaatgcaaaaaatgaatatgataatcagttttggtaatgtttctatattttcagggtcaggctgtggcctgcccagcctcaaaggcatttcatgaggtcaaaatggaaccatctacctttgtcctctctctataacatggccagagatggaatcagccaagacctagtgtagcttttgggccaaatgaccttaacatttctttcggtggttgagatgctgtggtttccataaatgggatatttcaacgcttatttttgaaactctagacttcataaggagaaaaatttattattggccatgggaagcatcagagaagctggatgctttaccacttaccctgatggaaaaagaaaggagaagcaaatgacttaaacatagaaagcaaacacagcccccgcatgctgggaccaggcacaggtggacagaagacacagcttcagggtggacctttatgtcagaaagcgggcatgtttctccctttggaacagggtactgagctctccctcttgactgtttaccagattaagtcaaatatactttctttaatgtgggtgccaaaaatggtcatgccaagggaaaataataacttccaaattaagtcaacacacagaaaaatcaagaaatttgtttggagggagagaatacctgaataactaactcattttcaaattcagagggcttgctcattcattacattcatcctggactccagtccctgttcattctcaactttaaatcacccacctgttaacaaaattattcttgaggaaaactactggaatatctgagaaagtaccacagtatttttttgcataattccaatatggtccctactttttgtattgtttgtttagatattgtgactgttcacatggtaactttatgattttcctcacctttatttctgagcactcatagagtcaagtgtacacttaacatcccaagagggtggatgagttattaccatggaattttaacccatatacccagatttttttttctttttttttgagacagagtctcactctatcaggttggagtgcaatggcgtaatcttggcccactgcaacctctgccaccgaggttctagtgattctcctgcctcagcctcccaagtagctgggattacaggcacctgccactgagcctggctaatttttgtagttttagtagagacggggtttcaccatcttggccaggctgatcttgaactcctgaccttgtgatctgcccacctcagcctcccaaagtgctgggattacaggtgtgagccaccacgtccagccccagagattttaattgactggctattttggcttactggctgacattacctctgttagattccactcattccccagcttctggcaaggaacctctgttctcttagcataatgttctcaaggttcatccatgttgtcacatattgcaaaatgtcttttttaggtctgaataatattccattgtatgtatacacaaatattatatgactctgcttatatgagatatctaaagtagtcaaatccagctgaatgtggtcactcaggcctttcatcccagcactttgagaggcagaagcaggtgaatcacttgagcccaaaagttggagaccagcctaggcaacatggcaaaaccctttctctgcaaaaaatacaaaaattagccaagtgtggtggcatgtgcctgtagttccagctactcaggaggctgaggtgggaggatggcttgagtccaggaggtcaaggctgcagtgagttatgattgctccactgcactccagcctgggtgacagagtgagaccctgtcttaaaaaaataaataaaatataaagtagtcaaatcatagaaacaaagaggtcaccaggggctgggaagacggggaagtaggcagttgctaatcagtgggcataaaagcttcagttaaacaataaaagtaagttctagaaatcagccatacaacaccatatcattaatgctacattggacactttaaaagttgtcaagagagtggatttaacattaagtgcattctcatatgctaaagtcatattaagaataagaaagagtcatccagtcagacgggttggctcccacctgtaatcttcgcactttgagaggccaaggcgggtggatcacctgaggtcaggagttcgagaccagcctggccaacatggtaaaaccctatctccactaaaaatacaaaaattagctgggtgtggtggtgcatgcctgtaatcccagctacttgggaggctgaagcaggagaatcctttgaacctgggaggcagcggttacagtgagccgagatcgtgccactgcactactgcactccagcctgcacgacagagccagactccatctcaaaaaaaaaaaaagaaagaaagaaagaaagagtcatccattgtcagggtcttcctgctctctgcttccattctttccactgcctaccacgtctaggcttttcttcccgccattcacctgaaactcctttcatcaaaatctctagtgaccttccagctgtcaaattaaaagaaaactcttagttccccatcttaatagacttcactatgaaatctgatggtgctggcccctctgctctctgggaaatcctcctgtgtttttctcccatcaccctggctgccttcgttcttgcactctgctatggtcatctccatctctggtacggtttggctgtgtccccacccaaatctcatattgaattgtaatctgaattgtaaccccatgtgtcaagggggggacttggtgggaggtgactggatcatgagggctattcccccatgctgttctcatgatagtgaggaagttctcacaagatctggttgtttgataattgcctggcacttcccccttcttgctttctctctctcctgcccccatgagaagacgtgccttgcttacccttcttcgtctgccatgattgtaagttttctgaggcctcctcagccacacaaaattgtgagtcagtcaaacctcttttctttataaatggttaaagacccagtcttggatcattctttatagtagtgtgaaatcattcttgggttttggtgggttttttgtttgttttgttttgttttgtttttgagacagagtctcgctctgtctcccaagctagggtacagtggtgcaatctctgctcactgcaacttgcacctcccacattcaagcaattctcctgcctcagcctcccaagtaactgggactagaggcgcctgccactgtggccagctatgaaatcattccgtttttgaaatgatgttgtaatctaaaagattccagcagcatttctcccacttccaatatgttctggtttgccctgatagttcctaaaacatattttcagctcagaaaatcctcctgagaaccagacttctacaatcaatttgtacattttgtgagcaaacccattatcttttcttcaacattccctagacttttgatgatgatcttccttccctgtgccctaccttcatggagcatagtaccatccccattcatacaaaccagaagcctggattaatccacagcactccctgcccatcttctcttctacctaaatcccaacagtcccagccagctataactcctgaaccttttttgtgtgtgttttctcttctcctccatttctactactattttattacttcttttctctattaacataagagcatcacatctagcctccctgaatccattttgcagaaatctatctttcatcttcctgttgatcttttgaaacacaaatttaatcatgctagttccctgcttaaaatcctttactagtttcccattattttcaggataaagttcaaacgtcttaaattgggggaagataaacattgaaaagaaaggataaaccaatgaaaaataacttcttacttggacaaaggtattttgcaatgtgaccttcatctgctgtccatctatctcttactatctactactgctcctctcagcacatctcttcagcccaattctactacatatgaatatagtcctatacatattttccaaatagaagtttacctttctgtctttttacattctgctccatttgcctaggaggtcttacctctcttatgtccttattgatctgtgtaatgcatacttgaccttcaagatgcagctcaactattttgcctcctctgggagaccttcctttatgacctcatttgcctcccccactctcctctgtgttcataatactgataaaactgttctccaatctgtatctttttcttccattctgttgagttgcttctaatgtttggcacattgtgggaacccagtggatgtttgatgattggatgaatgaatgaatgagtgactattaggccaaatgataaaggagagttgggggctaatctgctgtgtggttaaaagaactacttaactcttctagacctaaatttctttacccataaaattaggaggtcatactcaaaaacagtgaaagtttgtgcttagctccaatattctatgatctccatgacttagttcacaaaaaagcatgaccagtcacgagaattgtatggtgtagaatcagttcatggcccatacaccttcattgcggactgaccgcaacttggcttccagtttactaaatagactcctaaatcacagaagtttgaatgtaaaattgtcttccaaggagagaggtacatattcccatgagaaatcttaagcttaacactcccactgatattttttatcaaatatttctactattgacataaatttacctttatgcttatgtttatatttatatacatgtaaaattgtgatatatacttttgaaaactcgtctaagcttaaaagagccttttgaagtatagaattaaaagcttttttaaaaaaaacaaatttatttctgtaggtttttgggtaacaggtagtatttggttgcatgagtaagttctttagtggtgatttatgagattttggtgcacccatcacccaagaagtatacactgaatccaatttgtcatcttttatccctcacccccttcccaccctttcaccctgagtccccaaagtccttgtatcattcttctgcctttgcatcctcatagcttagctcccacttatgagtgagaatatacaatatttggttttccattcctgagttacttcacttagaataatagtcttcagtcccatccaggttgctgcaaatgccattaattcatttctttttatggctgagtagtattccatcatatatgtttgtgtgtgtgtgtgtgtgtgtgtgtgtgtgtgtgtatgtgtgtgtgtgtgtgtgtgtgtgtgtgtatgagaaacagtttatttatccattcattgactgatgggcatttaggttgcttccacatttttgcaatggtgaattgtgctgctataaacacatgtgtgcaagtatctttttcgtataatgacttcttttcctctgggtagatatccatttgtgggactgctggatcaagtggtagttctacttttagttctttaaggaatctccacgctgttttccatagtggttgtactagttcgcattcccaccagcagtgtagaagtgttcccctttcaccacattcacaccaacatatattattttttgattttttgattatgggcattcttgtgggaataaggtagtattgcattttggttttgatttgcatttccctgatcattagggatgctgagcattttttcatatgtttgttggccttttgtatatcttattttgaggattttctattcatagccttagcccactttttgatgggattgttttttcttgttaattcatttgagtttgttgtagattctggatattagtcctttgtcagatagatagactgtgaagattttctcccactctgtgggttgtctgtttgaaataaattgacttttaagagggttgagtgatgttcagactatcagagtattcctggggaagtgggtgtaagtgtggcagtctaatgactgaacccaggtctgtttctaaatatacctttgccttttcttgtagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggtgagtgcctgcgggcagcacagccaggctcaccctcccagtgtgcctttgtgtcaaactcatgtgatagaagaaagtttgaaaagtgctataataatacgataatagggtagaaaggtctggaactaacccaactgacaaatgtcaggaacatactgaaaaatataaaagcagaaagaggtcagtgcgacaagggtatgcatttagaaactgagacataattgatgtgttcatattttattcagagaggaaaataatgagccatgttgtagacagtgatttgcattataaaatgtgctgtgtaacaatagagggatggctgggggcgggaagccagtgtgcatgagtgcaggcagtcaacagcctcctgcggggagcacaaccacctcctgcaatgtttgcgttggggatctggattggaaaaataggagagagagagagagaagggaaaaaacaaagaaacagaaaaaatcattctttgctcttgtcttctgtaagtgcttgcctgtctacttttctttcatacctggaattgtttataactctgatacaaatcagttcaagaaagatctattttgggtttcttcgatccctttgctggcttttgttctgccccgcagtgaatagctgggtctgtgtcagtaacagataaagataagatcagctgccattctttgtgaaaaaggccccagaagtttaggtggaagactataaacctaagtgtgattctttgcagaagcacatatccagtgccggctttctacatttttagaagtgttgagaggctccatttctgcttctgggcagctgtgcacatagccagtcatggtcatgaatttccccatatgcccagccatggttttcttcagttcacctatgtagtatgctatttacagggacagtttacaagacaaattcattccaccagttaaccaaaaacaaattctgagaacgtaactttatatgaatttcaggtaggatgtctgcttactttctgaaagttatatttcttctagtaaatataacaaattacaaagcctatctatttcaatggcttagaatgtgtgtgtatatgtgtgtaaaatacttgtaaatagctatcattaatctttaattatggattattgtaaagaagagatcatgataatttttaattttatttctttgaaagatgtatctacacacacacacacacacacacacacacactgtatacaaagattggaagttgggaatggagttaaaagggcatggtctttgaaattaaccttttattcattcgttcaatcattcattcagtgaatcatccaatcagtcattcattcaacaaatattgatcaaatacttatgagtcagcaactcttctaggcactggggataaaataccaaatgcaaagaacaagaatccctgtcctgactcacattcttgttcttgatgccttttattactagttgtgtgttcttaagccaggcagaccttctcccatccatttgtctatccaacattaattccctacctcttcaggaagctgacattgggttcagcctccccaactaggagaagtgggaacagagccccagctggttcattgtccaggcagcccagagtgccctgccaccatcaccttgtcccaccacagaggagagaagagggattcagaaagagtaagatctagtacctgcacctaagtgaacttcatttttatcagacatcatgctaagttctagggatacagtgatgaatggaacatggtatttgtcctcaggagctccaaaactagttgaaggaaacacacatgtgcacacacaaatagataacataatacagtcagtgttgtgaggaaggtgtgtgcaagatacaacaaaaactaatgaaagtggcggggcgtagtggctcacgcctataatcccagcactttgggaggccgaggccagcagatcacctgaggtcaggagttcgagaccagcctgcccaacaaggcaaaaccccgtctctactaaacatagaaaaaattagccgggcatggtggtgggtgcctgtaattgcagatactcgggaggctgaggcaggagaatcgcttgaacccaggaggcggagcttgcagtgagccaagatcccagatcgtgccactgcactccagcctgggtaacaagagtgaaactccatctcaaaaaacaaacaaacaaacaaacaaaaaaaaactgatggaagaaattttcaatctaactggaggagtgaaggaaggaatccataacgtcttggaggaagaggcataaacttgaaagacaaggaaaagcaagggccctgggacactcgcccttgcatggtggtcttggagaagaagcatgacggagctgggccaggctggggaactgtctgtgcagttgacagttttgaaaacattaaggccctagcatgacatctgtgtctaaaccctgagggctaccattagtagaattacaggttgaaaacatagattttttttttgagatggggtctcactctgtcacccaggatggagtacagtggcaaaacctcggcccactgaaacctctgcctccccggttcaagcaattctcctgcctctgctggcacctgccaccatgcccagctaatttttgtatttttagtacagacggggtttcaccatgttgaccagactggtcttgaactcctgacctcaagtgatccaccctcagcctcccacagtgctaggattacaaccatgagccaccatgcctggccaagatagatctttattttttttattttttatttttttttttgagacaaggtcttgctctgttgcctgggctggagtgcagtggcgcaatctcagtgattctcctgcttcagcctcccaagtagctgggactacaggtgcccaccaccatgcccagctaatttttgtatttttagtagagttgtgatttcaccatgttggccaggctggtcttgaactcctgacatcaagtgatctacctgcctcggcctcccaaagtgctgggattataggcgtgagccacggcgcccagtcacaagattgatttttaaagatatatattagcctctgaagccatttcaaagaacatgtctgaattcagatcacagattagaagacattccattccacccttattcccagacctcctcctctggcaagcttcaattgagttctaacatttcacagttactcagggacttggtcactgctggtgtcttgttctcttctggcttagcagcagctaagacatcccactcctttgcttccgtaaagtttgtctaatatttcataataaaggcactatagcttgagcaaactgaaaagtataatgaatatttttttttttaagagacggagtcttgctctgtcacccaggctggagtgcagtggcatgatctcagctcactgcaagctctgcctcccgggttcacaccattttcctgcctcagcctcccgagtagctgggactacaggcgcccaccaccacgcctggcttattttttgtatttttagtagagacggggtttcaccatgttagccaggatagtctcgatctcctgacctcgtgatctgcccacctcggcctcccaaagtgctgggattacaggcttgagccatcgcgcccagccatgaatgttttttataataaatagctcttaaaatggtcttccctttttagcacaagaaagaatgctcttggagaaatcttcttggtctttgaattcaccagcacctagcaaaggccctccttcctatgtggatgctttagatatttgggagtggatggggttgcttctagagacactttctaaagctctcaggggcagtgaagagaaagttgagcttgatgcgggtagaccttacatccaggcccagatttgccacttttgggggaggcttttaacctctctgaaatttaatttattatctgtataataaaaataaatcttggcaaatttttgtgatcattaagaatatagaatataaaagccttctataaattatactatatgggatagttatttgcaattctattgcattattttaaaatttattttctttatttatttattttgacacagagtcactctgtcaaccaggctgaggtacagtagtgtgatctaggctcaccgcaacctctgcccccagtctcatggctcagcctcccaagtagctgggattacaggcacgcatcaccatgcctagctaatttttttttttttgtatttttagtagagatggggtttcaccaggctggccttgaactcctgacctcaagtgatccatccacctcagcctcccaaagtgttaggattacaggcatgagccaccacaactggcccttatcacaattcttaatgattccaattgactcttaaatgaaaataaatgaaaacagagcgtggcaagtaggccccttcatgctcttgacctgctgtgtcgtaggcctcaagtctaattccacaacgccacatgcagatgttatgaaacaggctttactagagaaagttataaatcagggatcatcatcagaagagcaagtacaggtctccaatcccatcatccctcagggagacgtgcgaaagccaggctattccgctgaatgcaccaagggcattcgttaccaggaagcccctgcttctctcacttctcacaaagcaaaaatgacagcaactttgtcagtaggggaaaatcagatgcatggggcaccaggcagtctgggcataggtgcctgctgtttacaagtgttgtctgggagtcagagcccctccaggaacagggaggaagccagagccccttcttgaagctgactttgggtgtagtctctctaactaggagaagtgaggaacactgtccaggcaacctggagtgcactgtcacgatcattgctgttcagtttttttgtttctccaaacacagagaagggctgggagattatgggaaataaaaatgtagcacatacatccaaatgaaactcacatatgttaaaccacgtttgttgtaatgtcagggtaaaaataaaggttctattaaatctcatgcttttagatgctttgtccagttaagaaagctattttcaataatctgaatcacaaagcatcattggattaagatgaactaagaccaaaatgaggacaaagtacccgtgccacttcctttctgtgtgatctaagtcaggatatttcacatctttgttttcttatcagcaaaatagaaatagatagtatagtacttcccaagtcatgtaaggatcttggtaaattgctgtcataaatgaaagtttaaaattacagtgtgatatattatttttattattatttgaatgttgaatggaaccttagctaaaaattattttaaaatgtcttaaattacagatgcataaattggggccctgaaaaatgtaaattactttcaaaaaattacagtagaaatgaggagtagaaagaagaccaaagacacacatctccaaacacccaggccagtgttcttccacaatatcaggatcaaggaagtttttttaatattgtttttatctatctttttaatgatttcagaatgtaatttttaactagcttatatgtaagctttaaatttaaagcttaaaccacagaccacattatatgttctttttctaagaactctaaaacttagattgaatacttattcttatttactggtgtaaaatgcataaaaatggagccaggataaatgagattgcagctcagagcatgattgggtctcacaacgaagctgcaatggcctgtgagtacgatcaccatttcaataattgcctgattatctatgctgggagaagttttgcgcagttatttctgagattgaatgtaatttaacatttatgatttactattcacagcaatagtaaatattcccacctacagtgccagaattctaattacacgagtcttggtctcagctaagtggccactgctgggtaattcctggtctcttgcagcctgactcaatgagctaaatcaccatatctgaaattagcaattcgaaaatgaaattatcagggaaagaattgccattcattgcgtgagtacccttctcttattgtagaatttctggatagttatgtcctggccaagatgggcacatacatggtggaaaataagtgaagtgaaaagccgttagcacagtctttgtgttacaattagtcagcagttcccacctcaacattagaaaggccaaatactagccgttgtgctctctttcgctgaccctaaatggaattggcttgtctaacagcctttttcttcctgggccaaaaataatccatgaccaacttttatagcagctgaggggagttaactaaaaaatatcttcgatatttcaaagccagaaacatatttatttggttgggtcagcttactatccaacacctaattctgaatatttttaaaaataatcgttataattttttgtccttgtttataagaaatttgattgaatcttagtgacttttttcatgaagttttagactgcctcttactcaaagtgaaatatttatatatgcattctcattcgtcatgttgtttaaataatagtagttacatgtcagccactgttcatgtatgtttcatatactgtgtcatttaaacatctcattgactctatgccaaaggtactacatattttgtctttattttagaaatgctccagagagattaatttctcccacaaggtcatatagttaaaaagcagtagagcagagattcaaactcggggcaagcaactttagactcatccttaggaattacacaccaagactgtattagcctgttctcatgctgctagtgaagagacacccgagactgggtaatttataaaggaaagaagcttattggactcacagttccacatggatggggaggcctcacaatcatggcagaaggcagagggaaaagtaaagccacgtcttacatggctgcaggcaagagaacttgtgcaggagaactcccatttataaaaccatcagatctcatgagacttagtccctaccaggagaacagtatgggggataccacccccatgattcaattatctccacctggtcccgcccttaacatgtggggattattacacctctgggtgagatttgggtgggaacacagccaaaccatatcaaagatgtaagttctgtataaatttttcacctgtgtactatatacagcacaatttcattttttttccaatttttattatggtaaatacacataaaatgaactatcttaaccatttttacttttacaattcaatggtattaaatgcattcattttgttgtgcaatcatcaccatcatccatctccagagccgtttttatctagcaaaactgaaacgctatacccattgaacagtaattccccatttccctctcctcctagcccctggccagttaaccttaaataatgagttcagaaaatgtgattaaatatagagtttattccagctcaaagcctgaggatagccaccagggaaacaccaactccaagtgaatggggtcagctttccaaagtgggaaagttaaggtttcacttacataggcagaaatagagaaggttaacagggttgcaacatttgccatataaggccagcacagatgttacggtcatttgattggttacagtttgctatgttccaaggaagattgctttaacattccataaggaggggtaatggtctcgaggggtcttatttctggaaccatttggtcttttctaatcatttacaggacagaaatgaggaagagatttaatctataatcagagaagcagaagttgcagctgcacgtggcataactcaggccacataaccacatttctctcaaggctcaaaataatgtaaagttccaaccattttaagtttgaattatttgatttcacaccaccatcgttctattttctgtctctgtgattttgactgctctaagaacctcatgtgagtgaatcatatagtatttgtctttttgcagttggcatatttcacttagtataatgtccttaagttttgcctattttgtagcatgtatcaggattttccccctttttaagatggaataatattccattgtgtgggtagaatacattttgcttcttcattcatttgccaagggacacttttatttccacattttagtgactgtgaataacgctgctacgagcacggtggtacaatttctttttaacgtctacttttactcacctctgtagtgctcctgatttggtttctaaaaatctcttattttaattttatattaaaagtattcattatgacaaatacattcaaattattttctgaatgtgacctgatttcaaatcctagtcctattgcttgctagttcagtgaccttcagcaagttataaaagctgtcaatgactgtttccttaaccacagcatttaaatggcactcacagctacctcacatggtagaaagggagtttaaatgagaggatactcataagggagaaggcacatccatatttcactagtaaatgctcaagaaatattgattccaattacacccaagcacacacagataagggttagctcatgggttccccaggagcagcctcttcagtattcaaaaacaactcattgggcccctctgttctgacctccttgcctgcatgccttgctgccaccctgctgctgacactgccctcctgagatccttactctgccagctgcagctgtctcagcctgtgacagtcactgatgcccttatggagagatggagagggccccctactcaacctcagtgcagtggaaacgaagctatggctttcagcaagacttgacaaggattggagctaacagaaattttacactgagagaaacttgcaactgcttcctgaaatagccactcttcaaatccaggcaggagcccagcccctgagaccctgccaagctcccagcgaagcctcctatgggtctcaaccctgctttcattaatgaggctcctcaggcatttggatccaagccaaacctcctccaagccccagaggaagaagaagttcttcttcatcccaagccctacctcagttcctacaggaggaacatttgcttctcaggctgattgatagtgcaataattaaatcccttaaggaggaaattcccagcttaagccacaaaggtgtgcgtcaatcacctggcctgaacgggagcatcgctgtggtctgttctgggacctgggtttgttgagtgcatttctccaagctaagattccagtcttcagggacgcctcctgtaggacaacagtctaatgcaatgtgtgcagtgacaatatcagtcaagttttatttcatgatgtctcctcataaagagaagagaaggtaaagtcagcaagctcctccttctatgatttcatgggagaaaaagccaagacaaaaatgtaacacatgtccaaaggataaaaaggagcttccagggataagccagtttaaatccagatttattgggggaggaaggagcatctctcatactgctggcacaaggtcctgctaaatttacagtattcaacagaaaaatcacttcgcaaggaatattccattttaattcctgcccccaaattcaggagcaatatggaagtacttgccaggcatgtccacagatgaaaagccacaaaagtgatctctcaggaaatagagattttaccctcagtgacaacactggaaatcactttataaccactgcttccattccacctgctcccaccttagacaaacaaacacaaatggtttttacagcttcagatttttagggcccaacaacaggcagttcaatgaaggaaagataaagaaacatggacaatggatatttaaaaagaatttctgtttcataggttttaaaaaaggtttctaacatcagtctggaaaacagaaaccttaatacgagacagaaggtactgcacgatggcagctaggagcctggctatagagtcagaccatctacgtttatgttcctcctccaacactcagccagttagtaagacctgcctgtgcctcagttttctcttatctacagtggagatgaaaagagcgtgtctccagagatgatgtgagaatcaggggacccaagcaagctgagcatcattctttgtcctgtcagtggcaatgggactggaaacataacctttagtacaactgggtaggaatgtatgactgaggttacttttttgagggctatttgggaattgccatcaaaacttgaacactacattctttgactgaatccttcaccatatggcatgtaccatcttaaaaaaaatatatgttctaaggtggcatataccattttttgtagcagtcaaaaaaaaaaaataacctgtagacagcagaaatgtccatgaatagagtttcagaaaatgatgttataaggctggccaaggaatgaagtagatacataaacacttgcacagaaagatggccaagatgaaagtgaaaaaagcaagttgacaaatagcaggtataatacgagtctggtgtttcttttttaaaaaaaaaattatttaggctggtcgtggtggctcacgcctgtgatcccagcattttgggaggccaaggtgggcagatcacctgaggtcaggggtttgagactagcctggccaacatggtgaaaccctatgtctactaaaaatacaaaattagtcaggcatagtggcacatacctgtaatcccagccactcgggaggctgagacaggagaatcacttgaacccaggaggcagaggttgcagtgagccaagatcgcatcactgcattccagcttgggtgacaagagcgaaactccatctaaccaaaaaaaaaaaaaaagaaagaaaaaaaattatttttgagaagggtctcactgtgttgccccagctgaaatacagtgacatgatcttggctcactgcaacctcgacctccccaggctcaggtgatcctcccacttcagctgggactataggcacaaaccaccacatctagctaattttttgtattttttgtagagatgggggtcttgccattttgcccaggctggtctcgaattcctgggctcaagcaatctgcctgccttggcctcccaaaatactgggattacagttgtgagccactgtgcccagcctggcatttctctaatgtgtataatccataacctttatacatgcatacataatttctagaaaatctacaaaagaaacaattacaacgcaatagattaaggatgtaggactttatggaggacctggcttgtcccattgtacatcttataagctctttgaattttttgccatgaacacatttaacctgatcaatttaagtatttaaaaatagtttagaaattaaaataaaaaataagaatcctagccagcatcccagtacataataaaacaatactaaattcttattttaagaaaaatcagatcaaagactaattttcacatcatcaacaacaaaaccaaacaaagcatcttactggctctcctggccccaatattggaaggaatttctcagcaagctggaggattcctccgctcagcgggcgccgtgaaactgagaatattcataccattagccctgtaaccacatgcaaaacaaaatagttttttcattgatctgagttctgtggaactcatgtttgtgctcttaaatcttttggaatccttctggggaacaatcacttgacatcccaatactcagtggtcttattcgtgcatattataggaatatgatattatgaggagtactggtatcagttatgacaccagttgctaaactgaccagaaagattgttgatattcaaataaatgtgtgtgcatgtgcttgtctgtgtgtgtgtgtataaaataaaatgttaaaatggacagctatcaatatattttctttctagatacataaacggagatgccctcctgatctcatgaaggccattttcattaagttaagctttgttcattttcattcagttaagctttgtttaaaaaaaaaaaaaaaagatattgctttaccagtgatctgggtggcgggcgggggtgaagaagaagaaaaaaaaggaaactcttaattttagtcctatttagccccaaagcatgtgtttcagtattagagcatggccagagcagttttcaaaagggttacaccatcccgtgtacgttactccttatactgactccactgtggtttacttggcagatttgagctatgctgaagttgcctcttaacaggagattcctagagcgtctaacagctcaactcttttaggagcttaactactttttaatatgtgggtcagggttaagagcctcaggcaagggcttctgccctctttcgttaggaatttaccttggggatgaactaaaaaacttcaggaggctcatccaggcaggttccagatagctcaaattgcaaagctacctggaaagccactgtgtttctgcagccctgtgagtgaaacacctgttattggcaatggggaaggggaaatgtcctgtctctcccagttccccaaagaagcataaaaatgatgtattatatactgtctcagggacattttggtgccaacccacttggcacagcatagaatcctcctgtcacctcatggattgtatcatgacagaagggtaattgggcaccggagaagatgtcagcagagtgtcaatacggtttggccactgcccccaaataatattgatgacagcaaagagagcgattaatcaggtgtgatcctgtcaaatgttcagagtgtgctgtgggtactagaaatagatatagcctaccaacaaaatgttaaatggacttaaacaaaatagattatttagtcattttgagaaaagcagaactaagattcaaaagagctttttttctgaaaaaaaaaaaaaaaaatacagtgtatttcccattagtatttctctccacttgcttgaaaaagagggagagctgttatgttttctgaaaaaaaaaaaaatgcattctgcccaaaaaatcaatcatggaaaaaaaaagatcaaattaaaagagatgtcatgggatctaaagaaaagtgcagacgcagcaattgtaaaacacgttataattgtggacctatctgtttatttattctgtgtcccactgaaagttcaccctcacaccctccctaccaggccagccatctcctcccattaccccctcttgatattaatgatgctcgctcacttgtagtttcccacgtgtaaaaccccattgccttatgtattatcagttgttcaccattttccatacatggattctgtctcccctgggcctttcacagacacctgaccatctgtgaccatggcctttctcctagttctaaatctaagcaatggtattgcaacaatcttccaaaataacttccagccttaaaactctcttatcctacaactctgtctataactgtggccatcactggcttcacattagaatcacctggaaaacttaaactattacttatcattaggccctgcctcagactaattaaatcaaagtctctggagattatttttggccatctttgattttgcaatttcctgaggtttctaatgtgtagccaaggttaaaaaccattgatatagggctaggttaagctgcatataacagaaaaataactaaacaagagtgcttaaacaagatgaaagttagttcccatgcatgtaaaggaagtccaggctccttccagctctctgttctggtgttattcagatttgacatcctcctcaggatccaacatggcttctagagctccagccattatgcttccattccaggcagaaggtagaaaagagaggaaagagagcatgccttttccttccaagaatgactttacataccacttccatttacgtatcattggctggaactttagttaaccacgactagcagcaaagatggctgggttctgtagcctttaactgggcatgaatatgccttcctaaaaatgagcattctgttaccaaggaagaagaggaaaatgagcattaaggggcaactaagagcctctgtcggaagtgttaattcttcaaaggggccctgctagtctcctgttcacacctacagtaggtccctgtgatctccagaataaagtccagactcctgcagttctggagtccctcctcaccttgcattctctgctttacctcactcacactggggccattgtaaggatatttgtattttctcatcgctggtcctttacctacacctaaaataactcttcacatatctgcgttttcaacatcatctacttctgcagaaccagcgccagtgctgcttcccaaggaaacctccctgcctttgcccacacccctcatgtctagcaaaagtccatgcataaaaggcctgcttcctgagggtctcaaagcaaattacacttattttaaagttattttctctcttatctgcaattagatgcctgggtatctgagttctctctcaaattacaagcttcaggaggtcaagcaccatacctcatgtgtattataagtcattcatgcctgtcacttagcagctagtcaacatctatttgcaatgtaagccaaatgtgtagcactttagagaatccggttttttgtatgtatttataaactttctttttgcattgagtcataaacccacatagacatacactcatctctgctttaggctttgtagatggttttagttcacatagcaaaaattggaaagttactttatattcaatagtgaggtaaatcatccaagtcagtttttaaaaagataatgggtgtgtactaatatgtatgtccatactcacatagacactgacacgtgtatacaagtatattacatgcacatcctacattactaaatgtgatgtataatgactttattaatttttttggaagcatgctagttgtcttaggctaatttaatgcccggtattaaggtgaaatcaattactaccttttttcatcaggactagaggaggaaaaaaacaaacagaaaaactacccttatgcaggaggaataattctaaagacagaaatacaggatgtttggaaatgaccatctgtgacgatatttacctgcttgtccctgtcagccctgggaatggtgtgtctttaccttaggttactatattaggcagaataatggcccccaagatgttcacattctaattcccagaacctgtgaaggtcctacttcatgtggcagaagggactttgcagatgtagttcaaggtacagactttgagatggagagattatcctggactatcagtgggtgcccagtcaaagcacatgacttcttaaaagtgagaaaagaccctttcctggctgtgatcagaaagaaatgtgatgacagtagtaggctcagagagatgctatattgctggctttgaaggtggaggaagaaatccatgaactaagacataaaggcatcctatagaggctgaaagagacaaggaaattgactctcacagaggctccagaaaggaacacagccctgacacaccttgatcttaatacagccagacccatggtctgaattctaatctacagaaccataagataatatgtttgtcaggttttgtttttgttttgagacaggtctcactgtgtcacccaagctagagtgcagtggcgcgatcacaactcactgcagcctcaacctccctgggctcagatgatcctcccacgtcagcctcctgagttgccaggactatacgcatgtgccaccatgtctggctactttttctttctttttttttttttttttgagacagagtcttgctctgtctcccaggctggagtgcagtggcgcaatctctgctcactgcaagctccgtcccctgggttcatgccattctcttgcctcagcctcccaagtagctgggactacaggcagccgccaccacgcctggctaattttttgtatttttagtagagatggggtttcacagtgttcactaggatggtctcgatctcctgaactcgtgatccgcccgcctcggcctcccaaagtgctgggattacaggcgtgagccaccacgcccagcctacattttctattttttgtgtttttctccgcgttgctcaggccagtctggaactcctgggctcaagtgattcacccaccttagcctcctaaagtgctgggattataggcatgagccaccgtgcccggccacatttctgttgttttaagctacttcattggtgttaatttgctaggcagcaataaaaaattaagtttccttcctacggtggtgatgtcatcaaaaagaccccgtaaagctttattttttcctctcacattggtatagagtgaaagttcactggtaaaatagctttgcagaaaccttaaaaagtatgccttggccgggcgcggtggctcatgcctgtaatcccagcactttgggaggccgaggcgggcagatcaccaggtcaggggttagagaccagcctgaacaacatggtaaaacccgtctctactaaaaatacaaaaattagctgggcgtggtggcacatgcctgtaatcccagccactcaggagactgaggcaggagaatcacttgaacctgggaagtggaggttgcagtgagccgagatggcaccactgtactccaacctgggtgacagagggagactccgtctcaaaaaaaaaaaaaaaaaaaaagcatgtctctgaaagtgattttgtggctaacaccctgtttccctgcctgtccatcacttgctgatgctgagagcttccagcctacgaagaggatgtgcagggccttcgttcactgataaccagctctaccagtgaaggactggttgtctgtgcctacctgtgatcaggtctccttcaagtagatgattatatagcagttggcaggaattttttaaaactcagaaacattcatttatacatccaatcattcagctcatgtctgagtccctgctatatatcaggcacagtcagactatctggcagtccttggaaacacagggtgggtgggtagttttaagtcatatgcctcctgctgaaagacagatttaagaatgtgtcttcacaatccctacaccactgcaatttcacgtatgtgcttctgctcctgtcttttttttttttttttttttttgagatggagtctcactctgtcacctaggctggagtgcggtggcgtgatctcagctcactgcaagctctgcctcccgggttcaagcaattctcctgcctcagcctcccaagtagctgggactacaggcacccgccaccacgcccagctaattttttgtatttttagtagagatggggtttcaccatgttagccaggatggtctccatctcctgaccttgtgatctgcccacctcggcctcccaaagtgctgagattacaggtgtgagccaccacgccctgcctccttttttttttttgtttaacaggcagagaaatgattagataatgaagacgttatttattttttattttcataataatgaattaaagaggatcttatggacattctgagctttcccattgtaacagcctcatttatggcagacgccatttgcctgctgtccacaccgtacttaatttggcctcaatctgtatctttggtgtattaatctcctcatgatccagataacctcttctccattaacaatggggttttatagctaggacagtgcctggaaagttataagcattattattttctattattattatttaggagatgttttgggcagcttactacattgcacagaagctatctcatttcctagggactttgatgcaatagtcaattgtaaaatagacttttccaaagtcattcatttcatccattcctttaaacacctaatttttgagttcctgttatgcacaaggtagtctgctaagactaatgacaatgataggtgaatgccacccctgctattatcatctttagggctttgagaagttacttgacttttctcacttcagtttcttcatctttaaaatgagaatagtaatattactgaccttgtgaagatccccatgtttatgcaatatgggtattgttttatcaggcctttgtatttcagaagtttataagcctcatgaacaggagcaggggaccaactagacaaggaaagaggcagatctattcaacaaacatgtgttgagtacttactatgcacaaaggcaggatatcaatatggggggtaggaattcaatggtgagtaacgctgagacatgtggtgggattttagagcacacattttgcaaatcaaagagaacttgtgaatccctgtaacagccctagtgaaaattgttaagaatgattctggcaagtcccatattagccatatacaaattatccccattatagacttcccatagtgtatatctctagtataaaaagcattacaataatcacatttaatccttgttacattttaaatacgcatgtcgatgcaaattacaaatatcgaaaggaaaatgaagacagaaggaaaataaatcaagaaattcatttagagaaagaaaaatcacaatataaaacagccaatctttcttgttaagagcagccctcacatttctaaatgtatgaattggttttgtgttgactgtgccccaaccctgcttatagtatgtcaatattgggagaaatccatcactgacactaacatggcagccctctgaggagtcaagccaggggcatctagaggggcaatgcccaggcttcactccccctccttttgaaaggctcaggttgccttatagtcttccataaaaatactgagggcttttccaggactgctcactgtgtgataggaacttacatctatagggcatgtggtaacatgcaactgaaagcttagatttttttctagtgatgggtcacattctacactaggtccatcttgccattggtgccctgaagtgctttgtctaggccaactgatgcagtccacagagtctaaagaccactcaaactactcataacgtttcttgtggctgcccatccattccagttctaggagtagtttagaccatgttcatctctattaattatctcaagtctttatgcagaaacagcaacaaaaataggctatagaggtatgagaagtggttttgaattgttagtaaagagaggatgcaaaaatcagtttgtttgttgtcatttatttcaagctcaatattagatgccaatgttagggactatcaacatacaaagaacattttttaaaaacactcttaatgacaccttagtcaagtgtccaggttataggagtttccagcaagcatcagctagaccacacctgaagaattataaatagtactaaaaaaccaaaacatggaaaatgaggtcaggaatttgataagtgtccaatataatgataatgagcaaaaaggaaggaaggaagggaggggagggaaggggaggggagatgagaccactgtccatgcaataatccctttcccagtgttaacagttgaattgtgtccccacaaaagatatattgtgaacgtgacatgtttttgacatagagtctttacagatgtactcaggttaagatgaagtcattattaggtgggccctaattcattattactgttatcctcatgagaagaggaaagacacagggacagacacacatggagaggagaatgccatgtgaagacccagactcaaggagaacaccacgttgggagggaggcagagatttaagtgatgtgtctaccttccaaagcatgcccagggttgcctgcaacaccagaagctaagagaaaggcctggagcagattttcccctaggcccttctctccgtttaaatttatttttaaaaattttttagaggtggcatctcggtctgtcacccaggctgaaatgcagtggtataatcacagctcactgcagcctcaattgccagggctccagcaatcttcttgcctcagcctccgaagtagctaggattataggcatgcaccaccatgcccagctaattaaaaaaaaaaaaaaaatttctagagattttcctttgtaggaattttctgtgttgcccaggctggtctcaaagtcctaggctcaagtgattcttctaccttggtctcccaaaatactgggattacaggtatgagccaccatgcgtagcctcctagagccttcagaaaaaaacgtagtctgcaaacaccttgatttcagacttctagcctccagaactgtgagaaaataaatctctgttgttggaagccacccagtttgtggcattttgtcatggcagtcataggaaatttaatgcattcagcaatgctgccagagatggccattcccctctgccagcacattcctaatgtggtgccagtctcctaagccagtctgatgatgttggacagctccaggcatttgctgagggcttcccaaatgctgggcaccactctaagcacttttttcttttcttttcttttctttttttttttttgagacagagtttcactcttgttgcccaggctggagtgcaatggcacgatcgcagctcacccaacctctgcctcctgggctcaagtgattctcttccctcagcctcccgagtagctgggattacaggcatgtaccacaatgcccggctaatttttgtatttttagtagagacagggtttctccatgttggtcaggctggtctcgaactcctgacctcaggtgattcgcctgccttggcttcccaaaatgctgggattgcaggtgtcagccaccatgcaagcccacactaagcactttatctgcatttccttatgtaatcttcacaaaaacctataaaataggtacaattacttttccaactctgtaaataaagaaaccgaggcttagagaggataattaacctgcacaagaccacaccattcataaggagtgaacgggaggcaatctgatgctgcagccatgatactccacctcctgtagagaaaaggggaatgagtgtgatggttaagagaactgaaagtaagccgggaagatggaacagagaaggaggcatggagaaaggtgaaagatgtaagcccagtcttagactgtccttgtgcagagtatgagagccaagctgtacatagagtagacagagggagagtcatccacacctctcaagtcagaaagaaagagaatgtggcaaggtgtggtggcgcacacctgtaatcccagcactttgggaggcctaggcgggcggatcatgaggtcaggagatcaagaccatcctggctaacacgatgaaatcccgtctctacaaaaaatacaaaaaaatttagccaggcttagaggcacgagcctgtagtcccagctactcaggaggctgaggcaggagaattgtttgaatctgggaggcagaggttgcagtgagccaagatcatgccacggcactgcagcctgggcgacagagcgagactccatcagaaagagagaaagagagaagagagagagagagagagagaaggaaggaaggaaggaaggaaggaaggaaggaaggaaggaaggaaggaaggaaagaaggagcagttttaggttcacagcaaagtaccccctaccccctacacatataatgcagacaaacacacacaagcgcgcgcgcacacacacacacacacacacacacacacacacacacacagctttcccccatgatcattcaacacagggtagtatatttgttatactcatgaacctacattgacacattatcatccaaagtccatcatttacattgggtttacacttgctgttgtacattctgtggattttttattttttaattttttttttgagacggagtctcgctctgtcgcccaggttgaagtgcagtggcgtgatcttggctcactgcaagctctgcctcccaggttcatgccattctcttgcctcagcctcccgagtagctgggactacaggcgcccgccactcggctaattttttgtatttttagtagagttggggtttcaccatgttagccaggatagtctcgatctcctgacctcgtgatccacccgcctcggcctcccaaagtgctgggattacaggcgtgagccaccacgcccggccattctgtggattttaacaaatgtataatgaaatgcagctatcattagagcatcacacaaaatagtttcactgctgaaaactattctctgtattccctccattcaatcctcccctcccctcaactcctggcaacaactgatcttcttactgttttcatagttttactttgtccagaatgtcctatagttgaaatcataaaggatatagccctttcaggttgagctaattttattttagtgataaaaaatgttaaatagtatgtagaagaatttagggatgctgacactgtgaaaacaaatatatttaattacgctctacttggagtttgtttaaatcagatgtaaatgatatttgagctgattataccttcttcaaatggagtcttatttgaaagtctagtatgaagagatattaaaatggagcatgtctgggcaaagggaaaaagagattaggagttccaacaactccacacctctccccacgcctcatcctccatgatggaccttggagacttacatgaagcctccagtgcttcatgaaacacagcattaaaaccagatttcagagattaggactttaaaaatttagtgaatttataatagaagtatgatgaaaatgtccttttcttccataataaaatgggaaggtacattctataaaactgtcaaagtttacctgatgtttgatttatgcttttaataccttcacatacactttcttgagtttgttcaatactaatagtcaaaattcaaagaaaattaaagtcaacatctttttacttgttgaacacattaagtcactgtgatctacatgtaattccatcctctccaaattaaaattaaaattaaagttggattgactggtatacagattacagttcatgaagtctcgttatataacctttgaaccaaagtttatcttataaacacgtaagataaatgtcaaacgggaaagtaaaaaagattttataaaggaaaatagaagaactgaaggcacaggataaatctacatgaaaaaaacaaagagcgtttttaaacacttcttcatgtgaattcaggtgataatacaatggagttattttactcttaagacagattgacatatttaaacatagttctgatgatgtggagatgtctacagaatatatttcctctctaatttaaattatttataattgcatagttagttacaaagaataaaatcaaattaattactaataaatgccagagaaacatgtttaaattgacattcacttccaaagtcagctcctgcataatcaccacaaatttttaatatttgctacaatatgacaataaaacaattgcgtatattacagagtagaagaaactccttcaaagataaatatgcatttattctatttagttgtagaatgataaagataatttttttagaatggtctaaggataactttttcaagaaaaaagatgaaaaatgttctgttcccccaaactatcataagcctgccagccacacctctgccttatcatattcaacctgagtagatgacagtcgccacttatgccatattgagaaaaactctgatggtctgattagattcattgaaatactttcagtattagtagctaaatagggttctttttaaagtttaatttaacctaagagttgtaaaaatgaaataaatattattttaaatattgtagaataagtcaaacacttttagtttcaaatggattgtcaagataactgatgtactccgtaaatatatacatctactatgtgttcacaaaaatttttttaaaaagaattggtaggcataggctagtaaattgaccaatatcttcatttgcttaaaataaatttctaaaaccaagttgttccttgagacatatgcaatatcttcagaatttcatgccataagattaactatacttgatcaataaactttgaaattttaaaataaatacagaaaagttctttctcaattcagaaataactactgatattccctgggtgacttttttctcagacaagttagaaaaccaccaatttgactagattgggaaattccttaaaaggaaattagtgcaatggccgagaccttgactctgggatctcctaagttagagtcccaggactacctaccgattatcaattaaatatgcagtcttggtgatatggtttggctgtgtccccactcaaatctcatcttgaattgtagcttccataattcccacatgtggtgggagggacctggtgggagatcattgaattatggggcagtttttcccatactgtcctcatggcagtgaataagtttcacaagatctgatggttttataagtggtttccccttttgcttggctctcattctatcttgcctgccaccatgtaagatgtgcctttcaccttccaccgtgattgtgaggcctccctagccatgtgaaactgtgaacccattaaacctctttttctttataaattacccagtctcgggtaattagcagcatgagaacagacactcctaatatacttgggaaaattatataacctctttaaacctcaatttctcaaagtgagggatggtgaacagcagggcgaggatgagaaagaagatgctagtgtaagtaatagtacctccttcacaaagctataatatagattatatgaaattatgtgtaaaatgcatgtaacataatcagaagtgttaggttttactgctactcatgagtagcttatttatttattttttctcattagaagaaaactttaaagcgatgaattgtcttggtgaaaagtattaggagactcttggctatgggtaaaaatgtcagaaaacaatctataggctagagtcagtgcaaaggaagttatgtttttggtagcctaatataaatgtaggtcgtgtttcctgatgtcagcaacattctaagaggcggtcagttactctcacacttggaactgctctacctgactatgtagtgggttttgggagagtcctaaaaaccacatcttataatgtgtcttctataaaatgttccacagagttttttataaaacctttaaatcggccgggtgcggtggctcacgcctgtaatcccaggactttgagaggctgaagggggcagatcacctgaggtcgagagtttgagatcagcctgaccaacatggagaaaccccgtctctactaaaaaaatacaaaattagctgggtgtggtggcacacacctgtaatcccagctactcaggaggctgaggcaggagaatcgcttgaacccaggaggcagaggttgcagtgagccgagactgcgccgttgcactccagccggggcaacaagaacgaaactccatcccaaaaaaaaaaaaaaaaaaaaaaaaaaacctttaaatctttatatgtgatctgtttatgtattgagttctgctcttattgatcatgtgtgtccatagaggcaagatagagcagtcaaattgtgatgaccagtatgagctgcatttgaagttcagctacacagaattttagaaagggatagaagagatattattcacataaatatttaaagactaattggacactatagggacagcatgtaacatggaggtgaggagaaggactcctcccaatgcttcaacaagaacacagctgtgtagataccatctaacgctgcctctttttcagaaaagaatatcctacaaactcaggttttactatcagtatcacaaaataataacattattatgaaataatgtgatttaaacaatatttaaagatatgaaaggtacagtttcaaaatacaaagtgttatacaggtccagccatttagagatagactaatccattatctactaacttctggtttttgcaaatagtatactagaattcatcctgtaagtattaaattttataaatatccaaaatgcctgtattttgccaaaaagtaaagccaccctatttcaaattttttaatctcagtacctacttttaggtaagcccattgtaaccacaaagaaaatacatacagagcagtgttccccagcctttttagcaccaagggacagttttatggaagacaatttttctatggaccagggttggtgggggatggtttggggacaaaactgttccacctcagatcatcaggcattagttagagtctcataaggagcacacaacctagatcccttgcacacgcagttcacaatggggctcaagcttccatgagaatctaatgccgtcactgatctgacaagaggcggagctcaggcgggaatgctcactcgcccgcctcacctcctgctgcatggcctggttcctaacaggccacagactggtaccggtccatagcctgggagttgggaacccctgtatagagcacatacaaaagaaaaacagaaagaaaaaaaaacaggaaaggagaaatgggacaaaataaatacaagacaaacaaacaaacaaaaaaggttaacaaaatggcaatagtaagtcaataattaccttaaatgaaaatagactagactccccaatcaaaagacagagtgactgaatggatttgaaaacaacaacgacaaaagatccaattaaatactgtctacaggagactcactttaagtttaaagacacacataggctgaatgtgataggatgaacaaatgataatctatgcaaatggcaaccaaaagagagcaggagtggctatacttagaatagattttaagtcaaaaactgtcataagagacaaaaaaggacactatataataataatatcagcagaaggaaggctaattcaccaagatgtaacaattttatatgcacccagcatcagtacctctaaatatatgaagcaaacactgatggaactgaagaaagaaatacaatattagaagacttgcatatcccactaaatagcagatagacattcagacagacaaatcaataagaaactatagaccaagtggacctaacggacatacacagaacatcccacccaacagtgacagaattcacatccttctcaaacacacacagaacattctccaggatagatctcatgttacgtcacaaaacaagtttcaataaacctaagattaaaatcataccaggtatcttttctgatcacaatggaatgaaatcaaaaataaataacagaaagaaaactgaaacatttacaaatgtatgaaaattaaatgaaatactcttgaacaatgaataggtcaaataaataaatcaaaagggaaattagaaaatgtctcacgacaaataaaaatgaaaacacaacataccaaaatgaatgcaatacagcaaaagcaattttgaaagagaaatgtatagtaataaacagctgcataagaaaagaagaacgcaaatcaacaacctaacatacctcaagaaactagaaaaaggaaaacaaacttagcccaaagttagcagaaggaagaaataatgtagattagagcagaaataaacagagtaaaaaaaaaatagaaaaacttgaagaaatattttctaaaaagataaacaaaattgacaaactaaaaaaaaaagagaaaaaaactcaaataaataaaataaaaaatggaaaaggagacattacaacctgatggcttcaatgctgaattccaccaaaaatttaaagaacttatgctaatccttgtcaagatcttccaaaaaattaaagaaaaggggatactttcaaactcattttataaggccagcatttccctgacaccaaagccagacaagaatattacaagaaaagaatactacaggccaatatccctgctgaacatagatgcaaaattccttaataaaatactagcaaaccaaattcaacagcatatcaaaaagatcatacaccacaaccaggtaggaagaaggatgtttcaacataaataaatcaattaatgtgctgcactacattgccagaatgcctaggaataaacttaagaaggtgaaagacttgtatgctgaaaactatgaaacattgatgaaaaaaattaaagatgaaaataagtggaaagacgtcccacgtttatgacaggaaaacttaatatcattaaaatgtccatactacccaaaggaatttagagtttcaatgcaatccctatcaaaattccaataacattcttttttctttattttattttatttatttatttatttattttgagacagggtctcattatatcacccaggctggagtgcagtggtgcgatctcagctcactgcaacctccgcctcccgtgctcaggcgatcctcctgcctcagcctcacaagtaactggaactacaggtgcatgctaccaggcccagctaatttttttattgtttgtagagatgaggtctcactatattgcccaggctgatctcaaactcctgggctcaagtgatccacccaccttggccttccaaactgcgaaacttacaggcatgagccactgtgcccgccccagcattttttacagaaatagaaaaaacaattccaaaactcatatggaaacacaaaggatcccaaatagctaaaacaatcttgagaaaaagaacaaagctggaggcatcacacttcttgatttcaaaatatattctgaagcttcagtaattaaaacactaaggtactgtcataaagacagctttatagaccagtggaaagagggcccagaaataaacctgtgcatatatgaccaactgatcttcaatagagatgccaagaacagacaatggggagaggatgatttcttcaataaatagtgttggggcattgtatatccacatacaaaaagaacaaaattaaacccttactgtacaccatacataaaaatcaactcaaaattaattaaagacttaaacgtaagacctgaaactgtaaatccttagaagaaaacgtaggggaaaatcttcatgacattggtctttgcaatgatttcttggatatgacaccaaaagcacaaacaacaaaagcaaaaacagagcaagaggtatactatgtcaaactaaaaaacttctgtacagcaaaggaacaatcaatacagtgaaaaggcaacctgtagaatgagacaaaatatttgcaaaccacatatctgataaggcattaatttccaaaatatataaggaactcctccaacttaagagtaaaaaagcaaacaaactgatttttaaatgagtaaaaaatttgaatagacatttatccaaagaagatatacaactgggcaatagatacataaaaagattgttcaacatcactaatcatagggaaatgagaatgaaaaccataatgagatatctcacacctcttagggtggctattggtttttatttgagggggtttgtttgtttgtttgtttgtttgtttgtttgtttgttttgagacagaatcttgctctgtctcccaggctggatggctattgttttaaaaaaaaaagttacttggtgttattaaggctgtggagaaattggaacccttgtacattgttggtgaaaataaaaaatggtgcagctgtgtatatatatgtatggaaaactgtatagaatgttctcaaaaaaattaaaagtagagttgccatatgatttaataagtccacttctggccatttactcccccaaaattaaaattagaatcttaaagagatatatggaccccatgttcactgcagcaatattcacagtagccaagatgtggaaataacctaaatgtctatcaaaagatgaatggatacagaaaatatggtatatatgtatatatgaatggatacagaaaatgtgagatagatagatagatagatagatagatagatagatagatagatagatataacagaatatcattcagccttaagaaaaaggaagtcctggctgggcgtggtggctcacacctgtaatcccagcactttgggaggccaaggcaggcagatcacttgaggtcaggtgttcgggaccagcctgaccaacatggtaaaaccctgtctctactaaaatacaaaattaaccaggcatggtggtgggtgcctgtaatcccagctactggagaggctgaggtgggagaatcgattgaatccaggaggcagaggttgcagtgagccaagatcgcaccattgcactccagcctgggcaacagagtgagactctatctcaaaaaacaaaaagaaagaaaaagaaaaaggagtcctgccataagtgacaatatagatgaatcttgagaacattatgctaagtgaaataagtcaaccacagaaggcaaatactgcatgattccatttatgtgaggtatcaacaataatcaaactcatagaagcaaagagtagaatgctggttgccaggggctggcaagaggggaatacggggacttgctattcaatgggtataaagttttagtcatgcaagatgggtatacaacgtagtgcttacggttaacaatactgtacacttaaaaatttgagagagtagatctcatgttacctgttcatactacagttagagtattagtcctttttcacactgctgataaagatatacccaagactgggtaatttaaaaaagaaagaggtttaattgggcttacagttccaagtggcttgggaagcctcacagtcatggcagaaggcaaggaagagcaagtcaagtcttacttggatggcagcaggcaaagagagagaacttgtgcaggggaactcctccttttaataccatcaaatctcattagacttattcactatcatgagaacagcatgggaaagacctgcccccatgattgaattactgcccaccaagtccctcccacaacatatgggaattcaagatgagatgtgggtggggacacagcaaaaccagatcaaatagaaatagaaatcaaaatagacaaacaaaaaactagaaagaatctgagagcctatacttcaaggtgttttacctaagagatctgaggaaattacaaacatgatcaccagcactgaaatcttgaacttggatcaaagtaaccctacataaccacaaaatgacagggatataagtctcagagactttaaatgaatataacaggttcttgtagataactcatatacagagatccaaaaatgaaaaacttgttttacatcctattcacaatatgtgtagtacccttttcccaaatacttgactgataaaaatacatacagatttttaacttatccagtctattacagtttatttgccaactcttagttccctcttgtgctacgtttaaatttataagatgagtacagagactttttgaataactaatttaattaatgaattttaaagttaacttttgtagagttttagatacgtcctttggtcatacagtttagaaattacattgaaaagtaatctaatgcaaagttttttgtttttttttttaatttaaaaggtttgagtaaatctttctttctttttttttgaggtggagtctcattctgtcgccaggctgcagtgcagtggtgcgatctcggctcactgcaatctgtgcctcccggggtcaagcgactctcctgcctcagcctccagagtagctgggattacaggcacacgtcaccacacctggctaatttttgcatttttagtagagacggggtttcaccatgttggccagaatggtcttgatctcttgacctcatgatctgcccgcctcagcctcccgaagtgctgggattacaggcgtgagccactgcgcccagccgagtaaatctttctttaaaaattactgaagctgagtttaatatactgtatttatttgcatcaactcaaaattgaattttatgccacctttttggtcagttgtgaattgaaattttataactgaaattgtttacaagattatgttaaagtagggctgagagaatgaattttaaagtatgattcaaggttatagattaaattatgttcttatatattttagtcactttttgaactattacaaatatctagtaaattttttaatgctctgcccctttaattctggtcatgtaatttaggactgaaaggtgagctttatcttggaacaatattatctttcatttatatgatagcaaaaaaattaactatactgcctttattcaaaagtgcttaaaaacaactatatgtttactctctccacttcattattttcttcctcagtgcaaatatgtttatctggaaataatgtatgcattgtagcatgcagaatgtcaagctattttaagagatgcaacataatgcttgctataaactcttatattcagtcctcatttcataaaactctcatgtttaacttgaacatgctttcatgtaaaagctcaacttaaaagtgtgcctgtttggatgataagaaaaaaaagcaaacaaataaaataactacacctatcttgtactctttaaaatatatatgttggtttttaaaaataattgcactaagctaaacatgagaacctctatattagcaacttacattaaaagcaagtcttttttgggaaagcaaaataaaattaaaagacacatgattttagatcactgatctgagtacacagatctaatctctttgccagggttgtgtatactgtacacgacatttattttatttttttttttttgcactcacttattttgatccagtggatcttgacctattatcaagagtgagtgaatattgctagaagtggtcacttcagtatgacttaatctgaagacagagaaaaactggttataaaagaggaaatatattagaaaggagagtatttttgtatctagcaacctggaatatgaatgtaaaagagaataaacagttcaacacagaatgataaagggtgccattgagagggtcttctggagttggttttgcttcattcaactatgaaatgactacatgtattcatttatccctcccctccctcattttgagggtataataaatgtgtttctcctttttctcctctttcttcaactctatctccttgaaagagaataaacaactaaaaacaatgctgcacccccactcaccttgataagcagcatgagtctattaaattaagcatgcttgacactcaaacaccaattttagggacagagtgctcaaaatagaaagcacaatggtgacatcctgttaccgtctctttgtgcccttggactcataaataaagttctgcaggtttctgtgctcccttgatacaaaataaagaaaagtgaatgagttagaacaagctctggcagccatcagtaatgttgcaccccattgctgcaggacaggagacatccaattatggagcaaggtcagcctcagtctctaccagtattttctctggtggtcaagagaccctcaccccctcaccaccaccaccaccaccaccacgattcccttctacctgatggtgctccgggactttatttttggatccttcactgcttgacttaagaggaggaagacatgataggccagtcagtcttggctgggttgtgggaaaagtgagaggacagaaccagattggtcagtttgtgaatcttgtgatcagctacttttagaatttatttgttgttaagtttgaccaacaaatttccatatccttcatgttttctcacaaagatctttaaattgcctttcccagcttcccacctaaatacattcaaccatcataacacattccaaaatacagtggttgcccatggtttgcccaatactgggcaataggcactcagatcccagttagtgaccaatatacctatgggacacaaatcatatcaatgaggcacagctgcagggtgcatgtctactaaggatactgctcatctgaaccctcagactatacattctggtaccttagttctgtctcttggtgccctttcctgcgggtaacccacattcttattctctctccatgcggcatgggcactctctctcctgcctgagtcatagttcctggagcagactccacccccatgtttcagatcctgcctgagtccactgaatgaaagcaacaactcctgcgtgtcactcacaattccctggatgatactaaaaagcaatctttctctcattttcgaaacccctttgagatattaatgacttcctagatttttttcaggacttagagattatttcagaaataatcatataataagaagcattttgaattggagactcaaattgctctttagatcatactatataatcttaatgatgatgacgatgataatagtagctaccattgaacaaatgcctactatgctaggtgccttctatcttaaccatggttaattctcaggggcagtcctcaaaagttaggatattgttcctatttctcaggtgggggaaatgactttcagcaggagtaactatttttattcatcttatagctttaaattggcagctagattttgaccccatgtctgactcgaatttcattttatttccacaacaccattcactgcgtagagataagaactgtgagctggtctaataattttttcttcctgcaatagaagtccttttctaaaatttgggtcaactctcagcactcgtaaaaatatgcatataaaaagggaaagaaatggaggaaaatattttcccattaaatactaagacctactatacactaagctacagtatttaaagcacacaatactaggaccaattggatggattatgataaagagactagacactgacccatacataaaagaacttggaatattatagaggaaacacgaagaattaatgaaaaaaggaaaataaatgatgttgcattaattgaatttcaatatttgaaaaagtaaaatagctttccctcctgaaacaaacaaaaaattcagggagatattggatctcaatgaaaagaacatttaaatatattaaaaaacaaaactttaaatatattacaggaatatgaagataatacctttatgatatctgggtaacaaaaggcaaaccacgtaaattaagtaaagcaggattttttttaagtaactaaactggtacaatttataaagtacacatactcctttgaaaaagtaggtctcatgtgaatctgctcaaattccagggctgtattcactttcaccaaacactaatgacctgaggctattgtatttttctagttttcctgttaaaaagagacatgagagtgttgactctcaggtgtgagatcttgactgatcccacacctagcccaactggaggcttaaggctactcatcacagagtccttctggagccaagataaatgcctatgaatctcaacttttattcacagctttcaatattagattttttaatattagattttaatatttttcaatattagatttcatcatttcctgtgcccatttccctagctcaagggttcacttatctttgataagtttattggctagatgtatgtacgatgactcactctccatcacataaaacatacaattttgacagttgataaaaagatgttcgcataaactataatcatataattaaatatgtaccagaaacctaaaaaatagggaagagggaagctgatagtattttactcacatttaactaaaaagccatacattttaaatctatgaggtaagaagaaaaatcaggaaatctgcctgaacccattagtgactattcatgtaggatttttttttttaattttattttttttgagacaggctgtggcccaggctggagtgcagtggcacgatctcagctcactgcaacctctgcctcccgggttcaagcgattcttctgcctcagcctcctgagtagctgggattagaggcacctgccaccacacctggctaatttttgtatttttagtagagatggggtttcaccatgttggccaagctggtctcgaattcctgaccttgtgacccacccatctctgcctcccaaagtgctgggattacaggcgtgagccaccacgcctggcctcatgtagaattttatggtcacaagcctgtagttctagcagggaaactcaacacataaaaaggaggcctttaaatgcattgtcaagaatgacgaaaggagctaagtatcattatattctgatcaaaagaaaaggcaagtgtccatttccaatctctctttctctctctctctctctcacacacacaccccccagcagatttgtaaagaaaggtaaataaatcccccatacaaaaagtttccttttttccccacttgggtctgagagttgttcagtttaacctgagttgccattagtgtccttcgaagctataaattttgcttttccatgcaattgtttcaaaacaaagaaaatctgtgactttaaaattactttagagccaagcatggtggcgggtgcctggggtcacagctactttggacactgaggcaggagcattgttttgagcccaggagttctgcgtggtagtgcactgtgctgatagggtagtcgcactaagtttggcgtcaatatggttaattcctgggagcgggaatcatcagtttgcctaaggaggggtgaaccaagccaagtgagaaacggagcaggtcaaaatttccattctgatcggcagtgggttccacctgtgaatagccactgcactccagtctggataccatagcaagaccctgtctctttaaaaaaaaaaaaaaaaaaaaatggctttagaagcaattttacaccctaacttaccaatataggtagcggtccgactttatcgccacaggaggaaaaaataaaaagcagagtaaaacttacagagcaatggtagatacaatacgatcaatacaatcttcaaacccaacttcactgagcatgagtttctacacataaaagagattctttcattatttcttttttaattatttatttatttatttatttttgagacacagtctaactctgatgccctggctttgagtgcagtggcgtgaacacaactctctgcagccttaaccttctgggctcaagggattctcccacctcagcctcctgagtagctgggaccacagacaagcgccatcacacctggctaattttttaaattttatgtagagacaagatctccctgttgcccaggatggttggtctagaattcctgggctcaagcgatcctcccacctcgggcaccaaaagtgctggaattacaaggcataagccatcataaccggtccaagaaaatcttttagaaaaccccatcaaacaaatcaccatactatttaactgtaagtccaaacaatagtttcaatcgtaatatttgaagcaactagtataaaaagagaaactcataagctagcttacatttctgttgtcaaagagtaatttatccttgctggagttggtttggaggtattaatagccggaattatcccaacaatattctggcaagaaactatacacgtactttctgatgtgctctgatgtggccacagtctggcgctgagagtagctccaacatgagggactgaagcaaaagggtttcccaaagaagcactgtgccccggagactggaaggagaatttgaggaagacattaggatgaggcatctcaggggtgtaagagagagaccctggaaggcatttggggccatgacttaattataagctaggaattgcgtgtgtagaatttacaaagtaaacaaaatggcagccgagggtggggatagttcacacccttagtaaaggctcgacattatagaatctgcctcatactaggattcccagtagcttttctggaaataggtctccttcctctcctgccagccctaaaataatattggtaacacacacaccaacttctagagagcactcacaaaaaaagttgtcaccgccaagtgacctcactgcttctccctggagagctttgcagacagaaaatagctctgtgtctttataaacaaatcactctgtgaatggcagtgggtacacaaacatgtcgattctcttccagagttcttactcgctcaattgccaggtttgcttctattttggttacagaattaaaatgtaattagttgtgtttttaatgagtccaaatgtgacacattaagattcagtaattactctaaaatgataagctgtgattgaatgtccccataaacaagggacatttaaaggcagtaccatttcttgctcagttgttactgcttttaaaaccgtcactctttcctgggtgaatacagttttaggatttaaatgattacgctggattattgcacatatttacagtcagagccagctataccgacatatttaaagtgtgtacgttctttgatcatgtggccatgtctacctaagaacctaataactgactttactgaatgttggctgtccaggttagtacctcattatgacttactggcttttaagacacgtttattttatgtggcatcagtttttctcttcaacctgatgcaagacctcactgctatttctgaggttctttatgtccttagtgtttggcagggctcacatcaggtctagaaaagtggtgctagaggttcaagatccaatacaacaatggcagcagtaattgatgcacttgccccatacggaaatctgatctcttaacccacctgtttcctaggctaactgaatcagcagcatgtcagtagctgccaatgctgatcaatttcctagtgacattggtaacttaaaaaacattgaaatagttaagttcgttgtagaagtaagcctttcatcctacagcaaatcaaaaacaaacaaaatggataaatgttttctgataacttttaaaacagtttacctaagaggaggaattgtaaaaacttaaacataaattgagatcatcccacctgattttttaatattcgtaggaagcctgttcatgatattccagtcaactactctagaatcctattttggtatctcagtatctcgtgcagcagtgaatagcactgctcaatattttagaggcttcatatttccttagagtcacaattgtcaccctaaaatttagatctaataatcctactactgtcctgtgtaggaaaaaatacagaaagcatatacttcttatttcccagccttcaagtatgtgaagactgctatcaagaccactgtgtcttactggccaggcgcagtggctcacgcccgtaatcccagcactttgggaggccgaggtgggcggatcacgaggtcaggagatcgagaccatcctggctaacacggtgaaaccccatttctactaaaaataaaaaaacttatctgggtgtggtggcgggtgcctgtagtcccagctactcgggaggctgaggcaggagaatggcatgaacccgggaggcggagcttgcagtgagctgagatcaggccactgcacaccagcctgggcgacaaagcgagactccatctcaaaaaaaaaaaaatccccgcttccaacagcagttctcctggaaccctaccttcccctgaattttgtcatatttatcaatgcctttcttatggcaaccagaagtatatagagcagttcagttcacaaagggctgtaaatacagtaggacaatacctatctcactttactttggacaaccagatgcttcaaaacttgctgatggtagattaacttttcatgtaactttatttattttactgttggcacacacggcatttttgtgtaaagttttctaatgatttttacatgaaatgatgtccagttataaatctctattctataccttgaatttaaaccaacaatttttttcacttaatcctattgtattatgtggtgttgtttttattattctaatctatttaaagcatattaatctcactctgaaagctgtataaaaacctctaaatctgggccgggcgaagtcgctcacgcttgtaaatcccagtactttgggaagctgaggtgggcagatcactagaggccaggagttcaagaccagcctggccaacatggtgaagccccgtctctactaaaaatagaaacattatctgggcgtggtggcacaggcttgtaatcccaactacttgggaggctgagccaggagaatcgcccaggagacagaggttgcagtgagctgagataatgtcactcactgcactccagcctgagcaacaaagtgagaccccgtctcaaaaaaaaaaaaaaaaaaaaaaaaaaaaaaaagcctctaagtttggttcatctgaaaatttcatgagtctgcttactcttacaagtccttgctcataatattgaacaaaaatcaccaagaatagacatgtgacacatacaccaacagaagtctctccccagcagttcaataagtggaaggtactctagctagcatctccatcgttcaactgtaccccagtatatcaacaaacacattatgagtggttcaaatgaatgcttttctgaaatgatgccatcctcaatggggaagtttcccagtctatcaatctccatgcagcataatttgtagaagtcctacctttcatttctagatgctaatcgatcttctattcaatggaagatctagcctactggtgtctcattttttattcttcctacaatttagaaaatcagatcagcataagaactttatttttaacaaatattaatataaaagtattacgtgtttttctactgcccatatctgttctgtccaagccatgtacattcatgttaaataaataccgtcttttaaaacataaatagcatggttactccacattgactcctgatgtcccaagatgttcaagatgcagtaaggagaaatattattttaaaacaattcaaagggagtgaaaatggtagcacacaaaggaggcagcatttcctgcttctcacaagaccatctgcctgtattgtgggcaagattttttaaaaatcctaactgaaaagaaaataatgttaagagacatatgcccatgtttacaagctgagggaaattgacaagtgtgtctgtttcgccagtatttttacagtcaactgttatacataatggggaaaattaaaatcggtaattacttttctagtctgccattgttttaaatgtgcttggaattttccttaagcatccattccaagtaattatttgtaataggccagaacacttaaagggttgtagggatggatacacagctattttacaaagtgaaatactttgacaataacaaattatttttcctcctttctctccccaatgttggctgagttatgtttatacctcactttgtagataatccttctagctacactttttttaggcacagccattataaaaatcttctgtttgggcttggcactgcttagaactagaaattgctatttgctgcctgccaattacagaataatttaaggtttgatgctcccaggcacagtttcttgaaatacacagaaaaaaatatattaaggtggatgcataatattttttctgcattgcatagcttcaattgcctgtatagaattatatccaaattgctaaacaaatcaattggagaaaaattatgtcttctaggaaagtgttttgtaatggttttactactctttcttttgataagatcatagcaaatattttacaaaaattttatattatttgcaactgaatgatttcaatctatgaaatgtgatgggtataaatattgatataattttaacataaaatttaaacttctaggaaataatagaggaagatgtgatttttttaaaatcaatttggaataattaagaagaaaagaaaaaagagagttaattaagtttcccggatcttttcaagtctaaaatgcaataatttttcatctttgtatattcgtatctgaattatccatcatttgcagtacgaagcaggaaagcggtaaagcaaagtaaatttgtgatttaaaaggatcaagtatatggttgaagactcaaaaagctttttatttgggacagtagaaggaaatgtgctgattatcatgagaacaacaaaaaagagaaatgagttatttatgtaaccctgtcatcatgcctacaacacctcgaagggcagtcaggcatagtctgttatcaggaaaagcaagcaaacaaaagcctttatatatatatatatataactaatcacaaacatgctcagactccagaagatggtaaaataaaataaaataaaataattttattgacttctttcacctaggtgccttggttgcactccctggaaaccattcttcgcattccccacttacttctcttttcttttctttttttttctttttcttttttttttttttttgagacagagtcttactctgtcgccccaggctggagtgcggtggtgccatctcggctcatggcaacctccgcctcccaggttcaagctattctcctgcctcagcctcctaagtagctgggattacagatgcgcgccaccatgctcggctgatttttgtatttttagtagagatggggtttcaccatgttggtcaggctggtctccccacttttcttaattcacccctgaaatacactacccaaacacgtagcaactgaggtctggaaacttcattcttgacttcttctaaggaaggccactttcttcaaaatacagcaagacaaacacatctagctcctagcatgacttcagtgtgaaaaggctgggcttgggagagcagcaggtagacatgcctattaacattgtgctgccatgtttactttttttttgtttacttaaatcatggacagaaagccaagtgtataagtgaaaacccaagggacaatgacatggggtagactgcagaccaagaataagcaggaagttaaataccaagatattcccccaaaataaaccagatagcttggtttatatggaagaaaataaaccagagtaccactaacataagcatgacagaaggttttacacaaaactttagcagaagtgggtccaaatttcagctagtttcaggaatagttggtcgaggatggttctccaaagagggtggaattgtgctgttgatcagctgccctcacatgagcgatttgcattttcttggcgagaaatagtcgctgaagtcaagcagaagagtacgtgagaaggaatagctgtgagaccaggacaagccaaggccacagtgggatattctcagtccgtctgggtctctagatttacaaagaagcatgttgaatctgtagaggcaaatgggaagctcccccttcaccctctaaaggttagctgaaaatgagtaaatgacaagagggggattaataggaggaaaggacatagagaaggtaattaacatgcttagggacaggggaatcacaggaggagaatgacccaataatccagtgaggtcctgacacttatttgtatacccttcttcacagggacagggttgatgaggagtgtagggataaatgacttacaggggaaatgaataagcccaaagcacggtggtctgggacaaagttcctctgagctctaggacaggtggagggaaggtgagtggttgagcttcactgtaatcaaaggttatcttattatgcagataaagcctcccaggtaatctcttggagctgtcttgagaagaatagatgaaaagtctttctgggtgcagtggagactcccagtgtctcctcttctccagtggttaatctttcctggttgtttgatgagattcctagggaggaggtcttaagacaattgcatttccttttaaagggttttcctagtcagataaggaaattccggttctggtacagtggctcacacctgtaatcccagcactttgggaggctgaggcgggaggattgcttgagcccaggagttcaagaccaccctggccaacatagggagaccctgtctctacaaaaaaaaaaaaaaaaaaaaaaaattagttgggcattgtagtgcatgcctgtggtcccaggttctcaggaggctgaggtgggaagaattgcttaagccagggaggtagagaggctgcagtgagctatgatcgctcaactgcactccagcctgggtgacagagaaagaccctgtctctaaaaaaacaaaaaataaaattccagcaagagtagctcccaatgcttcaggaaagaaaagagatcagagtggggcttgggagggaacactggagagaccttggttctgaggcttatttctgatgcctttaatttcctttaattcaaagcatgccaaagagccatatttttggaggagtattttctgagccccaagaactcctcacaatgcaaaatggatgcctggctttcatttttttaaaatgatttatttaccttaaaaataaacttggattcatttgatcttcataatccctgtagataatttaggcttccaaaggaaacatggtctctattggcctaattaccaataaccaagttaaattccatttctgtacagaatttttttaaaatttacctcacaatctagaaagaggagaaaaaaataccttaaaaattaattattttcaaagccatgtatatgcagatttggtcatggcttattcagaacacattagaattattttaaattctaagtatcctcaatggtgaacttaaaatttcattctagggggaggggggcatggttaatgagtagaaaaaaatagaaagaatgaataagacctactatttgatagcacaacagagtgactatagtcaataatgactgaattgtacattttaagataactgaaagagtgtgattggattgtttgtaacacaaaggataaatacttgaggggatggattccccattctccatgatgtgcttatttcacattgcatgcctgcatcaaaacatctcatgtacccccataagtatatatacctattgtatacccagaaaattattttaataaaataaaaataaaataaatgaaataaaattttattctagccattccaggaaaaaaaaaaagccccattttgcaaagatgattataaccatatatatcatatgattatcaccttgttttcatacacacaagcatatatgtatgtatatatacatatatatttacacacacacacacatatacacacacacacatatatatatgtgtgtgtgtgtatatatatacagttgacccttggacaatgcaggggttagggctatgtcctgcacagtcaaaaatctgcatataacattggactccccaaaattttaaccactaatagcctaccgttgactggaaaccttacccataacataaacaatcgactaccacatattttgtatgttatgtatattatatattgtaatcttacagtaagctacacaaaagaaaatgttattaagaaaatcataatggccaagcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaagaggcggaggttgcagtgagccgagaagaaccattgcactccagcctgggcaataagagcgaaactccgtctaaaaaaaaagaaaagaaaaaagaaagaaaatcataatgaaaagaaaaatatatttactagtcattaagtagaaatggatcatcatgaaagtcttcatccttcctgtcttcacaatgagtaggctgaggaagaagagacgaggttggtcttgctgtcccaggggtgaaagaggcagaagaaaatccatgtataagtggactcacacagttcaaacctgtgttgttcaaggatcaactgtgtgtatatatatatatatatattttttttttttaggtttattgcaggaacaaaatcctctctccaaagctataatcctgactggctcaagatgtcttaagaaacttagaaacacagctaggaataaattacagcccaggctagttggttgttctcccggaatgagcgaattcaaaaggaacctggttatttagcaagaaatagactcagtgacctcagcagcattctaatgcatggaaaggtcagagaggtttcgtaccactctgctgggtcagatggaagccagagaagctgttggggtctccttgaaggttgaccctgggctgcaggtcaggaaacccaagtaggattccaggaatggattgctaagaagcttcgaggagaatggcttccacccatgactgagaattgaattgaggtccaggtagaatgggtagtacctggtcacagcccataagaaataagaagaggctatgatttgaattggtattaataacaaagaagaaaagcagcatttacttcgggcacaaggccagccagcctgctctcagaagctaaatgcaagtgacattttcttgtcaaatcccaacttttacccatcaaaggcttggggagaaagggaatccattgcaatgagttggttctgtagatagccctgcagaatcctggggggtgtttcacacgccagagaccaggatgggttgcggaaagcagttaactaccaagtatagtaagggaggcacagtaactcacctggaattgactttgcaagctgaagactgttttcaactgtgactgtgccattaggattaatgcaattcatacagttggctagcacatcagataaatatgatgaattgtccttatatccttagtccagtgagaactggcttttccatcacagcttaagctatacacatagagaggcaaaaaaaaaaaaaaaaaaaaaaaaaaaaagaccttacagttttgtttattgtgcttatcacaagtgctggaaactcacattttcattgctaatagccctctttgaaagtttgttgacatttcagctgatctttaatgtgctctactgttataatacccttgggcaaagtcagtttccaataggaaaatagacagcttctgggtacccctgtggaagctgcacaaacacaaacagactggcaccccagcctgcaatacctggtgagctctgctctgtccgaatcacagaagggtggcagaatatataacctcaaagcatgccactttggcataaggattatgttgaagtaaaggctcttgaaaaatagcagatacaagaagagcactttgaccttcctttttcttcctaaaagcaggagataaatctccaggggaaagttgttgtccctgtattgggaggaagaaacattcttatcaccagagatagggagtgaaggtcaagagaaatccgtaccaaaaaactttgttaaattaaccttatctgtctcttcacttttctacaattaactgctctggcccaagcctctttgtcttgccatgttttcacaaggtgctcctcttcatccaacttaggatataagcatctgactctaactgcttctttgggtcttcattttcctatgtgaattcccatgtccatttaaaatctgtatactcctatcttggtaattatctgatagcgatttaattctcaggcccagccgaggactctcagagggcagagagaaagttgtgccttccaggatcactgtatttgggagcctggaagacgaagaatggagcccagtaaatagagagggaaggaaagacatttaaacaggttcctaaagagaatgtgaggacacgtaagaacaacagtaagaaaaagtacagaaagaaaaatttacaatctattctacagagcaaattgaggtatttcttctgtaatagggaaagaggaaagagaagattcatgactgaccatcagtaggctttatagtggagagagaattgtccaaacctccgtataatcaagcacatatcctgattcttagaatatatgttccaaactaaattaagaaagggtgatgctggacagaagcagttattaattctggggtcaacaggataaaaatagtcagaaatgaacgttgtggtttgggaatataagcagctgaattcaaaataagaattctaatagaaagtgttaaatcaaagagcagttcataaagtcagagctagaccttgggtggggggaagagcaattcaaaaatttagagcagcatgtatcttaaaaataaattttattgaaaaatgagaacacatggacacagggaggggaacaacatacaaggggggcctgtccgggggtagagggcaaagagaggaagagcattaggacaaatacctaatgcatgcggggcttaaaacctagatgatgggttgataggtgcagcaaaccaccatggcacatgtatagctatataacaaacctgcacattctgcacatgtatcccggaacttaaagtaaaattaattaaataaaaaaaaatgaaaatgaaaataaatgttgttatgagaactcatagtggcatggccccaattttagaaactgagcttaatacagttaataggtaaatgttagatgaatacctcaaactgaatgttaatgccaaaattaagatcattctttggttcaaaatatagagcatgtttatatcttaattaaaagcagtcatacttaaatctctccttttcggccaggcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaggaggcagaggttgtagtgagccaaggccacgccattgcactccaggcagggcgagaagagtgaaactctgtctcaaataataataacaataataaaataaatctctccttttcattatttatagaaaatcatagtattttggcacattaaattgaacatatttctttaagtaattaaatgtacgcctatcataatgtattcctcctggtacttaactatcatagattattagcagtttagtgtttaaagggaactcaggactgagagttttaaaaacttagactcacagtaagaaagtcatctcatgttgatgaagtataaatatgcacatacacacacagacacgtcacatgcaggtacataactaaaatgaaagcttcctgaaataatacttatttacactttgtacagaatcgaatgcactttatttcctagtctttgcattttaaaaatatacttattttttttaatgctgctcctggttccccaaattgaaattactatctaccaatgtatctcaatttacagtttggaaaacactgccttagggaatagctagtctaattttgcacctgagaaacgtagagatttagggaatattcccaaggtcacgtagtatgtggcaaagcaagcctgtgctgtcttctaagttctggcgtaatgagttttccccaatcttacattgttacattgttttcaagatgaatggtcatgtatagtgtactctttgcctctcaaatttgatgaagtaagcattattccgttgctacgtgtcttgctcactttgcgttttcttagtttcataggaagcatcagttgtgctaagttttatttgtgtgttccattgtctcttccccctaaactgaaagcttcctgagaatagtgtgtattcttatcaatatcccctaaaccaagctgagtagtgtgaatgattgaatccttagaaagacaagctcatgtagtcaaatagtctaaattacatgagtgggacaaaaatatcagcatccaggtagccacagatgctcttctttccttctaagaaatacgattctcattccatacctagatgatgggttgataaggtgcagcagaccaccatggcacacgttcacctatgtcacaaacctgcatgtcctgcacatgtatcctgaaactttaaattttaaaaaaggaaatatcaattctattggttatgctgattagagtaataagtggagagggaattgagaagttctaagacaagctgtgttagtatcctagggctgcagcaacaaagtaccataaacagagtagcctaaagcaacaaaaatttactctctcaaggttctagaggccagaagcctgaaatcaaggtatcagcagggccatgatctctctcgtagcttctggtggttgccggaaacccttggtgttcttggcttgtagacacatcgctccaacctcagcctctcttgtcacgtggcattctctctgtgttttctgtgtccaaatttcccccttcctattaggacactagccattggattagggcccatcttaatcaagtatgacttgattacatctgcaaaggtcatatcgagaagtaccaggggttagaacttgaaaatatctttttggaagacacagttctacccaccacagaagctacaccaatttacatgaaaaagaacctaagtagatctagaagagttggagagagaaatgggatagaagggagatgagcaggaagacatgaaagcaaacaaatgagttatcttcaggggagaaaagtgcttgtccagtgtactatggagagacgcataaatgaagatgactttaatacattctgctttgcatcatgcaacataactttttttcttttggtgcctctcacagagacctctgtaaatcctaaattatcttttaagactttgttcaagtcagattttttagagttatttcagatgttatgttattgcaggaagcagctcacaagtgacctagcattaaagataataaaagctaatgtttttatgtgagtagaagatatagcattgcatttaaactatagtttcaccattatacagaaggaaaagaagacagcaagcagaagagacaataatgatatattgaccttactgaaagatgatgacataaagcagtaggatttatcattttttgtaagttactgaacattgattcagtgttatgcatcttgttcttctatatattaagcaattatgtttatttctagcactgaaaagcatagttattttcagccaataattgctatttgaatgctatagttaatgtttttataatttttagatgacaattttattttaattaactctcttagaaacaatcatttatttatttgctcagcaatatgtgttcagtatccaaagtgtgttagacacaattcagtatatccgtcccctatatcgagagtctagttagagtgagttaacaaaagcttttattcatgggaatttatagtataaaagtgtacaatagtataaaaaggctgaaagatttctatagtgatttcactatgaagagatctctctgatatttttcttccctttcaccttatccagtctccaacgtttctgtaaaaaacagctacacccacttttttcttcctgtcaggtgaatccagatagtgcagcaaagttgagccaccgacactgaatttcccaccacaagtgaaacagcagaaaaggctttccaagttcactgtagggaaaataaaagccatgtgatatttattgcacatccaagtatatggattaagattaattcctctggagcaataatgatcacactttttaaatcttacaactcgttgatagtcatcaaaattgaagatccaaaaagcttttatttttatgagttttacatatcagaatttcatgtattagaaattaaaactgacaaactttaaatatttattttaagacaaatgatatactttaaatattaatttaagacaacattaaaaaccctctacttattagcataacatgcttttattttttaaaaaaactacattattccaaaacaaaaaaagattaatgagaagagtagtgttgttccattacacacccatgagtgaatgagagtgaaaaaggaaattgatgtcttaatattattatgaaaattatttggtccaatagttaatggatcccctgaaaggtattcagaacccccagttgtctcctggccacatttagagaatttcagccctagaatgttctgatatgtagtggaggaaattgattctatagtacagaatcagagggcaactcactggcctgctccccacctcagctatcatatgatgcacagtccctgaccaagtggatcggaaatgtctcctgttgtaggtcaaggtatccctgagaaccacaaactgagatatggacaaaagagcaaaagcgccgtgcacatatcttgagatgcaggttaaagaacaaaacaagaatgcatgtattttatctcaggacactaagtctccaaagaatggcttgtgatgggggtacagacttgacccaagaattactgactataatcaaaccacagtttaacagaggtgctatttatagtgaaaaattttcccccaagcaagaattccatagtaaagtaagatcacagttgcacactgcaaatctttaaaagaaaattccagaatttatagcttacttagcctacttagctacttgctttgctcatatataccagttctttcaactaccacaaaaataataactatttgaatatactcaataaacaggcattgtgaaatttgaattttacaacatagaatttggttactgttcctgttaaaacacaaaatacatgagtgaatatttatgtgtatatttttcaataatgttttccaaatgacctttggagaatatctcaagatgattatttctttggcagggggcaaaaaaaaaaaaaagctatcagtgagataagcacatcaatcgaactgttttcatttgagccatgtttaaatgagctaggatgcaaaatagaaattctggaaatatccaaaagaaagatgtacatgtcctctgatttctcctaagtctggacagaattggcagcagaggctctaatgaaatcttgcaattagtctgagaagcccattcagagagcttcactgtgttcagccttctgccgctgacacccttgcctgaagacacatgcccatatcgaagcacatgcagatgcctttcctcatacctagaccctgaaatgaccatggaccgcaggattctcatgtgagatttcagtttactgcttaatttttcatcttgattggacttttcatccatcatatcaggaaaagctgaatatacagacccagacatagataggtttggggacaggaagaagatttaattctacttagattgatcccattttttcttttcttttctagaaatgagtgagatcatttgctgatcctgaggtgtggagggaaaaagtcttggctagaggtgtaagagaatgtgtggaagatggaattgactaaagaaagtgatagggttgtcctgcaggtctgaggacccaggtgatattcatggtctccatgtaacgcataactggtcagcaccttttgtttgcttgtttttctccaagttttactgcttagatgcggtaaaataacatctggcattcccagagttggttttccaagtaatgtcacttactgaggcaggaaggagaaaaggtgtttgaggtttgaagagacaggggaaaaagtctgttaagagaaaaggagtgaaagtgaccagaaataagttagtaggattgacaggaactaaatgggttagcatgggttagcagagaatgagatgtaaactctgttggggttttgctgacaaatacgatggagagagctgaagttgtttgtttgtttgtttgtttctcaaagatgtgataattacagtgaaccttggaatctaaactaatgaagaaaaggagtgaggacaagagagtgaaaaagtgatagtcaatgaattgaaggtcccaggagaagaaatactgtatttgagaaccagagtaaatgaaatggaaaattaaaggcagtggtcagaagtcagcataactagaataaaagtttgaaaagataatgactaagtcaagggtatcaccaggggagtaggtggctgaagtgcaatcggatgaaaaaacagtgggaaacgagatgctcaaagaaatgggaggttcgtaggtcactgtggtccagaattgcaatgattatgtattcagttccggttaaccaagaaattaagcattttgcaattctaaaatcatcagttgatatactaaaattaaagtctaaaatgccatgaacattatgttagatacatatatattaaatggaaatcaaattgtatacgtaaaaaaagatataaagaagaaatatagggctagacatagtgtcttatgcctataatctcagcactttgggaagccgaggtgggaggattgcttgaactcaggagttggagaccagtctggacaacatgaggagactctgtctctaaaagaaaattaaaaattagccaggtgtggtgtcatgcacctgtggtcccagctgcttggaaggctgagatggaaggattgcttgagccttggaggttgaggctgcagtgacagatgtttgcaccactgtactttagcctaagtgatagagtgagactgtctcaaataaataaaccaataggacatattaataaatactgtgatcttaagcaaagacgctttaactttctagagcttagttttctcatctgtatcacgagtaatttgaattaaattatctagaagttaattctttgcctgaaatggtttgtttcctttatccaatattactcattgattataatgatcaccaaaaaatgaatacttacgtgaatactagagaaaaaatattgcttaattttgaaaatacaaattgcttatttgtagaagctattttggttttatttgtatgtttatttaaagtttgcgagggaaccagggttatcaggatcactctgatctgaaatctgagatttgggtaatctcacttctatccaaaaatctctaggacatcaagctcatcaaggtcttcagatgctcatgatgcattaattgccctttgagaataactgcctaagagatggatgtttatattgattttatggtagatattttcttcttcatgggagtggaattccttttacaggttgattcacaaacctagagccaaaaatataactgaactattacagatttaaagtatagattgcataattttgtaaaaatattatcatacaaattctaacatatcgtgagctgaattatactaccacaactaaaactcaattacttataggagtcagacgtatattctaataagacagacactgaaattgctatttttgtctgctggccaaattaactcccaactcatcagtttgcctcccattccctaaagccttgtgcatatgaattacctggcactattgctaaatacagatttttttgcagtaagtgtagggtggaatctgtaattccacatttctaacaaggtcccaggtgtgtcagtgcaacacatctaaggaccacactgaacataactctatacaaaaaggctccactttttattaaactgtgattctgaaaacccaagtagaaatcaggtttttaaaaacttatcattcctttctttggctgttgagacttgtatttctccatgccatatcagacaaattgcatttacctggttccctctgaattagcaatcttaggaacttcagctactctcagattctattccgttatttcagagttcccagtggttggctcaagtgtgagtgcacattcaggttttccagttgcctcatagcgtctttccatgaccttctcccttattccagctcctgcttgggtgtctctggcaccttcttaggacagatgtgggttgtccaatgctcaggacactgaatccagctcaagtacccaccatgagtttgatgcaaggcaagcgagccccaaagtggggcttagcccatgagggttcttggcttctcccaggaaagaatttaagggcaagccaatggtagggtagaagaaaacagctcttatggaagtggccgtgttacagttctgtgattgctcccacagagcagggctaccccacaggcagtgtgctgagagtagcaactcggggcagttctgcagtcatgtttataccgaccttgaattacatgtagattaaggagcagcttatgcagacatttctagaaaaggggtagtaactttggggtcatcaggtcattgccatgggaaggggtggtaacccccaggtgttgccatggcgatggtaaactgacagggcatgctggtgggtgtgtcttatggaaagctactcctgccccagtcctgttttagctagtcctcaacttggttcaggatctgagccccacctctggagtcgagtcccagttggtacctcaacttcaagtgaagaaagtcacttaattcagttttttgttgcccccttaccaataacttgaaaccatttgagtggcctctcatcctattcaaaactactcctttcccttaagcctaaaacattatccttggaataagcctcagcacctcgactctctccttcctttaggctcagagaactgatgactacttcatgccaatacatccttggcaagccacctagtaggctgccattcccacagcaagcccagcagaaccatcagagtcatggagtggttatagtttaggctcttaagttggaattcccaaggacactataacatagtgttcctgcatgggtgagggaaaaataataactggtttttatggagggctaggagaggtagatgaattacctggtgcaaagccggagtcagcatctgtaactgatgagtgagcaggacaagttagagttctatgaggaagctttatgccgtcactggcaaaatttgaggcagcaaaatgcaaaggaactcaataaatggtgagatgattaaccaatgaggtggtactgactccagcagtggtgttattgaaagttcaggtatattcaattataacacattttaaatcttggattgcctgaaatcagcctgccaaatatgagaataatccaggcagacaaggacaaagaacattacacaataatgatactaataggcagtgtcctgtacattgtaattgtacaatagtgacagtaataggcagtgttttccagcatcaactggagtatcatttcctatcccaagtaagttaaacacaggatgagctcaacatcctaaggtccagaggagagtggacggtagtgagttatgctgtctccctgtggtgcccagggactctctctctgtcaaagatgctgtatctaattacctaggctctttctttctcctttcctcctcctttcctccctctctccctccttctctctctctgtctctctctttctttctttatgccctagaaataagtctttttcttctttcccagaaatcatggtgataagtagaagcctgcatgcaggaaattattgaatataacaaaaaaacatagttggtgaagttaactcaagacaaaaattatatacaaagaggtaattgcatatagattagagaagtccagtgtattccctttttgtaaaacgccttctgaatcgagtatcttttgattccatacaattctgtctcccctcacatctgacctattcatgtcagagatctcctacctggctcctttttcatctagtaattaatttatatccctgtcctaacttctatctcctgctcccctcaacattatatctctttttataactaggatatactcaaatgaaaaaatccatgtatcttactatcttctgccttcttctaaatagttgtgcttccttttgatctatttatttgctacaccaggaatatttgacatttcctggagaagtaggaatctcttgtatgctcatttgaaatgagctagtgtggttatttaacaaatatgcagagcaacaatgcacaagatgatcaaaagatatacgtggagaaggaagttctctatttcacaccactgagttacattttaagcatggggcttgtgaactaataccactgttcaccttctcaaaagggcatggtatttaggaatggcattattacagttttctacagttttccaatagaagacattaaataaatgagagaacatttctattgggcaatattaaaacctttacttccacatccactgctttcgccagcttgaacagattagttattcccagtagattattctcattggtaattctgtaataaaagattctagatattgtgcattttcatcactggcattacaatttttatttcagaatcttggtcatcgaatattcattatctaattataataaaaatgcatgattcccttaggaatgcctataactaaatgaatatgaactttattaaaggaattaaattaggagattaaaattattcaaagggggtaacaactttattcttaaagaactgtaggattgcaatactaggaaagaaagagaataggaaaggcaacagaaaagtagtaaaaagaaacagaaacaaaacagatagatccctgatgtgctatgatggggaatagagtattaatttaattattcagttataaataaactaaagcctaagcctagtaaattatgtgctccttgaagattagagttaggactgattaatctttgcattccccaccagaccaggcagtgcctggaatgtagtggacactcaataaatttttgttgaattaataaggaagcaaattctatatgaaaatgataacaagtttatgagtactttttcaagtcagtttgcagatacaagtttaaggaaattcatactcggatatagttagaatgtgtatactgaattagaatgttagtctatgtgctttgggaattaattttgaagctcaggaagctatgcaagaggcagccaagctcagaggaagggtgagagacttgatcagctgcccctccctgtcttgaactatttcctgttatagatggaaatcatccttcattacctgggaaaaagtatgagcccaaagcagaattagccttctttatacatgtgttgaatttgtgttcccatcatattaagtattaaaggaaatgattatgagctgtttgttggacagtaaagggaagtgataatgataattttaatatagttaacattagcttgaaacacatgaaactgatatttttgtgtgtaaacacctaagtgaatattgacaatttcacatggtttaatttaatattgatcaaatgctacgtggtaggcactgtgctaagtaatgtatagtccattaatttgtttaaatttcatccaaaaagctttgtaatagatgaggaaattaacaataagttagggaacttgcccaacatacaaagaggacatagaaggtaaacagtttaacatcagagtcccttttcttaaacagaatactatcctgccagggaaaatatggatgtcataaattatgttatcaaaatcttgccttccaatcacttatttatgtcaacaaaaatgtgacaataagatataccatggttaattcacagtgcgaagtgtctgcttctagaaaggtgaaatttgcttataatacagttattattataccactgcaatatcgaggtcaagttctatggctacaaaatgacataatctttactcaagaaggtcacattgcagtaaagaggacataattataaagagtattacatcactagagttagatttttttttgttggtcaaatgactcaatccaaaaagtaggatacatagtaagaatgtgctatagagacaaagagataaatatctgaaaccaaggccccagaaaattaacaatctatgtcaaccataactgtattatccatgtgagtcaatttctatgggaaatacagttctgttatctatggataatacagttcttcctagaggaagaagcaattaattgatcttggaggggtcagggagagtttcatagaagatataacaactttacaaggcttgagggatgagtgggattgcattaggcagagaaaagaagaaagacatcctagaaaagggcgcaacatgtacaaacagaggaatgtgtgacagtaaacagtcacgttgaggaacagtaaatggtttatgtggctaggaggcaagtttgataccacattatattctgtattcctaaaacacccagacacgcgaaatgctgaaacagtaacttggactcttttgtgaagatcccaggactggaaatttctactgtgtcctagaaagcaatgataagccaacgatgctgtttccttctcgagctataactttcatagagggaagtgcacacatcttaaatggacagcttaggcattgttacatattagtatacccatgaaattatcacccagatcccttgcttggaagaccaaatgtcttttttcccccctcagaaatttattaccatttttcagaattaatattttctaaaacccaatataaaacattatatataaccattatggactgaactgtgtcctctgaaaaactcatctattaagccctaactcccaacatgattgtatttggagacagggtcattaaggaaattatttaggtaaaatgaggccacaagaatggggccttaatgcgatgggggtggtgcccttataagtagaggaagaaacacaggagaggttcctttctccactttagttcatggaaaggccatatgaggacacggtgggaaggtggccctccacaagccaaggagagaggcatcaccagaaaccaactctaccaacatgttgatcttggacttcaagctttcaaaactaccagaatataaatgtcgtctaagccacccgatccatggtgtctcaatacggcagcctgagcagactaatccaacagtctcgaagaattaaatttagaattggtcatcaagattttgttcacctcaaggaaataaaatgactcaatcctccacggatttgtttccatcattttcctttcctattttcagattatttgcaacctggagactgccctgcaaaagcacgtggcaatttccccttctggatcctcacaggagaaaaataaattcacattaacaaatattcagatgctttatttattctgaaaaaaataaaaaagtgaaattgctaaattgctaaattgagtttttcactggtcaaaatttacatagcccaataggtgtaggctccttactccttttgaggcattttctctctcttgattaacagtgatggatttttattgccccacttctgagaggaggatttatatgtcttttaatctgtgtaagttggactgaatcataaatggttcaccctctaaattacagagtaagtttgccaatagagatgaccttgtttattaaaatctaattaactgaagttttagaatgtccctgagtgggttgctgaatttctgattttctccaaaccaatatagatcaaatatccagctggctggagttaaccacaaagctctgaacctcactgtgaaattatctagttaattcctctttcagacattttttccaaaggtacaagcccaagaatcctttaatatgttggccatcctatttcagaaaagccatgtgcccaattatgagttggagaaagaagcccaggtgctccttgttcactgcaactgaaatgagaggaccctggagtgtaactttcattccccagcaatggtcagtcagaatgtctctgatcatgtgccacttttcatcttctggacaaagttctatgctgcctatacacataaggcagtaatattcatgactttttactgccaaccttggaaagcaatgttggcaaattgattacagacatatgggataaaacataattaattgattcagttcctagtctatatacaaaattgcttaatgctaaaactcctctagtttctgccctattgcttcttccatttctcattccaactttaagagtttaaggtttgtctcttctctctcatctcccatttaattatcagctattgaactttttcttcatgacattactagatccctttgtgtcccgtccaccgatgatctccatattgatatagctgatgtacatgctttaattttttgataacggacatttttgcaatatttaacataatataccacctcactcccaccccaccctccagaagctctctgttcccttggcttatagtacatataattcttttggttccttcagaattttagatcctgtattttcaacttctttggttcattcttcttctttcatgctgacactgacagtgctctcaaggctctttccatggctgcattctgacttgcatttagtcccagtcactgagagatattttgaagttctgtttttatttgggccacctcaccctgaagagtaagtacttttcattgttgtagctgaggtggtgtgcctttttcaaacgtctacgtcccacagcatcttcgagatattgataacataaaaacaaatatcgatcatcctaagggccttacagacttcagagatgggtaaaagaaaccacttccaccttcaaatcagtcttttgtatccactaggggagcaaaatgacctgctgagttgaagtgggaataacaaagtatctcaaagatgatgtgatgtttgtagagaaaagtttgtggcagtaatcgatacaggaatcacttatatggatctgtgttacttggagggggctttagaaatggcatcaagaagaaaaaaagcaatgcttcttggtttaaaaaataatgcttttatcattgaaaaatagtaccttttaagatggccaaatccccaaaataaaaattcaaagcatattgtacttccttctgaggccaaatgcatcagaactaatgctcttttgagaaaaccatgctatttaagcaaaaatttagggagtggagagtccgattattgtttttcatgagtgttgaagtctatggaaacaatgaaggaatgtacagaaagtaaattagataaagatttgatttataaaaattgtccaggtttagaaatttttatatatccaaacagaagtcatgaattaggtttccccaggctgtgaactagactaaggtggcatgtaccctcacattccaaagctgagtgccctctctgtccgtgtcacccagttaccctccttgggtgacataagagaagcccaacaattcctgggggtgtctcagagtccagcaggaaagatttatttgcagagttgagatgtcagcatattccgtctgcccacaaccatcatcaccatcatgggagtggactatcgctgtttagtttcaagggaaagaaacatggatgtgtggaatgaagccagccatgagcaacctttaaaggcacccacccaggggccatcaaggcaagagtgaggaggagtgtgaactgtgcagaaacagaggggagttgtcagtggctgggtgcacatggcattccagtttctgcacttatttattggttataaataacgcttcagaaacaccgagaagtcctagactattcactctaattttaaaagaatactgggccattataagggaagattttccccttgactacttttgagatgccaggagttggccattaattgctagatatgaaaacacatggaaatggcaaagaggctacacatcaagcattccctctactaatcatgcaaatgagtcatgatgtacaaaatgtaaggaactcctgtttagggaaaatatgaatgtagatgcacaaagtaaaatgtatgtagtccaaattagtcttctagccagtaaggcaattttcctatatgataaaaagaatggatttttatatcatttaaaggaaatacattgaaattattttagaatttaaaaaatgtaaacatgcatctttccttcttaaactctagagtatcggagatttgatctgtttttttctagctcagctattaactggttgaataccttagtctaggcattgttttattcctagtctattacctctgaaaaatgagggtagtaattagattatctcccaaaatattactgttctaattgcatgtggggaaattgcgtagaactacaaagtcttgtcatacaacctacattaactggttgagtaccttagtctagacactgttttattcctagtctattacctctgaaaaatgagggtaataattagattatctcccagaaatttactgttctaattgcatgtggggagactgtgtaggactacaaagtcttgtcctcaaagggctcacactgcatatctacgtgaagaaatattggcccagataaactaaccaacttacttttacatagagacagagccaaggtagggtttgcctttgcaaatctaagtcttgtacccctttcaccacgttaatgagatatggatcttctaattaaatattaatttctaaagaaataataagccccaattacagaaaaaaaaagatactaaaaatatttcaagagcattcaaggagcttcaatacaagaaaggcttgttgttgggtttttttcatctctctccattgatagttaagtacatacgggtagctattttagagctgcgcctagttaacgtctatgtttattcatgtatttattcaatcatgaaacacgtggagccggccacttttatttgaatccactttaaataaacacttttgtgttgattgtacaaagttccatgaaacaatatatctgccctcagggaacttgctttccagaaaggcaaatcaaagaaaaacgttttgcaaagaatcccgaaatggttacaagggctttctaagagaagtctaaattgaacagataattgtctcacattttgtaaaaggcctagactattctcactgaaaagcagtaattgaatctgtaattactttcatttcactggggacataggcatggattctaaagatctcattgtcatggttgttttcttaatcactctcattgcttcctagcaacactagcttccttccttccatgcaggaaagctcaacagtcaatggtgggcaaggacactatgagaaacatttaatggcacccacccaaggcccatcaaggcaagagtgaggaggggtgtgaacagagggacctgccgcttatttgcctttctgatgatccagcccctgtttgttttatgaacaaaggctttaacttctgacatagaagcgatttttgaaaatgaacgtaaaggaactggcaaactcagcccatgggtttcccttttaagaacatgaaatcacctcctcataatcatttcagtgatgccaggaacgttcctctctctctcccattcaccctccaccattcacagagatttgatttctagaattttgtcaaaagacaaaattgcacaaaaaattaaagatctaattggcttttattagcaattctcaaattgggcaacaccccactctataaactggaatagctgtcccagtgccctgagtagaggagattggctttataggcagaaaaggtctgaagaaagcagaaacaaggaataaaaagtggattggtcatttcaaagttactttccttgtagggttaaaacagggggatctcttatcatgccagctcaggcaaactggtctccttctctctttttggttttgacaaaatgtcttgctctatatggtggtatgatctcagctcactgaagcctcgacttcctaggctcaagcaatcctcccacctcagcctcttgagtagctgggacgacaggcatgtgccaccatgcccagctaatttttagtatttttggtagagacagggtttcgccatattgcccaggctggtcttgaactcctgagctcaagtgatcctcccatcttgatctcccaaagtgctgggattaagggatgagcccccacgcccagccaaactgggccccttctgattgatgactatgactctcctgttatttggaaaactggtggctttcaaagttcacgttagttatgtggcacctagcacaagtgattgcatgttggtttggtctgagttgttgggacctactgcagggcctactccaaaacaatggcctcccataaaccctgtatgacagtctcattaaggcattgcttctacttaactggtttgttaagtgggaggtttaaggtttgtcacctttttctctgagagcaggttttagtagagacttggacagagggcatgtagcagagaggatacagaaagatggagctgagaacaaaataaatacaataaactaaaaattcgccatacttttaaaaatatttaacaaaaactaactttggcttgagttataggtttcctctcctgttttatgtgcattagatacacacttttaacaattagatagtttttggtattaaccatgaagtagcatcttatttctgggtaaagtctgtctatttttttaagttgttttaaacttttaaaacattttttagttatgaatttattttattttattttattttatttattttattttatttttgagacagggttctgtcacccaggctggagtgcggtggtgtaaccttggcttgctgcagcctcaacctcctgggctcaagcaatcctcccacctcagcctcccaagtagctgggagtattgatgtacaccaccatgcctggctaattttaaaattttttatagagacagggtctcaccattttgcccaagatagtcttgaattcccacctcagcctcccaaagtgctgggattacaagcatgagacaccatgcctggatgtgaatttttatttaagagatagaaagaataagaacaacccaaagattatttaatagaaataactagacattaatcaaaaatctttagtgtaagccattagtaaaataactttccaggaaaattcttataggtttttaccttttgacctactttttctaaacacttgctatggaaaaagtacagtgtatttgaggatgattgttaggaggcagaaaaggtggagaaaagagaggctgggctcagtggctcatgcctataatcccagcactttgggaggtcaaggtgcgcagatcacttaagtcaggagttcaagatcaacctggccaacatggtgaaaccccatttaaaaacaaaaaaagatggagaaaagagatacaaagatttagaggtaaagtgaacttaattgtctgaacaagaaatcaaacaaaagactccaaaaagtttagaagccatccttgagatgcagatttaatgctaaaaatgttggcattttcagaatattacaatgatgaatgttgacagtcaaacagaattttattgttaagcttgtcctggaaaaaccaagaatgtttgattgtctgtgattgagacacagtccctaaatctagtttggaaaagtgacagatgtttcaggttgggatacaaaagacaaattctaaataaggaatgaaggagagaaggaaacatggaggaaattggtgggacattctgtgccatttaaatatcttgactcttgttaatgaatgtctatatagaggtcaaaggtgaggaaaacagacaaatcatgggtatctaagaaaggtgtgttttctatccaggaagaaaggtcaatggaatacataaatatagtgatataaactttaaaggtaggaaaagcccttaaaaacagagtcagtaaagattttgtagtccctggttcatagtcacaaagtagaagacaccaaagccaggaaatacaccactttgtagttcattaccctgctacttctagtgagatgtgtgcaaaacacttgtcagaccttattgccaattggcatttgagactatctacagttcttttttttaataacctcattgaagtataatttaaataccataatattcatcgattttaactgtacattaactgtacaagtgtacaggtttttttagtaaatttttagaaaattcattgagttgtgcaacaaatcaacacaatcccaacttaggacatcaacattatccctatacgattcccggttaccatgaatttctgtttctactcccagcccgacaaccactaatctcctttctgtcctggtagatttcctttttcatatcagtaaaattagaatatgtgatttttttgtgtgtctggcttctttcacttagcataaggtttttgaggtttgttcatgttgcaacatgtattcagatttcattcctctttattgtctaataatatttcattgtatgtattaccatacttttatccattcactagttgatgggcacttgcgtgatttccactttgggcctcttatgactaaatctgctataaacatctacctaaaaggctttgtgtgaacatatgctttcatgtctcttgtatagatatccagaagtagaattcttgagtcatatggtgtgtctatgtttaactttttaagaaactgccaaactgttttcaaaaatgactgggcacagtgtcactttagtgtaatccaagctacttgggagctgagacaggagaatcatgactttacagcccaccccccgagcaatgtgtgatgattccagtttctccaaatccttgtcaacacatgttattgcctctccttttgattatagctatcttggtagtgtgaagtagcatctcaatgtagttttagttacatttgcctaaggaatgatagtattaggcttcttctcatgtgtttatgttgtatttgtacttatatctatgagatatcttctgtagctataactttgacttcctgaattctgtccagaaatttctagtttgggtgatgctgtgatggaaatgcatgaaagtatgcagagtaaacattttttaagggttactaaataatcctgaaacttcacaaaagagaagtccatctactctgctagaattactgtataggaaaactcagtgtaatcattttcataatatttggtagaagagcaggcttattgtaaaaactggggatgtttatttttctttagggcttcatttttctactttttcattaagctaaggataagattaaactgcctggaggcttctttgctttctcagcacaataaaaaagtcaaggaaagacagcaaagcaagacagaattcttcagaaaaacaatactgaagggaaataacagtaacaccaggttagagaaacaaaatccatagaatcaagctttacttgagtaacaatgctgatggaaatagcatgtaagagtcttagttcagggcctattggaaatggatgatagaatttttccaatgtacaagcccactaacagatataattagcttattatgctaacatgataaatagttactgaatatctccctaaattagattgacctcaatctgtaaggatcgtaactttcaacaaaggctcgttttgcttgcaaaaagattcacacaagatgctcagatggacaacataaaggtatttcagaggacccctctccagaaaccaaattggttgtggaggctaggcacagtggttcacaccgtgaagccaggagtttgggaccactctgggcacaaaagcaaaagcaagacctgtctctacaaaaaaaacatttaaaacagtgggcgtggtggcatgcacctgtactcccaactactcaggaggctgaggcaggaggatcacttgaatccaggttgagcctacagtgagctatgattgcaccactgcactctggcctgggcaacagagcaagaccctgtctctaaaattaaaaaaaaaaaaaaaaaaaaagtaggttgtgctgtaggatcacaaaaactttgtgctggttaaaccactttactgcctttcatgaattagtttccacaactaatgtagagtccgcttctttgagagtttcacatgccattgcttgtggctttccattctctggatccctgtttagatctttggtcaaaagtgaccaaggaggcatctttatactattttctccttttattattttctcagctgacaattctttccctcttttgttgattgggtaaggaatatctgagtgttattactactagctatacggcaaccttttataaacttcaatatagcattacaaacattggttgatttgggcatgaggtagttctagaattcttttttgcttagtatggtatattgatagattaggggtaaatgtgaataaaacattgcagatatctttgaatttatgacttacaagtaacctcaatatttcagcctagctaaagacatctttaaaaggtaattttcacctcatctataaatgagagttaaaaggaaaattcttttaatttacatagtggtgttttggcttatattctgttttggtttttcccctttttaagacgaaaagtccaaggaggggatccagatagtgtgaatctgaatccagactgccactggtaaactttgtctagctaaattctctgattctcattcttctcatcagtaaaatgagaataatgtacattatctcacttaatgattattattctcacttaatgaatcatgatattaaattttcagtatcattgaccaataatgcaaacattttcataaaacgtggcttataaatttctatcatccctgatgttaatcagtttttcttgcaaaataattaagtaatgcctgcttttagtattaaaaatttttttaagttcaaaacctactaaaagtctacatttataaaattattacaaacacttaaaaattatatttccaaattatgagagtgtgtagatatgtgaattcctataaggttatacacatatcaatttgggcaatacaattacataataattggaatatttccaaacacttgttttaaaaatgctttctcctagcactagtttcataagaaggtagtacactgtcactcatcatatataaaccaacattactggctgggtgtagtggctcacacctgtaatcccagcactttgggaggctgaggtgggcagatcccctgaggtcaggagggcagatcatctgaggccagcaccagcctggccaacatggtaaaaccctgtctctactaaaaatacaaaaattagtcaggtgtggtggtgggcacctgtaatcccagctactagggaagctgaggcaggagaattgcttgaacccaggaggtggaggttgcagtgagtcgagatcgtgccattgcactccagcctgggcaacaagagcaaaactccatctcaaaaagaaaataataataataataaaataaaccaacattaccaagtgctgacaatgatcttgagcaacctgaattttcatacatccctggtagaaatgtaaattggtacatgcttttgggaaaactgcttgaaattatccactaaaattaaacatgtgtactttatgacccagcatttctacttttaggtaaatgcttgacataaatgaaggctaataagtaacacatctataagaacattcatagcagctttattcataatagccaaacactggaaacatccaaatgacaatagaatattcattcttattgttgtattatattttatttatataatacaatcttttgtattatataatacaaatacatgcaacatgtattatacaattttttgtattacatataatacaattttttgtattacgtataatacaattttttgtattatgtataatacaattttttgtattacgtataatacaatttttttgtattatgtataatattttttgtattatatatactattttttgtatcatctaaataaatatttaaagttgggtagaaggagctaggcacaaaggaatgcatagtgattccatgcacataaaggtcaagaacaggcaaagctcatctatgatgacagtagacaaatttatggttacttctgatggagtgtactgattgggaagggcatggggggtgcttctagggtgctggagctgttctaaatcattatgtgggtcatggttgtacaggggtgtgtgtgtgtgtgtaaaattcattgaactgtacctttcagattttcatgatcattattcatttcattacagaatgtcatagagattccaccatttaaagaccttgtttttataaaattacccatactatcttatagatgctggaagggttaaacaatgagagtagccacaagtagcagagcaccttctcttcctacaggatagatctcacttgtaccaaagctgacatatgactgcctgctatgtaatgcacagtaaatttaaaaatttattattaattaaatttatttctcactgttacaataaataaattgaagtgtagatggtttctgtcctcttgcatgtttctttgcatttattctcagtacatatttttgccccctctttggtcccttcccaaaccccttgctcaactttggaaacttgattgagttacacaacagttgcctaccatgatagtcagtgggatatttgctcaataaatttctaaagcaaaaatggacaattatgccccattatgagttagaattggcaaactctataaaggaccacataatatacattttagactttgggggggtcttatgtctctgccatagcttcttacctctgtagttgcatcatacatagacaatacatttttttaaatggctgtatttcaataaaacttttttatgaacactgaattttatagcatcacaaaatattttttcatcttttttaaaaccatttaaattgtgaaaattattcttagctagcttttgagccatacaaaaagaagtgatgggcagaatttgggtctcaggacttagtttgcagagctctgatttagagtcatgtaattttaagtaataacttgaatctcaaccttcagttccatcatttctagtaggttatcaaattaccatatgctgttagagagtgcttttatttattgttcctttaagaagcactaaatattaagtttaatatcaaaggctttgtttcctctttggcatgattgtaattcataagacttctaataaaagagggtgggtttgtaaaaaattccacagatatttgaggcctagtcattagtagctacagtgtcaataagaatcacagtacttttctgcattatcttaattctgatttgataaataattattttttaaaaacccttcattttgaaaacaatgaaataactaaggcagtatataatgcatttatttgaggccaactggccaagttctgtgactccttcctgggtttctatgggtcctgacacatgaggaaacaaatattcactgacattcaagaaggtcagaggtacaagtaactgctccacactgcatagcattttcaagacaggcctccaagttggttcctctccattccctgcactatttgctaagagacatgaatgataaatctttacatcattgaactgtctgtctcattctcctgtcatccaaaaatcagggtgggatttttctgatgagttctatgtgcaatttcaaaattgttatttctattcagactgaatagtaaaaaatcatctgaaagggtaaatttgaggaatgacatcacactgctttgtgcctcccacccattcactcccaaatgagggatccctcagccacagcagcagaaaaagaggacaaaaggccactgattttccatgaaggtgaaatctgtgctgcacgggctccaaaactcactgcacataactcatcttaagcccatctccaggaacccctcctgggtttctatgctccattctagagtcagtactttgcaactagccttgtctttcctcctttaggatggatacagggtagacttgggagacctgaaacaagataaatatagagtcaacagaagaacaaactcaggaggaaagccaactgggctcaaatctcggctccactcttcattgtagatggaaatagacacttattgaatacctgttctgtgctggaaacttcacataaactgttccagttgttaaactaaacaagaagagaggaaggaacaaaaggtgtcccttatttaactcatgtacaatagggaagaaaacttctgaaggaactgcttcaaatagggttttgtttcacatattattcaagcgaccaggttgactttgttgaacttctgattccatgacaacagcaaactctgcatgtgtgctcagggtttgacatgctgtggtgtactctctacctaaaagagtacgcagcataatggttgtgaatctctggaaatcagggtgtcgcttctgttttccagaagatgaagatgccagaagggcttctgagcaatgtgctatgagaccacctatggaagagagagaacaactctttaactgtggctttacttagtaaacttccaaacgattactgaaatgtcatcattagacaacgtaagcaactagcagaaaattcatatgtctaatgcagcctcctcattctttttctgtctttccctgtgatccaggaggaaggatgctggtttcttatcatacaaagatcacctgccagtgagccaagtggtggttggagatactgaccgtcaaggctcagaagccaaattgagcgtaggtcctctgcgctgccaaggagacagtaagtttgcatagcagctatggcttgcactttcttatcccatttaaatattgtttccaggctcctcagaagatgcctgcaatcagacttgctctcctgtagctcctacagaaacatcacacaacccaagcagagataacttagaggaggggaacagccataaagcctccagtacaggagccgagatttgggcataaagtggggatatccatctttcctctatattcatatgtaacaagtttgactacctaagtttatgatgatattaatagcaatgctaatagcataaatgcagtactcaacagctgtgattccacggagtgctgctgttaatgccattaggatgactatttatatcaccataaaccgagtttatggtgatataaatagtagcattatggcttaatgtatcattgtaaacttggattatggccatataaagtttgacattattgctatcaaacttcatcatcatcagagcttgatggtcccttgtaagccaaagattgtttctgttaactatgtcttgctttcaagattagtcaccccagagaggaatttggggctgctagcttggacagtgggaggtaagggagttggagtgatggtccctcctaattaagggcaccattaggattttatgttgtttgatacccttcggtgtgctttatgtgcagtcagagggaaacagtgacatggttgcactgtggggattctgcagcgagcatcctgggcatcgttttctctcttctttctgggacacgtggtttaggcaactctcctgagagttctatgcttttgtgattgtgtgctaggcatccggagacctagattctgctccccaaatagctgacttgccaggagacctcaggcaaacccctccattgtcttagctgtggtaatgagaataccacacacatcccaattcctcctggggaggctgtgaatattttagtgcctggatttggattcctcctagcaaagcattatgtgagatggaatattattaccactttgtaaatcaagggagaattagacctacttgataataaattatagcgtccactcaaagagatgtcctaaggaacgtaatgatgcatgcttaacagtttcctacttagtaaattgaggttgtcagcaattaagcaatgccatgttcctaatacaaaagggagatggactttgtactgatttttctctacttacattgaaaatgctacctgtaaaattgagactggtcaagatctttatcacgcacttattgaacaataatacttcatttgtttagtcaggcttagtaaaactgtgcagaagaaatttaatttcaactgcctaagaaaaggatattcacctaaagcaatagtatatatgcattttaaacaaatattataagaaatgaaatacagtgttgctctaaaattaggaagactgtcatgtgttgtctaatgaaaatcatttttgttatggaataattactcattagcatataaaggtaaaatatttctggcttaccgattctaattctgaagttagctttgaatttgagaaagtgttcccattaaataattgattaacttaatatatttataaaaattccacttctgcaaactttttttcttgtctgttttgttttgctttattttctttttttgagacggagtcttgctctgtcgcccaggctggagtacagcggtacgatctcagctcactgcaacctccgcctcccaggttcaagtgattctccagcctcagcctcccaagtagctgggattacaagcacacgccaccatgcccgactgatttttgcacttttagtagagacggggtttcaccatgttggacagactggtctcgaactcctgaccccgggtgatccacacgcctcggcctcccaaagtgctgggattacaggtgtgagccactgtgcccagccttctgcaaacttttattaccattcttaaaaaaaagattctaggaacattaaatagtagatgctgcagtatatgagcactttataattaatattagcttatttgttcttaataaatcagcctcaggaagaatttattgtgaggctgtcattcatctagaactttcctaggtgctctggaaagtaagaaaaagaagttcaaaccatgttatgtgaaatgaacatgaaaaaatattggaaaacacaaattggcttataatttaattttaggctttgtaatataaaattattgcaactgataatcaagaaaggagccatagaaggtgtatttcaggcagactttctttttaaaaaagagaaaatgagaaaagtatagtggtcattgttcatttgcatttctattctagggctgttgttcttagaaacatttttagaacctattatcaaaataaacttatttattcacattacatgatctcagtatacttataattactgtaacttcagagaaactcttttaaataatattttacctgatatttcatgaaagcaaaagcagtcaacagttaatggcaattatgtagaatacttttgtgtctgtgtgagagagagaaatctcattgttttccaggcaaccgagaataagtatcctacctggtactcgaattgcctggtagcagtcagcagttgtgaagcccatgttccctttaagaatgttctcacggccgggcgcggtggctcacacctgtaatcccagcactttgggaggccgaggcgggcggatcacgaggtcaggagatcgagaccatcctggctaacgcggtgaaaccccgtctctactaaaaatacaaaaaaaaaaaaattagccgggcgtggtggcgggcacctgtagtcccagctactcgggaggctgaggcaggagaatggtgtgaacctgggaggcggagcttgcagtgagcagagattgtgccactgcactccggcctgggtgacagagcaagactccatcttaacaaaaaaaaaaaaaaaaaaaaaaagaatgttctcacatggacacagtagtgatagagtgttccgtatcaactgcattttccagtttttatacatatgtgatctccctggttacacacagcctcctgtgaattgggcagggcaaatattagtctttctgccttacaaatgaagaaaatacttctttgaaaatggcatttacacagcaaatttctgagcatactttcagcctctgagaggcttcaggacaaaagatggaacagagaatagaaatagctgtgtctgtacaaggtcagagttgttttcccaactgtactctcatccctgagccaattgttgattaaattaaaatgccttaaaatgtttcatttgggttttatcccaccactagcctcagccacacatgtcagttaccaacatagtacaaacattatagggattacatttatgtaatttaaaaagtggcatagtgcatttttcctgctgtttatagagatgaacttactttgtgtcatttactgaagtctgttcaaacctacagcttataaagactaaacctattgttgaaaaatatctttcagtttgaggagttgagtgatgacagccctcagaacctgcctcttgaattaggccccagttccatcctctagtctcagagaatgaaaccatttttgtgggctctgcccaaccatttcagcagttttggttgatttcatcatgcctgctgagtttcatttttgctttgattcgtctgaactcagacccatataatcaaaatgctaaagaaaatcagtgcatgccactcagatctgctgcatttcccatatagttctgtgaaatgcttatgtccttacaggtgtgtgtgtgtgtgtgtgtgtgtgtgtgtggttttttttttctttcattctttcttttttgcaaagcctatccaaatggaaacttcaaatcaaatgacactgaaagtatgagtggtgacggatggttcgctgaaataaaaagtgctgtgaaaatacaaatccccctcttaaactacacgtacgcacctagaaagaaacaaaagaaccatttggaagattaaaaatcaatgatcaggtagacattgtttcaaattgaaatatgtaatcatctttgcagatggctgccaaactttcatactttcatgaaattagttaaaaaaataaaagacttccactttttggaggtagaaatctcatactatatatgacgaatataattaattgtaggaatatagtatttgctagacaattgctttattttcagccatatgatgtaaaactttactgtactcctctagggatacggggactgtaaataaatactttggagcaagtttgtcagaaccataggaaaggtttaaaaaaaaatcaaatgttttcagtaaacctgggtagaaacaattccagaaaatgtcttattcaagggcttcttccaaggccatgccagaaacactggctgtgaagctggcagacagagcactggagtcacactgcaggattaagatgcaaattcagtttctcagagctacggaggtgacccagagagacaaggaaggaaaggcaaggcagtagtgacacatctagttctggaacactcagaggacagacaaagctgtgtgtaaacaaataaagatactgatggagattcatcaagatgatggtgaatatttgttctttgggaaagttattttatgtgccagactaataggaaggccattatcttttttttgcaagaattttacaaaccaggatcataacctgccattcccttgacaggagagataagatggccaggcatggtggctcacacctgtaatcccagcactttgggaagccgaggcaggcagatcacttgaggtcaggagttcgaggacagcctggccaacatggtgaagccctgtctctaataaaaacacaaaaattagcagggtgtgctggtggccgcctgtaatcccagctactcaggaggctgaggcaggagaatcatttgaatccgggaggtggaagttgcagtgagccaacatcgtgctgttgcacttcagcttgggtgacagtgtgagactccacctcaaaaaaaaaaaaaaaaaaagcaaaaacagacaaggcaataaggcaatgcctcggtctccacgttgtttctgtaccaatgaaacatttccaacaggggcgcacatggcagtaactctctttcagaagataatacccacgagcatacataggccacatactctgtgcagtgaatagggactgaaggagaaaccacttctcatctgggttcaggaagcaattctccttattgagaggaagcagctctccaggctccagagaagagttcaaaatttatttatctcctttttctttgctgcttcaggcttggaaaaggcaagaaaggaaaagggactagcatgcaggttctaaaccaatcactttcgattcattttctctcttgattctctcaacatcccttaataggtgatactgttgacaaaaaaaaaataaaaataaaaataaataaataaaaaagtaccctgtaaaatatttaaagaggtttatttaagccaaagatgagtggccatggcccaaggtacaggctcaagaggtcctcagaacatgtgtccaagggctacaatttggtttttatatgttttagaaagacataagacatcaatcaatatatgtgaggtatacattggtttagtctagaagcaatgtgagagtgtggcttacaagtcataggtggatttaaaaatgttctggttggagattggttaaaagagttaagttattatctgaaggtctggaattgatagaaaggagcatctgggttaagataaggggttgtggaggtcaaggtacttattatgtagatgaagtctcctaggtggctgcccttagagacaatagatggcaaatgtttccatttagacctttaaaaggtgcttagactctcagtaaatttcttctggattttgagggcctggaaggggaaagatctagttatgttgatagagattattcatagatgtgaattttcccccacaaaaaaactgcttagcagggtcatttcaaaatatggcaaagaaacatgtttgggtgtgaaatctttttatttcttcctttttctgtcatgtgatgttatgctagagtcaggttaaaatttggtatcttattgctacagtctgtaaactgtcatggccctggtggaagtatggcagtgaggacaaccagaggtcactcttgtcgccatcttggttgtggtgggttttagccggcttctttactgcaacctgttttatcagcaaggtctttgtaacctgtatcttgtgccaacttcctatctaatcctgtgacttagaacttctaaccacctgggaatgaagtccagcaggtcttagccttatttcgagatggagttggtgcttagatttttagttttggttcacagtacctttgactccagtgtactgatgaggaaacagaaacaatgttattaggtgctttgccaataagtttcagagttcagactggaatctacctagttccaaagtcctcctttctactctattcaatcagagctgatgttaggataaaaatgggaagaaaaaaaaatctcttatgctctcggggagtggctgggtctagctgtttgctaatgagggggtctagggaaacatccctattgccctgtgaagggtcactgaaaaaccaactcacaaggcaggttaatagaagaaaaggcatgcaaattttactacagggagaatcacagaatgatttctcaccccccaaaggagttcagaagcttatatatcatcctggaaaaacaggttttgggagcaggggaggagaggaacttcactttcactgtcaaaaggactatttactggctgggcgcagtggttcatgcctgtaatcccaacactttgggaggctgaggcggatggatcacttgaggtcaggagtttgagaccagcctggccaacatggtgaaaccccatctctactaaaaacacaaaaatcagctgcgcatgttggtgcgcacctgtaatcccagctgctcaggagactgaggcatgagaatcgcttgaacccaggaggcagaggttgcagtgagccgaaatcacgccattgtactccagcctgggtgacagagcaagactctgtcaaaaaataaataaataaataaataaataaataaataactatttacaagttcatctctgttcctagatccatttattctctctggtaatcccctcaacagaattcctcttctctccactcccataatctatttttccaggatggtaaataagcttctgaacccccactgggggtggggggtggggagtggtaatccctctggggctctccttggttctccacatgtacatgttaaatcaatatgtatgccttttctccatttaatctgactcttgggagttgatttatgtttttactttttttttttttttttttgcgaatcttcagagggcaaaggggaagattccattggctcttacactggcaagctgtgtcttctaacttactcttacatgaagggctggttctgaaagcagagataaaaaaaggataggtgacaaaaactgctcccagtcccatgcttagtggagaaaagatcccccttgattttgcacccctctttttgacaagtcatcaaacaactgatctttttccacttactgcatctattttggctcccctaacagtgtacttcttaaaagtaaaaacaaaatctaattcacttgtatattctcagtagtatcacatgcctaacacctagaaaggattcaacaaatgtttgttgaatgaggaagaaaaataatacatcagagcagagggagagtgataatgccaggtttggcctgaaactcagcttctgcccttagggcactcatcaccccaagcagagaaatctcagggcgctggggctttggagttctctaatggagccacaggtgctgggccaactgacttcctacatgaaatctggattttagaccctgttttcctagacccctcatttcctgcttgggtacagctcttgcctctgccttttcttttttaaagttttcattacactgtgtactgatttctggctcactttgcttccctactattgttctgaaagcttatctctgattcagccccacccagaaaagagaggttgcctcaggcaatctatgtaggatgataataggtgtattaccagcatagaggaccactttctctctgtctctccattcctgccctggccattaattataatacattcgatttacttgggtttggtcttcagccctcatgcttttgcaacatcatgatgggctcatacatgatttttaaaaagagcattaacatcacaaatctcagaatgggtaacgtttgatcattcccagtaactatttcctgagaagatgctctaaattgtttttctttccccattttttcccacaaaatgtggctgtatatttttgcctcacgtatagctcaaaacaagaccaagaatcacagtgtcctaacagtggaagcgtcttagagatcaaccagtgcagaacctctcattttacagatcaggggtctgggtctagagaggttaagtgactggcccaaggtctcagagctggtatacagcagagcacatcgagaaacagtttaatacagccttcatccttagtaattccccagggccaagatgaatgttgacacccaaagaggaaactttgacctggaacaatgaccttgggtctctgcctatcaacagctgagtgggtatcagaactcttaatcttactccatcatgagatcaatcatctggaaatcttgatagaaaacctacagccacagaagtgagggtcagtggcagaaagttgatgacttctgtttttttgttatgttttttgtttgtgtgtgtgtgtgtgtgtgtgtgtgtggttggttttttttaactttttagggttgataatagaaggcatgaaaaaaaaaacaaaagcaaaaacgccctggagtgatgtgtagaaatcattaagctctattttttcttaatgtcccagccttcactgctattgccatgggctactaacaactgagaagcagtagtgggtctaagaacaagcagaaatagtgaaattttcaggatcacaacctaggctgactcccattaatggattgagcccaccgggcatttctgaggtcaggtccaattacaaatgctgtagcttttacaagtagatggaagccttcccttttatcttccagattccagagtgactttaaacaattagaagaaatggacaattcctgcgaaggaaatcagctctttaagattactcagttactcaacttcagctgcaaactcactgttgaaatgggacgtaaaattggttacagtttggaaaaaagtctttctgttttacaattgacatgatatttgtgtgcgtgtgactgattttcttacctgtcctttcaaataccatttgtatttggaggaatcgtcacatgccacagaggaattaacgtgaatgagctgatgccagacttggttctgcaggtctgtgttgtcaacaaagagtcaaattctgtaaaatatttgaagacatttattctgagccaaatatgagtgaccatggcccatgacacagccctcaagaagtcctgagaatgtgtgcccaaggtggttgggacacagcttggttttatacattttatctattttatgttattttattttatattttattttttgagacagagtcttgctctgttgcccaggctagagtgcagtggcatgaccttggctcactgcaacctctgcctcccaggttcaagtgattctcctgcctcagcctcccaagtagctgggactacaggtacatgccaccacaccccgctaatttttttatttttagtagagacagggtttcaccatgttggccaggctggcctcgaactcttgaccttagatgatccacccctctcggcctcccaaagtgctgggattacatgcatgagccaccacgcctggcaggttttatacattttagagaggtatgagacatcaatcaaatacatttaagaaatacgttggtttggtccagaaaggcgggacaactcaaagcggagggtggtgggggtaggggttccaggctataggtgaatttaaatattttgtgattgacaatttgttgagtttgtctaaagacctgagactgatagaaatggaatgttcatgttaagataaaagattgtggataccaaagttcttttgaagtcttatagtggatgcccttagagacaatagatgacaaagtttcctattcagatcttaatctctttaggattgggagggtctagaagaaagagatctagctatgttaatagagattctttacagatgcaaaatttcccccacaaagaacagctttggaggcccatttcaaaatatggctaagaaacatgctttggggtaaaatattttgattttcttccttgtctcataatgttatatgagtcaggttggaaaataagtcacaatatataggttaaataaaacccatctgatgaaaatttattatttgtagggcatgactccccacacctcttagataggaatttgggcaagacttaaaaaaaaacaatcagagtttagtcctcagtgtggctggatgggttctgcctcctccatgtcctctctctgggtgcctctcccttcctgaacttgttactctctgcagaagaaacagcatccccagatgcaggcgggagatttctctgcaaattgaatccccgtaatttggtttctctgctgaactctctgaccaatctctcaccatttgaagagaattagtcttggcctattggatctaaacatccacagtgtggagcatactttggaagtgacagaaacacggagtgaaatagagtctaacctattccaggatcagctcctgaaaacaaattcaacctaagagactttattgagaaaaacgagacatggctctgatcctggatcagtttatgtttcagtgagggtgaaaattttaacaaagtggaggagattaggatggaagtttggattcctagtgggactttgagtggaaagctgagaggcctcatgtagttgtgctttacaaacattaatgtacttagaaaccacctgagatcttgttaaaatgcagattctgattcaggaagtctggagcaggacctgagatgctacaaggtgtggctgctgctagccaacaggccacgcttaggccagcaaccttacatagcagcatggtgaacagcacagactttggaatcacacccacctgggtccaaatcccaactttctccctcactaaccatgtgcctttggacaagttccttaacctctctgggcttctacttctcacccagatccttacctcagctgcaaatgagaataattgtaacatcactgagtttgctccagtaaagcctgattgtccccagtccttgcacatagtcagagctctctaagtgttagccaacatcatcattcttatatccatttgctgtggaaaaagtggcaggcttgatatcagaaaagctctgcccatcttcctgctccatgttcctgtccctgtacccttgacttcatgccttttcttggagaagacaggcctagtctcaggtgacagtgtagcatccagccatttagcttctcctaatttggaggtgctggccacaatacctgattagagctcaactgcattttctgagtccccagggacaatgtccttccacataagcaatctctcatttccttctcatcatgtggatctcagcttcgatgttaattcttctaagaggacttctttgtccactcagctgacatagccactcacacctccctacagcccttcttaattttcttcatagaatgtgccactccctggaattatctctgcaatgcacaactcaattctgacaccaactgccctgagttagcacagccttcacaagttaaaagcacagtccccaacaaaacagccttctcttcacacaccagctgcaaacttgggtggctctcaagccactcacatttctgaccaactgactacaaatttggggttgctactattctttcagggtcaataattcactagaatgactcacagaactcaggtaagtgctatacttataatcagagttttgttataaaggatacaaatcaagtctagccaaatgaagagatgcacagggtgaggtcgggggaagcttcagagacaagagcttgcatgtcctctccctgtgaagtgagaattgtaggagttaaagaaagaggaaagaaacacaaaaggcagctcaacagtcaaagacaggtttattttggagaacaaacctaagaggggcttctggctgatttcagtcaagagcactctctcttacagactaagagtatttaagggttttagggtgagagagcttatcacaggcttggactgtttctgtgtggaagagaagtttattgcagggttgaaatgtctctggttggaggggggttatcttggggctgacatctctccggcctctctggccagaggggagattatcttggggctggcatgtctctggctggggaggggtttatcttggggttggaatgtttctgattggagatatcatttgtggtttatggtcatgctgaccttagcctgatgccctttggacttaggcgatttttttatcaaggggaactttaaaatggcggtgcttgtccaagatggtgatgctcctgctctgtcaagaattccctactcttctggtacaccagtgtgcatcaccaaccagtgacgctcacccaggctttgggtgttcaatgatttattgggatctcattctgtaatcatgattgattaaatcattggccacatgattaaatataatgtttagcccccttttcccctcctccctggagatcaggctgatatcaggaagctcaaagcctcaaccctctatcaggtggctggtcttcctggcacacccagcccccatcctgaaaccacctaggggcccaccatgagtcaccttattggcatggacccaggcatggtccctggcgctcactatgaataacaaacactcctatcacttgagaaagtcctagggtttagaaacttggtcccaggaacctgggacaaagaccaaattaatgacctgttatgagtcaatctcttttctctatttatttgctttattgtcaccattgtccctaacagtagacgggaatctcaggcagaagtctgtatcatggtgccaaggacaatgcctgccacattgaggcactcagacatgtgttcattaaattaatatgaatggttaaataaccacaaaagatgatttaaattagcatttccaagtaacaatggaggcagtgcatgaggcacttcatgataaattgcagaaaacttgcacagacaataattgttataaaggtccaagagaagcactatcacttgatttatatgcacaactatttttaacctcaacagggttttgcacatttattcatcttaactaaatgaaaacttttattcctttgtaccttgaaaatcccttgaatctgatgattatctttaaattaaggattaaaaaaaaactcttttgctaagtttttatacattctttggcaattctaaattaagatgcacatgaagtattaaatttatataactcattgtttaatctaaattagattaacccccttggcccttcagagatccaagtagaggcttccatacttttgtttatccatgtctcaaggttattactgacaaaattacaattagtcagtacttcatgtccattgttagggtgctaagctgtgagctataaactacctcactctggcataattaaaaccgtgttccagttcacctattttatgatacctacttggctttccataaagcttcttttcacactcctaactatgtgcaggtctgggaaacttgggaactttactgaagaaaactttaaacataagcttcttcttgaagtttgctgatagttctgttatagcagtcttactatcatcaggataaaaaaattgtactaaactattgtaaaaacataagatttgtattactacctctttttttttttttttttttttttttgagacagagtctcgctctgtcacctaggctggagtgcagtggcgtgatctcggctcactgcaacctccgcctcctgggctcaagcaattctcctgcctcagcctcccaagtagatgggataacaggagcatgccaccacacccagttaatttccacgcccagttaatttttgtatttttagtataggtgaagtttcaccacattggccaggctgatctcaaactcctgaccttaagtgatctgcccacctcggcctctcaaagtgctgggattacaggtgtgagccaccatgcccagcctctattactacctgtaaaataaatcctaattcaaaagtcgccatgtgtatgtacataggaaatagtgcatttgaactggcatttacctactggcataacaaattgctctttggaatagatgcctagtcccaagttaagaagaaaaggggactcctgtgtcccatccatagtttctcattaagtccaagagccaattgtgctaaagtaaatgaatatcttcaagctaacctataaggggtggtgggaatattagttgctagaccaacacttaatcaagaatctctcacactgtctaagggtgaatagaacaactagacttgtagaggattgcttaatctttttatgaaaaagtcatgtgccaattaagattctagccatacctccttcagggttttcttgacttactcaagctttagacaatgaagtggctcaataatcttttctgtaatccctatgtctaatgtattaagtattccttaattcaatttggtagattaccctaatcgattttgttttctggtatttaaacctttagaatttaattatattatactgaataggatacaaagtaggacttgagcttaaaagatggcctttcatttcacagaaaagaaatttatatgtcaagtattttgctgtggtattctcattgacatagctgagatgataatgtaaccagttcacgacgtcaggattgctatgagagaaccccgttactgggtgcttgatttgctcttttggtttatccaaagatactgagtttgctctgactgcctcggttttctccattttaacaaaggcaaaaaccaacactttgtattaaataacctaaaccttggcattgaacttgtcaaaagagaaaatgacctgaacattagagccaagaagatactctgttgtattttactttgttacttaggtatctttatttattctttacttatatatttcaaaaagacatagccttcctttatggaaaaattcatttgttattatttaagtacaacagatagatagatgctccaaaattaagtctgagtgttttctttgcctgcagaactgacagtttgcttggcttatgctgataatccccaaaaaagtcgcttgtgtcttgaacatccataggaaataaaactgtagttccgggcagtgtcgataagaaagcaaactttacaccttcacttaggggttgagaaagagaatgagctattgattccactctgaactttagatggccatatcacatctgaaaccagtcatttcgtggtgggcagtattaaacccgactttgtcttatgactttacaaattagcgaattatgttgttatgataagagaacccaacaaaagtatctgagtttggaacatcaattttcaggatgttatatatttgagaacacttctccactgctcctctaactcctctagcctacctaactttaatagccaggcctccttcctacctgtttccttcccccttcacaagaagcacctattaaggaatcaagaaaaaaaaaaggatgacacttactttcggaataaagtaatatagtctctactatttctgctttcacacagatttgccctcctttctggcacaattacacatacacacacacacacatgcagatatacttacgtatgcacacatgcaggtatgcttagaatttagcattaggctgggtgcattggctcacacctgtaaccccagcactttgggaggccgaggtgggaggattgcttgagccccaggagtttgagaccagcctgggcaacatagcaagaccctgtatttacaaaaaaataaaataattaaccaggtttggtggcacatgcccgtggcccaactacttgggaggctgaggcaggaggatcactggagcccaggaattcaagactgcagtgagctatgattgtgccactgcactacagcttgagtgacaaagtaagacctgtctcaaaaaaaaaaaaaaaggaacttggcatttgcaatcctgaacctactttaacccaaggtaatatggtttggctctgtgtttccacccatatttcatcttttagcttccataattcccatgtgttataggagggacccagtgggagatgattgaatcatggggacaggtctttccagcactgttctcatgatagtgaatggctgtcagaagatctgatggttttaaaaatgggagtttctctccagaagctctctttttgcctgctgctatccatataagatgtgactttctccccttgccttccaccatgattgtgaagcctccccagccatatggaactctaagtccaataaacctctttcttttgtaaattgcccagtcttgggtatgtctttatcagccatatgaaaatggactaacacacaaggtaaccacaactcagggcttaaaacttctggacaccagtgtagttggaagatatagagaggaagctgaagagaaatgagaggcagccttggaactcgttcctctcagataagggggaactgctatagttgtactcatgggtatgactacagcaaaaggatacaaagcaaagtcagcaaaaggaaacgtgcatgagatgaagtccagaggaaaccaaacacaagcttccaagagactcccactggagtccacagaacacacttaattcccccagctattagttgtggcatcatgtgtgaaatgctgtctacaacagaggctcactagagactcagcacccaaggttttattgggtactggtcacaaaggcagcccctaccaggcatgcacccaaaacccagactcccagaagaaaggcagttgtttagcacaaaccacattgtttgtaccaacagttcagcatagtggggcattcttattaatcagttaaccctcctgaaatctaacttggtgggccagccatgggaagcacttctccagcacaaggatgctgcctctctccttcccctgctccccaaacccttctccacactcttttccctctcccttccatagaagtattaagaagatgtgggaacatccagatcttcaacctcacaccaccctgcatcacactcctgacaccatcatactccacttccacctggctttgtcctgcctcttctaattcttttgttgtttttttttttttgagatggaatcttgctctgtcacccaggctgcagtgcagtggtgcaacctcagctcactgcaagctcctgccattctcctgcctcagcatcccaggtagctgggactacaggcgcccgccaccatgcccagctaattttttgtatttttagtagagatagggtttcaccatgttagccaggatggtcacaatctcctgacctcgtgatctgcccacctcggcctcccaaagtgctgggattacaggcatgagccactgtgcccggcctccctgtccgaattcttagagaaggaaaagaaaaaagactgtgctcttttcccttgagctgatcctttgtatctcatggcctgcagtttctgctgcatccattccccgggcagcaccagctacataatttgcaaagtccagtgaaaatgcaaatgcaggaccatttgtattgtgaattttaaaagagagacaataaaccaggtgccaggcccttctgaggctgtgagggtcacacacctatgtttctacgtgctagcgaaagcacaaggtcaaccctagattctgaatatcactggggcatggcagaccttgcagatgtggatctgcaagcttggtttctctaatagctttgaaccacaagaaacatttatgtgatgaaaaccaaactatatatggcaaaaatatttaacacaggggcttcttatatgtactggcaaaccatatcatattattgagttttccctaaacttgattacagaaattacctggggttcttatcaacatgcagattcccacacagctcccctagagattttgatttggattctccagagtggagcccagtaacctgtttttaagaagttttctagaatatttttctgacagggaaagtgtagaaacttaggctcagaatatttgggggcagacaggcctatgctgaaattctccatttatcagcagtgtgacattgggaaagttatttaatttcactaagcttcaatttcctcatctgtaaaatagaaataattgtgctagtacaaaaggttgctatgggaataaaatgagacaaatgtctgtaaagaacttagaacagtgactgctacagtaagctgtcagtaatcgtagttataaatattacagaaaaagagtagaactcatttaaaaccctcagttttgtaatactagatgaattaagcttaaatgcaaattgctaaaggcaacagttatttctgtcaaattaaactcattcagaaataataaattacaatctgaagtgaacaaaaggctcaatcagtcatcaatggtaaacattttgagcactgctatggtctgtttttgtctttccaaaatttatatgttgaaacctaatcacccacatgacaatatcaggaggtggggctctgggaggcaattaggtcatgaggccactcccattaatgggattagtacccttgtaaaagagaccccagagagcttattggccctttctgccatgagagacttcagctggaaggcacgatccataagccaaaaagtagaccttcatcagatatcaaatctgccttaatcttggacttcccagcctccaggactgtaagaaataaatttctgtttttcataagctacccagtttacgatattttgttataggtagcccagacacactaagacaagcaccttgtgttggcagtgtcacgatgcctccgttcttgtcttcttagtttaaaagaatttaaacagctgggtgtggtggctcaggcctgtaatcccagcactttgggaggccgaggcgggtggatgacctgaggttgggagttcaagaccagcctgaccaacatggagaaaccccgtctctatttaaaaaaaatactgaattagctgggcgtggtggcacatgcctgtaatcccagctgcttgggaggctgaggcaggagaatcgcttgaaccgggaggcggaggttgtggtgagccgagatcacgccattgcactccagcctgggcaacaagagcaaaactctgtctcaaaaaaaaaaaaaaaaatttaaacaagagacgcacagtgaagcgggtgcagcataatttattgcaaaagaaaaagaatactttgaaagttaagtgcagaatagacaggatgctctgagagagagaggagtcagggtgggctgccggggaggatgagacagaaaagattggcgggagggagactccccttatgggagtcttacctgattattcctaaggaggtgaaaagaggtgttaccagtaagcatgttctgggtggttctctgggtgcacatgcgcagtagccgcacatgcgtgttcatacgtctcatgtctcattaacatcttaaatctccacctaggggtgtattttataccattataatgaacaaagggtcagtctgaggacggatgaaatcaaagtgcgcatactctctacagggggagtccctaatgaagatagctttgcttgaacgagctcaattaccaagcgaatgctggggcttattgtattgactgtgtggtcaccacggttgctgcgtcctaagaacatggtcatttcttttttcttttttttttttttttttttttttttgagacggagtctcaccctgctgcccaggctggagtgcagtggcacaaactccgctccctgcaacctctgcctcccgggttcaagtgattctcctgcctcagcctctcgagtagctgggattacaggcgcccgccaccacgtctggctaattttttgtatttttagtagagacggggtttcaccgtgttggccaggctggtctcgatctcctgacctggtgatccgcccaccttggcctcccaaagtgctgggattacaggcgagagccacggcgcccggcccatggtcacttttttgactacctatcctgcctcattgatagcaggctgcagatacagaggcgtgaccgatgatttttgcaatcaaggaattgatcatctatttcaggataagttagagaggtgagaagatgcatctctttaaaaggaaacacataaaggttaaagggcaaagcaaagagaatgagtaaagaccattttccgtggggattggtggagtgggtagaaggcttgagctggagaatattagacaatgattagccaaacgtaaagaagcaaaagtttcctgtagaaaaatatgcaaacatacacagtaagcattcagtaaatacttgaatgagaaaatgagacctgagttggaaccagaaaaaccgacaaatgccaataatcccagagctgaagatagtctgtagacagtggggagtttgttagccagaaataggaggggtgagtgggaaatctttaattaaaataaaacctttaatctttaattaaaatattaaactcttcacttgtgcttagttgcagagatctatgcctatgtagttttttaaacaaataaaacaaacattgccaataaaatgatgtaattcaataaagggcttacagtaggttccacatccaacaacgctatactgaaaatacacaattaaaacttattgttatattctcattatagaagtctttttttttgagacagagtgttactctgtcacccaggttggagtgcagtggtgcagtctttgctcactgcagcctctgcctcccgggttccagtgattctcctgcctcagcctcctgagtagctggaattacaggcacgcaccaccacacacagctaattgttgtatttttagtagagacggggtttcaccatgttggccagatggtctcctgacctcaggtgatccgcccacctcggcctcccaaagtgctaggattacaggcatgagccaccatgcccggccagtagaaatcttttttaagaagacttttaaaagctactcattttagacaagcctttcttaattgtgtaagaatgcttggaaaaaagtagtattttactatttttaataaatctgtaaaattattgatgactgctagcttttctgttttgcttcatttataagtgaatgaacagtgattgttgtgggttgaataacattccccaaaagagatgttgaagtcgtatcccctcatgcctgtgaatatgatcttgtaggaaatagggtctttatagatataatcaagtcaagatgaggccatactgaattggggtgggccctaaccctatatgaccggtgccttataagaagagaaagcgcacacacacacactctcacacacggggagaacactatgaaaaaatggaggtagaagttgcaattttgcagttgccctgccttaagccaaggaacatgaaggattgccggctactgccagagcctgggagagaggcacgggtgaacattctccctcagaatctgcagaagaaatgagccctgccaacttggactgtggatttctacccccagtactgtgggagaataaatttctgttgatttgagccacccagtttttggtactttgttaaagtagcctgaggagcctaatacagtgacttcctaatcaaagaatgtggaggcgcaattcaagtggtcttttcaactccaagaggattgggctgtgtttgttatggttaaaggaccattagcagttgttgaaaggataaagggaaggtacttcagtctgatgcggagtcagtgaggacacccaccgctcccctgcagagcagtgtcttgagagagaaagggttctcctctctgtaggagaagcaagctccattcctggtgctcctctgtatgatgggcatggctacctatgcctgccctccagaggggaagaagcctttgtgtttaggaccccgggatgatgttgacagctatgatcacataataataattgtatgataatgattgcagataacatctgttgcgtatctaccatgtgtcagatctagttaagcacttcacaaatcaactcatttaatcctcgcaagtatatagtccatgaaggtcatattattacccttattttacagacgtgaaaaccatgatagagattcagtaatttgctccaagtgacacagtgaatgacagagctggaatctaacccaggcaaattggctccaaagcccatactttcagcctttacagtttagcaaggctgcaccagaccccaacaaaaactagttcttttgtataacaagagaaagattccctggctgaattctagcagactagattcctcagtgccattacgggctgaggacttacaaacatgaggaaaagataatggctagtttggttttctaggtctgccttagcaaattaccacaaacttggtggcttaaactagagcgacttctctcaacagttctggagccagaagttcaaagtcaagcatcagcagggccacatccctctgaaggatctgggggaggatccccttcttgacttttccagattctgggggctcacggcagcccttggcttatggcagcaaaactcccaactctgcctgtctccacaaggatttcattgtgtgttcaagtgtcctttctgtctcatgtcaggaaagtctcattggatttaggacccacgctaatttagtgtgatctcaagtgatccttagcttaattacatctgcaaatacccagtttccaaattaggtcacactctgaggttctgggtggacatgaatttgggaatggggaatgatattcaacctgctacaatggccaagaaacatctacctagttcaaaagagaacaggatctactggaaagcttctcagctcttggagccccacaactgtgtctcctgggtcctagccttcagcctggctctcagcacagctctttgcggataacatggctctacactgcgtcgaacagatttggtggcagtgactcacctagcagagttctcagcagcccacctggaaggtcccatcacattgttgttattgcagatagcactttcactgttactcaattttttttctagtatcttgtgaacaatgtgtttcaaagtataggacgacttggtggttaatgtcacaaaagcaatcattggagttgtcaatcacagaatgacattacataaaagaattaggactcttcttgctcaagatgctttatacatgagcataaattgagagttatgtatatttggatagtagaaaagctatacattaatgtgcatcttaatgaggatgattttcttcttttgataaccaatgtgtctatgaagccatctagctaggtactggtgagaaaaatgtttcaaataaagtatttttattggagcatataaaagagttacaaaaatatttctgtaaaattttctggtctatttttttcaggttggtactttttaatggtttagctgttaaataagcttcatctattaacttgtattcagaaataagcttaattattcatcaattcatgctcaccttatattttatggttttccaaatggatgatatcttctatgtctgtacattttttattaaacataagtcattttatgcccataaagcttattcctgaaaaaattattttgctactaaaaaagatcattaagttcacaaattttctctccatggcttgatgctgctatctttctgcaccataattagttgcatgtatagttaattattatgagaaaagcagaacatctcccaatttctacaagatacttagagtttgatggtttaactatgttttctccttcatttctcccatccaccctccagccacgtgtattttcatggtaggaagatgataagcatacgctttttcaaaatgacagcaaaatgttcatcaggaacttcataaagctttgatagactgaatatatatttagaaccagcatttcaatggctctttaccttttcttaagaatttccttatctatgaccctcattgctagaaaaaaaatgcgcacttttatataaacacaacatttttcatataattttaaagagatttgaaaccctctgaaggctatatgtagtccccatgccaagaatgccagatttgggaaccaacatttcttatccatttataatgctaattaattatttctcttaaaaaatactctagttagcctgtaaaattcatttagatgacacatttaattttgcccaaaaccttgatttttttggaggaaaaaataatgtaagaaaatacattattttaggttaggatctttaaattctcacagtcaaccaccatggtttctttgtacgacctaagctcattcactggtgggcaagtgttttggggaccaggagtggatctgattcatctctgtatctgccacagagcctagcatgatggtttagacatggagggagctcaagtaatactgttaccggtacacttgttatttaattttaaaaattaggaatggctactgtgtaagtacataaacatttaagttcataaatttgtttacagttgaacacaaaaaggccatttgtgttcagatatgtgacctggggaagaaagatgaaatgggtattttgatcagcacggggagcagtcagtgggcctacagagaaggcgattagaaaagccttgtgctgacagtgcaggttctatgatatggaaagaactagtgaggaagatgcacatgcttagtagctcctaggaagagttctcaaggagcatcaacctctatgtgtccttcccaaggaagcagtgggccctagattggaggaattcaggataaaacacacagtcctgctaaccatttcttatcccagtcacctgaagggatgagatcagaattactagggaaagactttgcagtgggatagatatgcttccaaggtacttctcccagcccctaatacttcctgtttgctaatgcttaaaatctctctaacctaaaatctccctaacctaacctttcattttaacattagaggaaaaaaaatttgctaaatattgactgaaatttattcaccctaaatttaatcacaaaagtacaagagcaagcatacttcctctctgattccgtgaatgagaagtattgaggagccaaggttggagaaggggttaccattgagaatcggagagggcaccagaggtcaagactggggaaaaagacaaattgaaaagacattctatctttccctaggattgttccaattatcaatcctattagataagcatatgtagaaacctggtataaaagaaattattttgtatggctaaccactctccttcaaaaaacttcacaatttgttaagtttagataaagatttatcctcttgtttgattagtttccttagaaataaatttcattcttaggggtttcactaattaagataaatagacaattagcctcttggcagcagaagctacttcttatttatctctgtattcccaatgcctaggccagtgcctagcataaatattgtgcttaatcaggattataatatgtatatttcttgaatgaagataacaaaaatatctattacaactctaagtgatttattaattgatttgagaaaggatttatgttaacttacaaaagttcattcaataagaggttacatcaaatatttaaatcattgcaagaggaaattagaagtaaagccaatgaaatgaagttatatagctaataaatcaatttttcttagttgtaataagtatacaaaatctttctgcatgtaatgtgtatgctatcagcttaatataggcatgttttaaaccatgataaagaaaatattccaatatctcaaattctttcagaattatgccaaccctagaacacagtttctagtatgtgattaagccttctattttttaaaaaagtatttctcaattgactgctttacataaatcatataggtgtaaatttgaattattactacataaatttttcttagatttatgacagaattaaaatagccttttaagtcttaaaaatattaataagaaaagctcaattatgtgaacacagctaataatacattcattctggcaggcattgtgcaaagttttcaatgaatatgaatatctttatgaaatatgagaagctttgttcatttacatacaagttccttagtctcctacattaattattttttctcattttttcatgtggaaccttttccagtaagttctcataagacaacaaatgacccagtggagtacctatttaaaacattataaacaaagaaagcttctttcttcagccctgttctttaatatgtaatgaaaatgcttcatctttcattacagaaatgttttatgttctaacctcttaacctcattattatagtttggttagatttttaaatagaactcgagtttttctcagtgtttcagacaggaagaaaggtggagtacctgacaacctgttccaggaaagaatgttcaataatcaagcatctatctcctcttcctgagttaatccagttagcttatgaggcaagcatgggggagttgcaaagtaaatcaaggtgctgaattctactctcatcctgatcctaaatggattgagttttgttctttcttatgtactatccccatattcacagttacagactttgcaggtcacttgctgtctttgtcatattgggatgctctaacataccatagactgggtggcttataaacaactgaaatttgtatctcccaggtctggagaccagaagcctgagcccaggctggcaacaaggtcaggctctggtgagggcactcgtctcggtagcagtctgccaacttctccttatatcctcccaagtgggaagaaccagagagctcgttagggcccctttttataagggcattaatcccactcatgagggctccatcctaaagacctaataatccccaaaggccccccttctcatgccattacattggtgattagggttttagcataggaatttgtgggggacacagacattcagttcatagcagtggaagataaggggtgctgtgcagacatcatgggctctatgtgtcacataatgtagcatctcatacagggtaaacaatcgccactgttatctcttcccaaagccctgctgtggggtctgctcaccggccctgcatccagtcaaggaaggggaggtggagaagggcacttgaatgctgagtggcaccaagaggaatgtgcagatgtcataaactggaaaattggggctaaaggtgaaacagcatcatacaaatgtcttccctccaaaagctcaatcttattttagaaatatatgatccatgaggactttatcataaattggcccaaaacagccagtcagctactgagggtcctcattttccaatgagtgcatgttttgctgcttcagtggtccagcacgatttggaagtattattgctttgttactgaagagacctttgttttgattcagttgccaatattctctaagatggtttaatgtgagccatggtacttaggtgtaatcctgtaaggtttcttttcctgggattcacagtccctgctttcaatagagtctcacgagggtctatgacccttccagacagcactgatttcaagtctgtatcactttataaaatcctacacatagtcgtgatcttagaaaaaaaatggacacaatatagaacacaaaaagatgaacccattactaacaaatctccatatatccattgtatctaagtcatactctatgagcccaaaggctaataaaaaaacaggatcagacccaggtacaggggcaacagtgccaacttctgaaagcagggatattggtgtagcgaaatagagaatatgaaagaaaaaacaatactctgtgagaaatagcctagtagcctatactttatgccaataagctttataggaagttctttttttttttttttttttttgaaacagagtcttgctctgttgccctggatggagtacagtggtacaatctctgctcactgcaacctctgcctcccaggttcaagtgattctcctgcctcagcctcctgagtagttgggattacaagcatgcgccaccacgcctggctatttttgtatttttagtggagacaggatttcaccatgttggccaggctggtctcaaactcctgacctcaagtgatctgcctgcctcggccttccaaagtgctgggattacaggcataagccaccgtgcccggccataatagtaacttttatatcccagacaaaaaaaaaaaaaaaactgagttaggcttacagacttgactctgaggggctcatgataataattttcttttttttttctttagttcgtttgttttagcatgtgctcagaggaaaaagaaaaagaatttatggaagaaatctctaaatcatattccgttctttcatgaaagtgggcaattcaaataatttcactcaattttcaagtgagatattcacagtaatttgtatcttcaggttgaggctaagcttcattgcacttcatgggaatatatagaacattctagcaaatctttcttagactattacatctttgacttacatgtttatgaagaatcatctgtgcctctgattggccttatataaatacaagggtcatttcagagagcagttcttaactgacttggaaaagcctaagagccaaacaattcagcagctcttccacattgatggcaccagccacatgcagtacatgtgctttacgcatttcattattgcatctctttgtcttatgagtttattgatggaaaattgtgccttgtcttttatcaagtaaacatatttcagaagacatctacatgctatcaacaaaacagagcaaattcagaaaatgtaggacttcgttgtacttgggggattacttcaattgccttaatagtctaccagagtagaaatattacattctttaaagttcagataaataatttgtgctgcttatgtaggaagtaagctattctccactgtaagcagtcttttatgttgacaatatagaaataatctgtcttataagctacactgcatctaaagccctgacactacagatttatgcatacttctggctgaaaataatattgaaatgtgaaaatgaaatctttcaccaaatctctgggaacataggtttgaggctggctttggaatcactaaaaattcattgattcccaaacgtagactaagtaccataagaactgactagggtacttgattgagcttgtgctgtatggtttattacactggtggtaggaatgtgtcaatagtgattatactgctctaagtattttgttttagggtatgattctagcttcccttgtatcattactcaaaactccaaatgaagtgtgtaagagtatttttcaaccctggatttacttgcattccatactcattaaatatatgacacaataaaatgtctaggtcttatgcaaggaacttcaactcttctatggctcctggcctaaaaaggtatctgtgagaggcagaataatgtccgccaccaaagatgtccacatcctaatcttcagaacctgtgaatatgcgaccttacatggcaaaggggatttagcacttatgactaaattaaggatctataaatgcggagattttcctgcaattcgctgggtaggtagaatctaatcacatggatccttaaaaatagtaggaggaggccgggcacagtggctcatgcctgtagtctcagcactttgggaggccgaggtgggtagatcacgaggtcaggagttcaagaccagcctggccaaaatgatgaaaccctatgtctactaaaaatacaaaaaaaaaaaaaaattagctgggcatggtggcggttgcctgtaatcccagctactcgggaagctgaggcaggagaattgcttgaacctgggaggcagaggttgcagtgagtggagatcacgccactacactccagcctgggtgacagagcaagactccatctcaaacaaacaaacaaacaagcaaaaaacatttgaagcattgagattaaagtgttttctttgattaaaaatctgtcaagagtaattagaacctgcttcctttcctcttctcattgtacagcttacaatatggatcaagaaattgtttctattgacatacttctttccatgtttagatcggcttccaagatcttatcctttccactttcaatgtcatgaaaaatcattgagagttcctttaatgcgaaatgttatgccagtgtcacttcctgtgagacagcttcatcctttttggggtcacaaccaccttccttatttgtgtagttcaattcatttaacctgagttcctctggctacaaatctggagtctctgaaacaatgacacattcagctattgcttctataactccatttacattcatttcacatttcactttcagcatcatcactctctgtttcttgatgcacttttatcttagttagccaattctcccttctcgtgtccagttttgtaaagtgttatatgggcttatcactgggaaacaaggaggcaacataaccacatgctttgctgtgtgtggaaagaataacattatgtggagtaacaaacccttaatagattttgaaagaagtgacatggttggtcactgatcatgatgcacatctgttatttctgtatagatacttctgaatgcacaatgaggttatgtcccaataaatccatagaaaacacatagttgaaaatatatcaaaagttgaaaattcgtttaatacacctaacctaccaaacatgatagcttaacctagcctaccttaaacatgctaagaacacttacagtagcctagagttggaccaaatcacctaacacaaagcctattttgtaataaaatattgaatatctcatgtgatttatagaatactgcactgaaagtgaaaaacaaaatggttgtacaggtactcaaagtacagcgtctactgaatgcatatggcttttgcaccttcctaaagtacaacaattttaaggcaaactgtcataagtcagggttcatctgtagtgtttttggacaggagagctagtaacaaaacttgaacactatacatatgcataattaaatttgtatattatgcaattactcaaacttagtatagcacagtaactaaaatttgaaccatgttgggagactggtatatttacctatactatagtaactgaaatttatgcatattaaagtgtgtgcaaagcaaggactgcctctttgtgtgtgtatgtgtatgtgtgtgctctgtatgttttgcatattttcaaactttaaataaatgccatcatataatatttatccttttatgaacttgctatttacattcaaacaatgtttctgattattcttattaatgtatgcagtcaccgtttatttctttttctgttttatgatattccattcacatgactatactacacttcaagttatttatgtattctttattgaaaatatatattgctttcagttttttatttttgcaaatatgactcctctgagaattaatttattgcttccatgtagtcatgtgcaagaatttctctaaggtaactatatctaggtgtggagttattcagttttaaaccttattagatatttccaaattgttttcccaatttacactttcaagtaagttttaattttattttgactcaacttgctccataacagttagtattggcaaattccattttaccaatctgatcacataaatgaatgaggctaaactaatttaatttgggttttcttgattaagggtgagactgagcatattttcaagtttcctcaaatatgagttatctgtatcttttgataattatattaatatatattatttacataaaccaaatattaatgtttataatttgtatatactgcagctgtcatctcctaatctttgtcttgtctttttatttgaattatgatatattttgatgtgcagaagttttaatttgaatatagtagaattcatccattttcctttttggtttatgttttgtgtcttatgtcataaaaatattatcttttgtgcttcatgccttttttcttttatgatgtcttttttcttttaaaagttttaaccgttttctatgtttgggtcattaaaatacatggaactcaatttttttaatggtataatctaagggttcagtttcttatttttgacacatatacaaccaaattttccatcatcaaacatgggaaaaattctttctccactgaactgtaaagccacctctgtcatacatcaaggtttttttttttttattagactttattttttagagtcaatttaggttcacagcaaaactgaatagaaagtacagagatttcacattcaccctctgcccccacatatgcacagtctcccctactgtcaacatccatcaagtttttatacatgcaagggtctcttttgggctctatatttttttcctttgttcacattgtcaatgctgcacaaatttcatactgtgctagtgatacatcttcataatagaacttggtttctgatagagtttagtctacagtgttgatttttaataaagttcttaaaatttctaactaaaattcatgcaaattttgctactgcaaatagtatcttttaataaattactttttctaatgattgctgatagatagaaatgtaattttttgataatgtgagacagaattcacattacatataattcatccatttacaatgtaaaagtcaatagcttctgttttttgaaattatatgtatatatataatcatatagtgtgaattctttgtgtctgacctctttcagtcaacgttatgtttctgatattcaagtttttgtgtgtagttatgtccatttatttttatcactgtagagtatcccatcatataaatatatcagtatttgtgtatcctgttttcagtttgggctattgctgattatacatcattattctagaatttccttttggtacattttaaacctgcccactctctagagagtattttattattttctcacggttttcatttcttttggtctgtcttacaagtgtcttaagtatatttgttttgtatcttttttataattattacattaccttgagggtttagagggtttttctggcactttttcacagtggcttatttcctcatctgttttggtatttttgttatctttctgcttatcccttgcaccttgcaatgtgtgagactcattttgtcttaggttgatgttgctctgtctcaacaggatttggatttgcttatacacgtgctttgatacataatctaggttgggtttatgttcatttattggcttggcttttcttggactctcaagtagtgtatactcaaactgtagacctctgtgagggcaggcctgtggttatgaactctcaggagaatagctcttccttattcagtattctggccaagacagatgacagacatttcctatggccagtagtcagctgtgtttcctagaacatcctatcattgaagatgtagccttcaggggcctcagccctgtgcatcctctagattcccaccacaggggagcccagggcactttcctgtccctggaatgctgtgcaattcaatcctctcgctttccaagataaaggaatgtccccagttaagggccagctcaccactctgatgttcttccccatttttttggtttttgcctttttgtttatttctttgtttaagaggggatgttgctttgttgcccaggctggcctcaaactcctggcctcaagtgatcttcccccctcagtctcccaaagtgtcgggattacactggcatgagccatcatacccaacccttccccttctttttctaccattgggatttatcttgctctttcgagtccccagctataccttaaaaaagacacttgttaatttttatgcagcatttgtgggaattattttagagattttcagaacccctagtctgtcataataccaggatagaaagtagaatggtgctggccagggcctggggagatggagaaatggaacattgctgtccaaccactgtgaaatttcagttatgcaacaggcataagttctagggatctgctgatccaccttgtgcctgtaggtaacaatactgtatggtgctcttcaaaatttgttaagagggtagatctcatgttaagtgtttttaccacaataaaaaaattgttttttaagagttgaagactattttctgaataaaaacaaaatgaaacctcataagtaaattcagagttgcctagtaaaatgtgtcacacgcataataaaagtgtaaaacattcacactcctcactctcatttaattatcaagaattaattaagcttttatttttcttccataaattccaagttcccgatagctaacttccaaagctaaaagtaatgttacttttgactcttttgctacaacaaataatactacactaataccctggcatgtattgtgtggctatgtagagtatatctgtaggaaatgttggtggaggtggagctgctggttaagggtgagagaaattttaattttctagctttcaaattataccattcagcctcccttttgtaaactgttagtttaaatttgcttttctgtaattgtacgtgagtgacaattattaaccccagttaaatgaacaaggagttgatcatctgggggtgttcacagtgctgaaattatgaggaaaagatgtggttcaggagaagcttattaaatgtactttcctttttctccacccccacaccaacatgctgacaatagaaactcattctcaaactgaccttattcaaggtaagaaggtattgttccagtgtgttggtttcaaggactttcttccatgcagaataaatagtagaactaaaatatcactaaacctctaagtaagcagattatgtgctgtcaacggtgaatgcccaatatatccacagcgcaagaacttaagtagacagaggtattaactgtcattttatttgaaggaagccaaaaaatcttgtgctcacatcatattccttaaaacctcattcttccagaatggctaccacagtcccaggcatcacctggagacagagacataatacccagcagaagaaaagagtttattattttatgatctctctgtttgaagaagaaaaaatacaacactttcttaaaaatttctaagtggacttcctcttgtgtattattggccaaaattgaattactgaatcatatgccaaccccaggaaaatcaattattggtgtgaggaatagaattcccctgatcaccttagcctaatcaatttgtatccatgacttacacaccctgcaacaaaggaaaatgtaggacttgctattgattacgtacacaagtgtgcctgatgtggacagcaaataagtttgatggtattgtttgtcataaagttaagtaacagcatgagtaatatggccctctgtggaatttcttggtggcagttgagcaaaatttaaattgctctgaaatggaggactgtgatcacggaaacaaggtagagttagctgatataatttggtacaaggaaattaaccatggttgggtttttgagccatagatatgataatactcagaaatatatgtaataatgcagcattcccaaatgattccaatgttgagttctccacacaaatcatttcattttctttcagttggtgttaaagatattggagtcctcatttggaagtcactcactatagcatttatgggaaaccgagctctgaattacaaacatcgagttgacaaacgaaaatctggaacagaacccactcaccagctggcgaccacccagtattatttgactttaaacttgatacttgaacatgattttttaaaagaaacttaagcaagtaaacataaaaaaaaaaaaaaaaaccacctctctttgacttggtcttgcaatgggctttttaccgctttgaaatggaatacagttttatttccaataaacagcagccgtaacaaaacttcacacagacacctggagaaggggcatttgatgaatgcaatactatcattgtttattatagaattatttactagaatctggcagagatcctaaacaccatttaccataactttggccaattttcctaaatccatacttcaaactctactgatataatgggctgctttagccaagaatgatagctctgttactccccaaatattaccaaaacaaaggcgtggtcacttcccacaaatccacctggagtatgagtcaccagctgccccttgttgatataaagagctcgaagaatgaacagttttgaaatccattagtgaatcactgagaatccactcagtacagcttggagatctcaacagaagccaataataattaaagaaagaaaagctctgggttaaaggaaagcaagcaatccagcggaaccaactagaaaacatcagccaactgcagcgccttgctggaattagggcagaccacagtctagtgcctgctagagcaattgaaggaagcccagctgagagagaaggcttcagtaaagaaaattagggaaggttttatttttatgtgaagttcttgtgagaaggatgttaagagaaagcattatctgttattatttatgattgttgagccccacaagcaagcctttgagtttttataagcccacatagcatgtttttttgtttttgtttttcctgagggtaaacacttttatttgtaacagcattgtccatggctgtcaatgtatctgatggaaaatacctgtccataagcatgaaggaaatccatgatcttcccctttaatttgcagaacattacatagtatttttttaaaaaagatgcaaatagcagcctacttctttgctgctaaagagctttaatggaatttttagtgaatcagatgtgtaagggctgatgtcctccaagctgagctggatctccccagttcttcctaaggttccttttgtgtcacattcaactcaacagacaggaagcaactctcctgcagtgaaggccgcacagtgggctctgctcctaaatccaaggacacagaggagcgcctgtgtccccaaatcaggaaggcgggcatcggcgagacccagtgtcacagagaacgagcatttttgctgctactgttctgtgcaagtgatcacagcccagatgtacagtatgatttggaacctccacactatttagcatcccttaatttgtatccagtgtgctaactgacctggaaacattagaaccccatttccaagtttctcttaaaaatccccaggtcccaacacacaccaaccactttcatcctcaacagggcatgttacgccagagacagatccttctgcatgcattttgccttaatgccagtaagaaaattgattttttgtttcaggatttttcaatccagaagacaaagagattagtcagcagcttttaaaatgaaagtttccaggtgagagatttcaacactattttgtagatctggtgaattaagatacatattttcagtattttaggaattcaaattctaatcctttccaattcaccaactccctttatccaaatccatggaatcagagtctaatgaaaggggtacttagcatttgattccaagctttcccttacaactacatttacaagaaagtattttgaagctgagaaaactgacaggtcctgtggttgatctgcacagttctatttcctttgggctccaaatgttaaagcacatgccctggcaattcgggcaccagttttgaatgaagacacccagcatcttgcacctgcctgccaatctccacgtcctttgtagaggaccggggtggacatgcccatcccctcctggggaagtctgtttacactgcaaactcctgacttctgcatggcggtagagctgattgtgatacctctgtccacctatgccagcccaggtgcctgacttgtgttgggttaactattctgatagctttgatatggccttcccacatgtgccttctcctactgtggccgctgtcactctgtctccactcccatgacacttggatgctccagtgacaccagctcctgcacagtaccactcttcagcagcgttcatatcaaactgtgcatgtctagcttatctgggggaagacactgaagagaggcagaggtggagacgtgaaagaagacagcaaaatcacagagcttcgcaagagaaactgcttgcttaaagataatttcttcttctgattacaaaagttacacatgctcattgtcaaaatgctggaaaatacagagaagtttaaagaaggaagaagttaccataatcatactacccagctaacatttcggtgtattggtagtagggaaatttctggttgtcaaggaggaaggtatatatccctaatcacagaggttttttcatgctcttaggtcctaagttatagcattttaatgggagatttctaagacggaaggtatttctggaatagcattccttccctttcttctgcagatctgtcaaattgttcagctttcttgactaatagatgctatggatagagcatccctctctctctaaaaatctcaaaaaaagcaagtcttatttattcaggatttgaagagaaatattcaggaaggatatttcatcaaacctgattcatatattatgcactgtaatgatgctagacacaaaacacaagatttcttgatagatggtcagaataaattacaccaactgcattagctcagcagcagtcctgcccggatctcagcacctgagcttctcatctgcgtatggttgctcagcttggtcactgagacatgcaaaagggaaatgggcattttccctgaacacctaaatcctttccaaaatctgtcaaaatgtttactaaaatgtagcttctttgtttatcagacgaactgtggtaacagcagttatgaaacttatcacagttcatctgataaactacattttagtaaacatttcaaagtgaagcagatatgagagagaacaaaattatttgtgtttacatgagacttggaattgttaaaatttttatatctagcatacaaaaaggctgcttatgttaaaaattgatagtaactaaatatataagaccaaaagaatactaataatgtgaattaaaatgaaatcttagcttggtttataaactatgaaatttgactaaaatctattctgtatatatgttctagttttagaatataaactagaactagaatctaagtagtagccaattggtaagtagtgtctgactgggatctaaaccagttcagattaaaccattgcaacactactcagaaaagcgtatggtcaagatcttccgctatggagattaacaagaaatgcccatctatgtaacagtaatttaaaaactgatagtggtatattacattccagtgaatgacgtaaataatagcctttttaaccctcttgcgaatatacatggtatttgagaaaaacgttgcttcagaacaggtgaaagaatatgcctggccaaaataagttcggctacccaaaatggtaatggcttaagccttttggtttttatctttgttaaaggcagcgagtgacattttaatcttcttgtgcaggtttttctaaaacacaaaacgctttctgttaaaactcgccacaaaggcagaaagggaaaagcattcacagatgcacacagattccaagaactctctcacactatctcaggaactcttactgctccctagaaactgtttttcatcagaatggggaaaataacacgactggtacctgcaatttctgacaccaatttcacatctaacctctgtaggtatttaacggactcagggcctaactgaaactgctgctaactattgatttgttgaggtgttcatcccaggtggtttatggggactctgtaaatatgggctgataatagtaatggtcaagctcccataatttcttaatttcagtttatttatttataatatttatggttgtaagatcgaatctggtgattatctgtgctgggggcagaaatttcatttctaaaggatggcggtaaatataagcatgttgttggttgaatgttcaaaaacatatttcaaaaaccaagtactaacagctaaggggaaaaactcacacaatgaaccagaagtgtatgaaacaaggaataaaatggaaaaggagaaggcatgaatgttggagggatttaagttatggatgaaactacagtgaacattcagggtatgttgggagatgaaaactgaagcatccttttactcggtagcaaaagtgaccgggatcaagggtcactcccggatacaggtatcccggagcacctccacaatggcttccagcccagacctttgtcgtgggaaggagtcccatgctctcatttttggcacaaacagagtttgactctcaccacaaaacagcatcaaacaatgtcacaggctgtgcttctcacaaggttttttgtttgttaagttcattttcctgaactcaaacattgtgggaagaagtaggtcataatatccatttccctctaaattgatccagagcttccagaaatctgaagaccagtgaagccaaggtttcttccaaacatagagttgtgtgaaatcactatgtaaaactgtcagcattattttggtggcaagttctgtccccatcttggctctcctccctgcctctcccacagcctggtacagtcagctatagagttcagccctgaatacctgctggatttacacctagcaatgcatctgttgatctcactgatgtgaaaatcattttacaaagaattcccactgcattttctttagcatggcattcacattcccccatagtgtggtcccaaatcactcctggtcttcatcttctaggttcctcagaggggacctcctagcatcagtctgggaattctctgtctcctatgggatccaggacctggaccacccagtgtccttccaacaggcctgaaaccttcctatgtgcaggtgtggaatgctgctttcgcttcttgcctcccaatatcttattgattcttcagttccttgttgtaatctccctcattcagagttgttttgtgtttgtgttttgttttgttttgttttttgagacagagtctagctctgtcacccaggctgtagtgcagttgtgatatcttggctcaatgcaaccaccccccaggtccaagagattcttgtgcctcgggctcctgagtagctggacttacaggtgcatgccaccatacctggctattttttatatttttagtagagacagtgtttcactatgttgcccatgctggtctcgaactcctggcctcaagtgatccgcctgccttgccctcccaaagtgctggggttacaggtgtgagccatcgtgcccattctcagggtattctttttttggggggaggggtgtgaggggagggtgaggagaatggagtttcactcttgtcactcaggctggagtgtaatggcgtgatctcagctcactgcaacctccacctcctggatgaacgattctcctccctcagcctcccaagtagctgggattacaggtgcctgccaccacgcccagctaatttctgtatttttagtagagacagggtttcaccatgttggtcagtctgtttttgaactcctgacctcaggagtggtccatcagccttggccttccaaagtgctgggattacagacatgagccaccacacctggccagagtattatttaattctctgagtaaccagaagccaaaggatattgcttcacctttagttgccatgtaattgaggcatacctcatcatcagcagtacacttggttttctatactggattacacaccttttggaggcaggggctacttttattcttctttaaatcttcacctgcactagcatgctaaaacaaggaaaagaaagttttatcttctatactggaaacaaagaaaaacaagggtaattcatcttacttttatcactagtctccgattaactacatgttcaagtttactgtatagtatatctatgtgatctaggcaggcatatttcccctcaaatatataatatggcaaaataaagtgcaagttgtgattggtgaagataaatgactgaacttttactatcatattctcactctgctgataaatcatctttgagaattcgtattaattttggtcaagaaatacacaagttaaatccattttattcttttttttaacattgggaggactaagtgaataaagaaggagtgaattatatgattgtctaccccacagtttcagtaaaacgatattttttcctgcaatatatttatgatctgccttaaaaccatagaatctggcttaagccaaagcaactgtatcttcctttattttttaacaataaacacctttaattatcttccttccgactactttgttgtaacacacaatgtgtttgtctcctgaggtgagcataaaaaaggagcccagcatgacttgaatgctaccgtaattaaagaaaagctaaaaaggtcaaaaacaagaatgtggtaaatcttaagcaactccccagaacaggcgccacctgccactttgtgctgacaccgtcaatcattgaatcggttactgaatactttcttgcatttcttcttctccaccttgtgcccacgttaagcaggaagacatcatattttcattagcacctgttttgttttttcaccttctgtagactgttgagtgaatttctaataataaagccaaaaggaaaaataatggcaatatgattggacaagcagtttcagaatcaaggtaggatgcctttttgttggtggaggttttttgtttttgttttgtttttggacttattctccctcatatcaaataaatttattaaacacacctgaacacttgttatgtgccactgtcggccacgtattagggacacggaagaacaataagacatactccctaccaaaagaggcttatggtttagaaggaagacacagtcttgtaaacaggtaagtaaaataaaatgtgagctgcactatgctggaagtcagcccagggtggcccaagtagaccatagccagtctacataaatagggagacacgggggacagctttctagatgtccctaacgctgaatcctaaaagatgagaagcatttctagggtgccagagtggagaaaacacctgacttgtgggagaacggaaggcctcgtgttcattcaatggatcaactatcattgggcatctccacctgcgagagacggcgctagcccctggggatccagtccccggtgagctggaaagctactctgtgctctcagaggacttggaacagagaatgcagacagggtggcaggaatgcaggaatgtgctcacagtgcaggaacccggtggctcgcagagaagggcaccaaacttagacctgggagatcaggaccctctcccccaaaacctggaggattgctccaaagctgtaccgagtcagtggcggaggccgggtgagcgtggggaagggcatcagacacggtatacctgctccacctttcccttttgttttgttgtcacaagaggcactacttcgctgcctccgtctcctctgtgggtggaaaggatggacccaaaggaacagaaggctgtggccactcgacgatggttttgatagggacttatcttgctctctctccctggacactctctttctaggcctgcagcctctctcctcccttcccatttccaaagcctctgccccaacctgatccaagtattatatgtaaacctgtcattagggttctttaaatcaaggctttttgatgacaaaaagagggtttaaaaaaaaaaatgtggctcacgcctgtaatcctagcactatgggaggctaggcaggcagattgcctgagctcaggagttcgagaccagcccgggaaacgcggtgaaactccgtctctactaaaaacacgaaaaattagccgagcgtggcggcaggcacctgtagtcccagctactcaggaggctgaggcaggagaattgcttgaacccgggaggcggaagttgcagtgagccgagatcgtgccactgccctccagcctgggtagcagagggagactccgtctcaaaaaaaaaaaaaaaagaaaagaaaagaaaaagaatctgtaagaatatccagtgtggcttctgcctctggaataagtaatagtcttagtgaccatggctatgggagtacccgggttccatcagtgtgccctgtgtggttttggtctgggctgcattggcgtggcctgtttttttgtttttgtttttgtttttcccttattactgttcgtggagtgttttagtttgcttttttgtttgtttggttggtttttttttggactctgcgaatggatgtctaatgctctcgtctccctggcaggacctccttcctgtgtctgcagtttctcttgtagccacaccgtctgcccgatcatcagtgctaggaaaataacgatgagaacagacctttcgaagcccgattatcagaaagagtgtcttcatgcttgaaatctgaatataaaacagacgcccctgaagtgcatccctgtgacactgcctgtacagcaccgttaaatatctcatcggcagtaatagcttaagactactgtgctcagtcacttctttgggtgtcactcatagcaatccccatccctgccatcatcattatcacacagcactgccataatgacaattataaagatgttagaaagctgagacaagtcattctgaattaaaccgcagctcccataggtcctctgaaattacccgtttccaatatctccattgtttccctacccaaaagcaaaaaggggagacaaatgtctcttgagcgatgcacaaaatacattataagcctgggaataatcaaagctaactgtgttcagtagagagagatgcactgtgactaagtttcactgaattttaatggcataatttttagcccagaaagcaagctcatgtgtgccggagtgattaatgatacagtttatgcagctcattggtcatacttaaattagtttaaatattcatctgttgttttgttataatgaatctccatgtttctttttatttctgttcccctgagtgtttcctcttgtctggttggaggatgtttgcctgaattgggaaagaaatgccaatagccctgtaggtgacaatgcacccaggctgctgaagatcaggggagatgaggcaataaacgcttcatttcacactgtgaaatgcacacacagctgcaccagcttcttgagtgagatgtcttggtggattctgtgaggtgccaggtcagagattaaacttactgatttgtggcacatgaagccattggatgaagttggatgctgtttgctgtccctgggacttcctttaaagtccacacatcaatttttataccaactccctgaaagtcctccttttatgagcattcataatttacattttgagttggaaagtcctgtaactctaccttctgggattttatgaattttcctcccaaatacaaaactctctagatgctgaaattgcatttgtggtgaagaagggaaaggccataagagtaacttaataagacttcatgttacagaactgaaagatctttcaaattcacataaaaggaggcctgcacttgacactgtcctgactatataacaacatctagaagtagacagtgttgcctttttatgctatatccttgggagtacaatttacaaatagtctactacacacttcttgcacttgtgaatcacccatatagatcaacctttaaagtgtaaaaaaaaaaaaaaaaaaaaaactttataacatcctgagaattaatccttggagagctggctagatacagaatgaaaaattccagacaccacaagtagttagagctcagcttcctggataaatcagttaatttggaaattgtggcctccatacccgctaggcatgtttgttcatccattgttctcctccctatctcctagccacagtgaaagaaaacgaagtgtggtgtacacacacttctagctatgaaagcagctgcatgatactggaaacacagtgtctccaaatgtttcagccttgggggcttccctcattattactatctgaataaagtgcttcagtccgctatgatactttactctaggaaacccagctttgttcctcacattatcaatgacttccaggagtgttcaggaaggacccaacttttacactcactattcaacatgttattaccatgctgctaatgtttagctttcttctacattatttgacccccaaaacagacactataacccaactaatataattctgttatagcatgttacaagtttttagcaaaggtgagaatcatcaaattgcatacgggatgttattattcttcatatccatcaaagtacaggaagtccttcacaggcagccatctttttctctgggccacaccagagaagccccctgccttctcctttctttgagtttcaaggactgaacttcatgtctcacaagcagtcagaggtggaagcaaatgaaattgcctttgcaaaaattctaacagtgagaggaatctcacctgactccatcttgcttctaacctcacaagctagctgactttgttagctttaaaacaaaaatgatacatcccttcctgaaactaacccctccttgcttagggactgaaaccatgtttgtaagtctaatgaaaggacataagattaggattatgggaggggcctgaattctgctaagatatatgcatagttaaacaataaccagctattgttccagaggtacaagatttgtaacttctccaactgctcctttagataatatccatatggtcaaaacctaagattgggctttgaggtattttccagacttttgcatttggtttgaccagctgatgccacctgaacccaagactcataccagggaactggctcaaccagtcctgtgaccttcatccagatactgactcagtgcacaaagaccattttggacattcctatgatttaatccccagtcaatctgcagcacccattccccatccccctacccaccaaattaccttgaaaaacactagcctccaagttttactatctctcatccttctcttggctggccctgcaataattaagttctttctttgctgcaatacctgctatactcaatgcattgacttttctgagcagcaggcaagattaacccatcaggctgctatacaaatacttcctgttaccttagtactcaaaacaatctatggtccctcttctcaacctttctttcttgattatttaatctctgttaccattcttacacttacttacttgcaataacataatacttactctttctgtaataacttgcaggttataattggatcatgagtgacctctccccaaattcatttatctcatcttaagcctaatgaatgaaaaaattatccataatgagagaaaacagcaggatccttttcataaagagatgtttgaaaacaagtatttttggaaataatatattaagatgcatatgtggctatatgaccgattctaatgtgtttaggccttgctaatatatcggtatgggacaatctccttcttaaaattgtcacactgtattgtttgcttcagtccaggatagcaggactttttgacctgaaaggaaaaggtaaggcaagggcagaggttggacccttgtcccttaggacaaagcaggcagatttacatcactgccttccaggaaatgacagcttacccccaaaagtaaagaaaaagtgtactttaaaaaatactagccaggtgtggcggctcacacctgtaatcccagcactttgggaggccgaggcaggcagattgcttgagctcaggtgttcaagaccagcctgagtaatatagtgaggcctcgtctctacaaaaaaaaaattttttttaaattagtgtgatggtgcaggcctatagtcacagctactcaggaggctgaggtggaagggtcacttgagtccagggggtcaaggctgcggtgagccatgattgtgccactgcctttcagcctgggtgacagaacaagaccccgtctcaaaaatatatatatgttttatacttctcactatagaaaagccatttaaagcattctgtgtagggggaataaagtgagacacaacctgagtattataatgagcactgaatttgtagtaaaaagagtaagtcagattcttgatttgcctcctgcaggctttgcactttgaaaaaattatttacattctctgggctttggatctcttgtttttaaaattcagagtttgaaccagatacccgcccacctcatacagcttgaaaactctacaagactcaagtttaaaacttctgcattccaataaaagttagaaccctaatcctcttgctacaggctagcaagatttctcgtatgaaaataatgacactgcaaatcagtacctgaggtctaccaaaacctcatgttgtcaaaaccaaattgtcatctaactatttgaaacccgccacaaccctttctcgtaccattaatgtcaaagcacaccctctgagcagaggcagcagtcactgttttttgttgttgttgttgtttttttctgagctttctcacatactaacagaggctttgatgcaaaatatagagcagtttccgacctaagggactttggaccaacagatatcatgctagccctaattttttctgtgggttttcacacgactgtgtgtgagaaaagcaagagatttcagatctaaacaagacccactatacgaactaatgaaaatattgggtgtgtggtctacaaaacagcctaaataagtacttctctctgaaagatccctttctccataggcctattcagattaatatctagttttcttcacattaaagtgtatatgacagttgtcatgataacttagtgaaaagtttagccaatagaatctatgtagcacttttaggcttctcctgctgtctgaattttttcttaattttctttctctcaaattcagcccacctaaagtttttgacagtctgtttaccaatcaggaaaagatttaattcttatttgtcttaaggcagacatccaggatggacagtgattatgggttcatggaatgttacaactggaagagtttataggattcatctggtccctcattttcctacttgtcaaatgaaaacaatcaccagggaatgtgttgaaaatatagatttttagtctccactccaacctgttgggtcagaatctcaacagacacaagagaatctgtacttttaacaatcataccatcaagcaaatttgagaaacgctgatataatcctatgattttattttgtaaagaggtttattttgattatacatggtcatatatgaaaaaaagaaaggatttcatagcctttcgtgaaagagttgactgcttcatatcagttataaaacataaattgaaaattattcctgaggttgaaacactcaacttgggcctctcaatttctgaaactcttgactttgatgatcgtaaaatgacaatgattattttatgttaattacagaagtcaccttccattctctcccaacctcaataacacctatagatgatatcaaatcgaggcatgtagagccacacactattttaaaaatgtagcattccttcatactcataaacattctcttaaccttaacatatgaaataatctccaaattctcacaaaaatgagtgcccacctgaactaaagtttttttacacctttaaaaatgtaattgtacagacgaaatcggtgtcataaggttactttcactaaaatagtatatccctctaaaaacaactttcacccatttgcaatcactggaaagtcatagaaggtgactagagtaactgatttctctcaagagcaaattcatgctctccaaaggagatcagggtctgtttagaaaactgaggtctaataatcaaggttgccacctggtagatctcatgttccacacatttggatgacttggctgatttcaggaatatgggaaaaatcagtttaacccaggctctctgaaccaatgtctcagatcaaactgatgacccccggacagcaaaaatgtgaccaaggtggaaggatcacttgagtccgggaggtcaaggctgcagtgagccatgattgtgtcgctgcctttcagcctgggtaacagaacaagaccccgtctcaaaatatatacatatgttgtatacttctcagtgtagaaaagccatttaaagcattctgtgtagggagaataaagtgagacacaacctgagtattataatgaacactgaatttgtactaaaaagaatcaggcttagccttcacttcacaacccaggttcacatgggtccttcctgtgcatcccaaggtcaggtttaaccacatcaacctcaaagccttccaaacagaaagcatttggaaacaacaccatctccccagatcattctacagtatgaagccgtgaaactgatggctctcggttcccctattcctggaacacaagtcttcagtttcagatttgggggaagagaaatcatcatagtatgacaattgggagaaaattacgtttttgttttcatatgtctccaaataaaatcccaatcatattttgtacaaaatttccatttttcattattaaaatttcattattttcaggcagccattgaaaaagattgtgccctaccagaatctggatatccttttgggcaacacacttttaacctctcttaggagatgttaatttgagtgagttttcaccattctatctactgcattcgtaaatttccctttttgattattctagtcatgtaacagtgagctcagcaaaacaaacacacgcacaactccaaagttctatgcttaatgtcagtgataaatttcaccaagtagctagaaaagcagctataataaagaatattctaattagtcttagaggcattatgtggcagaaaatatggaattttttttcttatgccgagtttgctaattgcccccaacaataggtgtgaatctcttttgttatacttgcagaaaatatataggtttgacttccatctgggacactctagagaaatgaaggagttgcataaaacttttaatgctgtgaacagctagacacaagttacatagctgctgaaatgaaactatacaacaatttctctatataaacacattctgaaaacacgttgggtaaatggagatattgttgccaccctagaattgatggtttccataaatatcagcatagcatccatactatcttttaattacaattttaaacctgcgaatataataccttgactcgatggtagtctcagagaatgtatgactatattttattccaccacatataaatttgtagaatagggtcttagtgcttagctctgtgagaactatctaactgtctgatgataaaagttgaggagttgtttctgtgaccaaatatgaacataagaccaattatctgcaaatactcctgtaaggtatatttccagtactgttttatgtttggcaggattgtggtggagaagaacagggagatgttctaagtgtttaaaattatttttacatcctagaatcaatgtcttcttaatatcatactctctggttggaaatcttcagaggacagacactcagtgaataacctttaactaatttccaacccatttgagtatgccaggaaaatagcatcttccaagttctagtctagttgttgtatctgtctgtgttgctttccggctgctatagcccagttaaattaccaagtgctgctgatcctttggagcttttcttaatcctcttttgacctctctaatttgaattattctgtgtcatcaacaaagatgtaacagttaggtctctgtgaaatcacaaactagaattgcaattagagtttcttaatcgttgtgcatattgtattgttgcatggggaaagaaagttttggaatttaattaaaagaaaggggaattgtcaatgtacttaatatgccattatattttttcttttaaaatatggagttaaagaaaagtttgattgtctttaatagttgcagttatctaccaatggggactactgaatacatatgctggggaaattcaatgtcaaggaataatgtatgcttgaggaaagtgtcattaaaaaagaatcagaggattagggattctctaagtttttaaaaatatatatattcttagttcttccggttctgggcccattcctttgtttgtagagttacaaaaaacatgattgtttggtagtaattttctttatccagctctttttttttttttttttggcaggtggtaaagtttattcttgtaatttcttgagaagcgtacagcatattttcatttagatgaagttcaaaaacaaaaataaactattaagtgagttagggctacaaaatgtggtcaactataaagaatatcaagggaaccataaacctgaaatctgggagagcagtttcatctgagtcaggaggaaataagtggatggaatcaggcggaagcacgtagcgtaaaagaaaaattgcaccagacactcattaaaaatggcagagagactttctttgaaacgattgtaatatggattaagactattgcagtaggggagagattgaactagactccattggcacaaaagactggaaagttttcaagcatgaagtgagccagagaacaggtactggaagatggtgggacgatgtgattaggccatctgcatttcctaattggcacttccagaatttaggctccttacccttccacagagactgagagactggggccctcccttcttgataacaacatttcaaagggatagctcccgggtccttaagaaaaacactcctgggctgtaaaaggtttacctctcaaagggcagagtaagaatttacaattgcaagttttctaatgtaagtgctctaagaaaagagaagtcaaaggcctagagtcaggaagaaagctgtctgaagtttagtcaagctgaaaggaacttaaagcctccttggtcaacagtaagcttcagtgataatgctgaagtcttgttttctaaaattaggtgggaagtccgctggtcattgtatcatgacaccttacaccttacacatactttaaacattttctttagtatttggtagaaacagaaatactacttaagtgctacttaatagaaagtaaatcaatagtattcaacagaagcagaaatgtatttaatagcactaaatagaagtattaatagcatccagtagatacagaaatgttcggcccagggtcagtggtgttgcccaggggaatagccttcctgggtaacatacgctgagattgctgagtggacaaggtatttccatgtgccgaatttacacagtgcacctctttcctttttcctggctgcactcggtctctctgaagtgaatggcagtatttttaccctcgatttactgaggaggagactcagtcagagaggacattaattgtttcttcctaatatcacaataaattctcattccctaaggctatgtcactccctagaactaagttatctacttagggaagatcattcgtcactgccaggtctccagggtaacatcaaggctttattgttgcaagtcgacaaatcgcctcccatctgtctgccctgactctgtgactgcagccgcgcggtgccctagatgtttccccagtggtctgaaagaattaatgtgcctccctaaacatctaacttaatgctagggaggggcttaggcaatgggggaaatccgcctggaagagatgttctggatgtcagtaggttgtgctaatctggctgtggtcatggctctattggggagacattgacagtccatctatgtctcactgaaagatctttgtgatatctacaggggcactggggaactaacatttcaagaaaataatagcgccagcaggtacagatggtgtctcagacaaagtttctgggctctccctgaagcttgacatcacatcagtgtgtgtgcaactctgcatgtggttggtgagtacaagggcaagagacagagagggtaggagtcagaccgaaggagctaccgtgctggagcccagtgaaaggtgccaggagaactcatggcctctctgctcagatctcaaaatcagaggaaatgacaaagaaccagaagaacaaaggagaagtgacatatgggaggagacacccaagggaaacgttcaaggtcccaacatgacaccttatttgcagaacatcccccaaaacaaagaaatcctctgcacttgttcagaggatttctgatcaacagcagccaacccacagaagcagcagcccttgggcgctaagcagaagagagaaccaatgaggagccattcacctcacctgctgacgcgaaggctgcttgccagttttaggggttttctatgttgatgagcactttggattgttctgagaaattccccctcaacacaaaacacactctttaatgaagagatcccatattcctggctcaaaaatttgacccttgaatcatttatatcatatcattttgttgtagtccatgaattcatgaaaggcacagagtgacccagggctggatatcagccaggttccacgcagacagagtgactgggatgactggatcccaacactcggtgactctcccattcaccaagctccctagtggtctagaataatacccagccacacacctagcgagggctcatagatcttaaaaagttaaagaactactgccactgagcagatttttcatgtctgtatctgcttgcctgccagatttccttcctcttccatctcattgctgaatttaaaaatacttctaagtctatatacattataattgggtaaaataagaaattcttcgtaatttagaagatgtatctctttcctgaagacttcctcctactccacccccaatctccagagacacatttttacccttaagatccttttttttcctttatttcttctaaaaaaaaaaaatgggatacatgttcagaacgtgcaggtttgttacataggttacatgtgccatggtggtttgctgcacctattgacccatcctctaagttcccttcctctacccgccactccacaaaggcccttgtgtgtgttattcgcctcactgtgtccctgtgttctcaatattcaactcttacttatgagtgagaacatgcttaatcctgagattctgagcaagacaacctcctttagagatgtctattgcttggaatgttttaatctgttagatttttgactgcacatattagctttaagaaattagaattgagcattaacatgttcagtttgttttcactattaatttctccataaattatgttagattgcattttttatagtatgtgcaagtgtatgtgcatatacgtatacacacagagagaggctttgagctaaggatggtggattgcccacatctgtttaaatctccctaccaggaaactagcagcaagcatattacttcttcttaccccctcctatattcctgccaaggagggaatttaaaaactctttcaaggagaaacaggtagccagtgatcatcaaacattagagaaagcattcaccgtgacagaggcaggaaaaagaaaattctaaaagaaaaactctagaataaacaaagacatagtaggaatcataaaaaaactgttaagtgagcaatgctgacatgcctgctcctggtaccattattagcagaaaagtagatacaaaatgctttgatataaatgagacatctatatctatcaggttaacatagagataaagtgaacagatgaatttcaagtgatagaatttcctgtgtgtagcacccacattagaggttataagaggataaaatttaaagtaaatttggaatcacccagtcttacgtcctcattatcagggctatggtttaattgttccccccaaagtgcatgtgttggaaggttgacccccaatgcagggatattgggaggttaagcctaatgggaggtgtttgggtcataagggcaccactctcatgaagggattgatgctgttatcttggaagtggattcatggtcttgggagtgtatttcttataaaagcatgagtttgaccccctcttgccttctgccatgttatgacacagcaagaaggtccttacgagatgccagcaccttgatcttgaacttctgtgctttataaattacccagtctcaggtattctgttacagcagcacaaaacagacgaagacagaaaatgggtaccagagagagcagtgttgctatagtaaatacctgaaaatgtagaagtagctttggaactgtataatgggtagaagcctggaaaatttggaggagtaggctgggaaaagcatgcattgctatgaacagaacatttagggtaattctgttgagggctcagaagagaagaaatataggggaagtagagattactaagttgttgtgatcagaatgttggtagaaatatggacaataaagggcattctgatgaagtctcagacagaaatgaggaatagcttattagaaactggagtaaaggccattcttgttataaattggcaaagaacttggctgaattgttcatgccctagggctttatggaaggcagaatttaagagtaatggactcggatatctggtggaagaaatttctaagcaaaatattgaaggagttgcatggttacttttaactgcatatagtaagattagagagaagagaaatgatttaaagacagaacttataattaaaaaagaagtagagcagaaagatttgggaaatctgtggcctggccatgtaatgaacagccatgtaaaggtgctgccaagcaaccctttaataaagggattagtacagctagaaagaagccaggtgctatttatcaagacagtgggagaattacccgaaggtgttttggagatctctgaggctctccctccatcacaagcccagagctctaggagggcagaatggtttcagaggagagtctcagagtgccctccttggtttctctgcccagggcggcctagggactctactccctgcattccagtgtagcagtcctcgaccactccagctgtggctcaagtgggcccaggtgcagctggtgctggtgctccagaaagtataagggtaatctttggtggtacctatatggtgcttattttgtaggcacacaaagtacattagctgtggggccatggtagcctctacctagatttcaaaggatgtgttggacagcctcagggcccaggcagagacatggtacagacagaagtcatagcagatttcccactatggcgatgcctggtggagccgtgggggtagggcaaaccccacaaccctgaccccagacctatagagctactagcatgtagccccagcctgggagagatgcaggtatgaaactccaacccatgagagctcctatgtgggctgaacccagcaaagctatacgggtgaggctgcctgagactttgagggcccaacctcaactccagtgtgttcagcacaagaagtcaaactttattctggagtcttaagatttagtgttcaccctgttggctttttggacttacctgagaccagctacccctttttccctgcttattcgtccttttcaaaatgggcatgtctatactatgcctgttttagttctaggattatattttggaagcacataacttgtttaacttcacaggctcatagctagagggaaatttgcctcaagtgaatcatgctgttagtctcaaccatttctaatttagataacattctggactttggactttgagttggggctgggatgagtgaagagtttagagtctattgagatagattgaatatattttgcatgtgagaaagacatgaatttggtggaccagggatgaaatgctataatttgaaactgttccccaaagttcatgtgttagaaacttgatccctaattcagcagtgttgggaggtggggcccagtgggaggtgtttggatcatggtggcactgccctcatgaaaatattagtgccattatcttagaagtgggctcatggtttctggggcgaattgcttataaaaggatgaatttggcctctcttgctctctcttgtgatgctttccatgtgatgcttttccaccatgttatgacacagcaagaaggccctcacaagacacggatgccttgatcttggatgtcccaggctccaaagggacgttttcattccaatggaatgaaaaacaattccattctttatacgttactgagtctcaggtattctgttataacagcacaaagtggactaagacgagcagttatgttatttacccataatcatataatatattagctgcagaatcaagtctagaattctgattcctaatttctagtcccatgtgatttctattacctaactccataaaatggatggaaatgtctgattctataaggaatctcaaagttccacagagtcaacatatagaacacataaagccaactttatgtgtttttttaaatgtaaatgtgactgatatctaatagctaaaaattcttatcaaatagctaattgttacataattagcacaagtggtaataattctaattactttctttcagattttagaagagctatgttgagaagatttgctaggcctctttaaaattttatcctaggaagttttaaatgggggctttacttttctcttgttaaattttccttaagctcagaatccagtattgcccactgatcaatattttcaaagatagatggcatagcactcaaacatttgaagacattactaaggccttgtcttgtgagttttcagaaagcagaagtcacttatatcttgctcccctcccccatcatctcaaactatgtcgaaatccttccaaaatggcaatcttcatgtaaagaattatttaaaaggagcagccattggcttctgacttaatataatggaaggaaattataaggcagatagtatgtgtatcagactgtctctgggccatgtccaatccgcagctgtgtgcccacttgttgcttctcttggtttgtaataaattttaatgggttacatctaggtcaataataaaaaataagcacaatgatcattcaattcactgaactctaagtctagctactagtgttccaactcgtataaaatctgtgttgaactataaatacagtagtccccccttgtccgtggttttgctttctgcaatttcagttacctgtggccaaccatggcttgaaaatatacagtattttgaaagagagagagaagaaccacataacataacttttattacaatatattgttattatttttctattttattattctcataatctcttactgtgcctcatttataaattaaagcttatcatagacatgtatgaataggaaaaaaacatagtatacacagatgattcttgatttacaatgttttgacttaaaaattttctcagctttacaatggtgggacagcgatccatgttctttgacttacagtagatttattgggatatgaccccattgtaagtggaggagtatcttttaggatttggtactacctgtggtttcaggcatctactgggagtcttggaacatatttcccatggataagggggaaactactgtacaattgtaggacttcagtatgtaattaggaaaagaaaaattaatttgttttcataaacaaatagatcattatagtttacatctgtaaacaatcatggtattcttctgtcaaaacctttccatatcttcttattagttacaaaatacaatctaaactatagagcatggtcttcaaggcaattcagtctgatgcctcaacctgtccatcaaccccatcaactgtattgtttcacttcaaccccagatgctaatcactccatatcatccagactgccttgaacgctgtatgcatttcatgaatctgtacctttcccaagctgcttccgcagttaaaattctctgatcctttgagactcagttcaagtatctatgatcctaggaaatctcttcaacaccccctctttgtcccctctcgtctcagcagaatccattgtttcttcttcattaaagttcccatagcatctaattctatttttatgaaagcatttctcagtcacaccttttttgccatttctgtttctgtttccctccccaaatggtgaatcactagaggaagtcaaggatcatcttatagtatccttgtgtctcaagagtttagtctacccctccacatgtttggtacccattaaatgtttctttaattggatttatgtaagagcttaagagtatttcccatgatttcatttgatgcccatagaaactccattaagcaggatggtaactgactccattaaagcaagtaatccaactgttttaggcttctccaaagagagagagagaagcaataggatggatggatagatggatggatggatggatggatggatggatggatggatggatggatagatagataaggaatttattaggggaattggctcatacaattatgaaagctaagtcccacaacaggccctctttttgttaaatcctttttgtattagttaagggcctccagagagacagaaccaatagaagatatacatctgtatctgtacatatgagaagagatttattaggagaattggctcatgcaattgggaggttgagaaatcctacgctaggctctctgcaagctggagaaccagggaagctggtagcatggctcagtctaatctgaaggcctcagaaccgggaaaattattggtgtaactcttagtctgaggctgaaggcctgagaacccaggtggccattatgcaagttcaagtccaaaggccagacagcctggagttctgatggccaaggacaggagaaggagagtgtcagcgctctgggagagacaaaaaaagaatttgtcttctgccttttgttatctctgggacctcagcaaattggatcatgcctgcccacatgagggaggatcttcctcactcagtccaccaattcacaccccaatctcctctggaaagacccttgcagacacacccagaaataatttttaccaactctccaggtatttcttaatccagtcaagctgactccttaatttaaccatcacagcaactgggcaccaaaaacagattagtgatttacctccaggtcatgtggtcagtcaatggcaggaccagtaccaacccctaggttttccaatcctccatcgcatactttgcaccatcgttgctcagcacctactgagaagtggggacatggtaaagagctaaggatgcttgcaacccaatattcatgtcacttcttgaggtttcagcagctttttcatgcatgcattggctccatggtcacatacaagaaccctctgctttctcatctaagagtttcagagatgccaaagtaacaggattgaggctgaacaatcaccttcatttctaatgtttttcctcacaaaccaattcagaaattcagaaaacatcttactatagtagttgtttcctgaattactaaatggaagctttattaggaagtattctctgttctttctaccaaggcagctttgttccttgggcataaacaaaactatcccttctctctctaaattgaccacagagccaaccttatataaattagaacttgttagttttggcttcagatgccggctctttctcttgaggttttcacctacttaaaattcacttgttgccctttaaattcacatctagcttaaggcaaatgtttgaatttctaaaataaaaccatgtgcccaaaataagcttagggaaaaaataactgaaataaatggaaaattctccaaaataagcaaaagcattaaaatgataatgctttaactttctgaactaaactgaaaataatgtatgctcaagataagcttacaaccacggagagatctctcttctacaaagccttaaagaaaaagcaggaaattacctcagatgaaacttcattacatggcatttccattcccaggatccatcctcagacacgttgacttaattgctctggaaaagagccccagcatcaatatttttcaactttctaggtggttctaatgtcggtcacaatcaagaaatgacatgaacaatattctgaatcatttcagtagatgttgactgcatgactgtgctttctaccagtcctatcccacaccccgcctttttcctaaaataggtatgcatgcagtgtgtgctctgcacacatgcacatacacaaacacacacacagtttcattcatttgtatattcattcaatcaataagttgaattttgccttcgtgcaaggaaccatgactatcagcacaaacaagaaactattcctgaccccaagagattcccagtctaggtgtggagaatatgaagcacagaaatgggaacaactctaggtaggaaatggaaagagagcaaatttttttttttaagaggcagctgggcacagtggctcacacctgtaatcccagcactttgggatgctgaggcaggaggatcattggaggcaaaatcaagtgtacctaacagttttagaaaattgtacatcgtatacttccactttccatcgtgacttctgttcatagtttatagatgtacaacataaagacataattcctaaataaacaaagcttctgtgaaagcataatgtgactctgcaggcctgctggcctgtcttattattgatctgaaaacaagattgacactactgtgattattctttagtgggaagggacattcatacttatttagccattgctatgctttcaggcaaatcaacccctcagtaactccaggcaaatgaatataggcctttcataaaaagtgtcttggagagaaagcccacaactgcaattaacaggaaatagctgatgcagtgtgacagcaagtccccaaacccttaatggaaggattgactgtcatgtgcatggagatgtggttagagaggaaataagttactgggttttgtaaggcaccaacttgaaaaacatgaaaagctgtggcaggccacaaacatggagcccatttggagtagaggcaggcaagtagaacggagaaccgtggcatttcaaccctagattaatctgagtgtcgcttttgctgccactacttaacaagagtagctgtagagagtgaaacatttttcctaaaatgtcatattttctctggtagctcctgttttcttctttgtatcacattatagctccacaaagttcatgcaaatgcataactaaattttgattatgagaggtctcagaatgcaacttgtttatgggaagaatatcattagtatagtttcaggcaattccttgcaaactatccccagtttaaaacagtcacaccttagtcaacaagcatctattgagcaacccactttcgacctggcattatggtaggtgcaaaggctaaaaaaaggtagaatgagatagaacctccacggaatatatacaataacaaattatttttttaaaaaactggatataacttgagaaactcttctgtacaggcattctggagtgagctgcaatccatcattattcagaaatgcattcatgcattacacctttgtcaagccaagttccaggttctgtgcttggtgctgggaagattgaaaggtcagctgaagttacagaaggccacgatgccagcacagctgctgcctactctttcgcctgatttatttctgttatttcttttacaattgtgattaaaaaaacacataacaccaaattgacgatcttaaccatttttaagcacaagcagagtcacgttcagtgactccacttcagtcaagttcagtagcattaagtagagtcacgtttacgtgcatctggtctccacaactctttcatcttgcaaacccaaactctataccatgaagtatccaaagtactcatatgtatcaaaacagagagtaggtggttgccaggttgccagggcatggtggagggggaagggaggagttgttgcctgatttctttttaaagctcagtcttccctttggcttctggttctaagcgtgttagcatcacggccccttttcattatcctaaaggacagacccagccctggttctgcaggtgctgaattctacttgactccaaagaggctcagcctctacctgcacccaggttctgctaacttggtctaccctctgttgtttttcctctctgttttgttcccatttgtaagatctctgccaaacttacttatttgctgcttttcacagacactagaccataccacctcctgggtattcacgatccatgcctggcccagctgactgttctcttattccaggctgttcgctgtttacctcgtccctcttcagcatcctcaatatgcctgcataatgcatatccatttttctccccaaattaaaagctatggccactgtatgttgaaaaatgcttaaaaccccacctaaacattccaggaagcaggaagccatgaatgactttaaaccaagaacagtctcaaaaatgttgtggtttccagtatgtgagtctcggacttcagcatattgctgttcatatgccacacaaatgttctgtaaagtcccattgagaattatgtgcaaatttaaatgctctccagacaatttcaaatatcagctttgatgcaagacttcacctgctaaaagcatctctttatggtttgacactacatctctgacattttgacgtgatacatattccatcagcctgatacattgccacctcccagtgagtcacagtgtcactaactcagaattaaatatgttgctaaaccactttacagcccttgcaaagcacataaaggctgtttgacaattacccccaggaaggcaaataatcagtacacctctgattctcttattattaaccattataaaatcatgtgctgtgatcaaggtgtgtaacaaagacattgatttttataagactacccaggaagcaaatacatattcttgatatacgaaacacacaggaggcctcttcattttcctttgtgtctttaatttgctcagagctgctcctcatacagcactggctttcacctgtcaagctaaggctttaattactgagttatggaaaaatcattgccaattgccttaactacaataataaagaatatcttacaaaggataagaaatcttttttcttcggctctgtagttaaaagactagttctagttttaatctgaacttttctatttctctccctatatttccctttcttcctattttaattgctggttagataattaagtaggtacctgacctgcaccaaatgtgcttgggaaagtctctcgtattttcgttttgctttgttttgtttctgcatgccattgaaacccctgtgttaattattctttccttacttgaagtatcttatacaacctttcttcaccagtatccttttcactaggccaaatacttattttggagtctcaaggatgattttctaaatcttttcataaccgcttttagcccttactcagttttattgtgcctgcccctcattgcacaaagggatatatttgactattccatggcatatttgactttgtaattcgtaaattatttttcatgtcttacatggttaaagatacgtttcacttgagcttgtaacagacataaaaatgacccatggtaaacctgtcgtattagaaaatcaaacaaaaagcataaggagataacacggtaaaaatgaaaagagtacaagctttagacccgtgtggatccgagttcatatctaacttggccaactaatagcttgttaattatgttaccttaggttgtattttttttttttttttttctaatttagtctcggggtctccgtgttctagctccgacccaagggggttcccgggacgtggttgtggatgttcagtgtgcctttaactggatacttctttatcctggcagacggcctgatgcccaggtgtgacttgtggccaggtgtcccacaaacaggaaaacctgtttacactggcagatggccttgtggcgtgctatagtctgaatgtctctatcctcctaaaatccgtaaattgaaacctcattcctaacgtgatggtgttaataagtggggcctttgggagatgattaggtaatgagggcagagccttcatgaacaggattagtgcccagacaaaagaggcccaaggaagcttgtccacctttgtgccatgtgaggacactgctggaaggcaccatctatgaagcagagagtcggccctcatcagacaccaaatctactgctacctctgtctcgggcttcccagcctccagaactgtaagcaatctgctgttgttgttgtttacaaattacccagtctaagatattttttatggcagcccaaacagactgagacatggcttttgtctgctctgtgtctagtgtatgttttgttttggttcggttttaagtttgtttggtttttggtttttggtttcgctttgtttttgtagacaacatcttactatgttgcccagactggtcttaaactcctagactcaagcaatccttcgcctcagcctctcaaagtgctgagatgacaggcgggagccaccacgcccagccaccctgtgtctagcttattcctaccaagagaatcactctctgtgaaagctctgagcagaaggagagttaggttcgcgtgtgttgctcaggtgagacaaagaggagatcatacagcaaaacacatgaaataacagaagcagcgtttgactcacagatccagagcagagagggcagcctgcctctcagggccaacaggaaaggggagctgtcctggacacgcaggctccaccagtgtggggagcaaaagagatcacaagagacctcagggcctaagactttgttggggtctcaggagttacccaagcaggtttcctgctgagagttctaatgggggtgggtggtggggggcgttacagcaacaattaccagtttcatggagccacactgtgcctgagcggtagtaactgtggcatctccatgcagtccatgcagcgggaggggtcttgggcgtgagtcaggtaggttgtattgagctgtcccctggggaggtgggcactagcagatacctggattgaccgccttgaggagctaggaggaagcagagaactagaaatcatgtcaagattcactaagccctgcatctgctatgagaaagtccaacttacaatcaaaatggatgcccaggcaacataaaattgtaagatttcgctacgccttaggcaatgaaacttggctgccttccagtgaatatttactgagcgtctagcttatttgagaaaccataatagacactacagggactgcgaagaatgggaaataaaccaattacacaatcacccacatagcagcgatacaaggccagccatatcaaacaacccaacagataaacagttcatatgttatatggtgtcagaagtaagacacatcaaaaaatggtaaaatacgtttgatactactgtccttataaaatcaccaaccataggaaaaatgatttttattaatgacagggatataatgaaaatagtttatgtgtgaaaacacataagtaattacataatacattatgatcaaaattagatacagcattgctgggcaagacctttttctcctctaatgctgtccttcaatattattaccaaaatatagcaccagtttttgtttttgtttgaggcagggtctcactctgttgcccaggctggaatgcagtaatatgatcatggctcactgcagcctcaacctcctgggctcaagtagtcctcccatttcagccttccaaagtgctgggattacactcgtgagccattgtgcccagccagtacctggttcttaattaactatatgaaaggcaaaatctgttttgctgctgagcaattatagtactatgcattatgtgtgtgtgtgtatgagtgtgtgtataacatgtagtttatatccatatataaactacatatagtttatatttaattgagtgtagacaatttataggttataatatctttagttataacattcacatgggtgtaattttttatactattctaatttatcattcctttctgttttaccttcaactctggttgaagtaatgtagttactatctgttttccgagttagacttccacttttcctctctggctacctgacaccccaagctagtgtaggtggctatatcattgcctggaattgaagtttttaagcctctgataattcagtctgtagaagctacccagctcaagaacaaaggggaaattacatatttcataacatgcttcaacatgaatgcatttaattagtatttataaatttgaatcaaaatgcaggaaatattctaaaaatataatttctctagaagagttatataatctctattaatgtaggccaactgcttctgtttcaaacacagaagaatgttcttcaatttttcatttgtgaaactgaatagtctcttctgaaagagtatatagtatttttccttttgggaatacaaaagcttttacaaaatgattatactaatcatcagatataagagtagtaccaattctctacctagaatagctgttaaccatggcacttggtgaattgggaatagacttaaatgatgcttctccttgggcccccacctccccaactcctacctttctcgaaaccaggctatttctctccaaatctcctttccttttgattcttcagttcgtgctacatgataactacttgccattggtcattaattatggtcgacgctcattattcacaggagtatgacccataaaatcactgcaaacactgaataagttaatactgaaccattgcccctagagggaattcagggttaagttcctgcaagcctctggtcacagtatattcatcaacctatcaatacataacgttattttatgcatgtttctgctttaagacatcttacttaacatatgtttttgattcattaacactgaactcatggccaacagctctataactaatgtctgaaaaaagcttatctaataggcatgttttccccataaggcacatcacagccttcttgtgcttaggaacactggacgacactcaacactgcgcttgggggccatttgaaacagtaatatcaccaataaaaaaaaagcacaaaaatgtcagggggaaatgtggcagtaaataggctgtgaaaaagacatttgtttgcagtatgagctaaaagaaggcagggcatcaccttgttctacatcagtagggatcatgagtgttatgccactcaatttttttgccagcctgtgtgtacacgtgtcctcaaatgaccatgaaagcactgcaagtatagatttggggattacaaataaatttcaacaagtagatgagtttgcaaacatggaatccgcaaataattactgttgactacaccatccttttgaacaaaaataaaagccacaattcaacttgagattggttatagatggcaactggcatttagtgagcacctgctatgagctgggtgccttacttttttttttgttttgagacagagtctcgctttgtcgcccagtctggagtgcagtggcaccatctcagctcactgcaagctccacctcccaggttcacgccattctcctgcctcagcctccccagtagctgggactacaggtgcctgccaccatgcccagctaatttttttttttttttagtagagacggggtttcaccctgtgagccaggatggtctcaatctcctgacctcgtgatccgcccgcctcggcctcccaaagtgctgggattacaggcgtgagccaccacacccagccactgggtgccttacttttagtaacacattgacctgggatgtgatcaactcgagaaccacatcactgtcatgtagctgcatggagctgtatcactcaacttctgggggcttatgtttcataacaattatcttttataaatgttcaatttaaaaatgaaaaacttccccaccccaatcaccacctcctttccccctctcccttccctttaatgaaccatctaagggaaggacatgtgtgcttctttgacatttcttcacagaatccagtccaatggcagggaggctgggtgagggtcagtgtcagcctagccagtagggaatccatggagctggggcatgtcaggggagtgtctcttactgagaactctgggtcctcttggatcaaagaatgtgcaaattgagctaagagatagaggggaattcgagaagatcacctaaaatgggcaaacaggaggaagctagatccaggtagcctgggagtcaagaacagtgagccctgtgtgagctaaaaaaccagaagcaaaccttggccaatggctggagctggtgtttttgctcaagcctggctttcatgggctccccttgatgtgagtctcagagtagggctggttaagtggccaggacctgagaaataaaatctcccttatatactcttgagagaacaagtctaacatatcagtaaggtaatagctataaaaatgtggctaggccgggcgtggtggctcgtgcctgtaatcccagcactttgggaggccgaggctggtggatcacctgaggtctggagtttgagaccagactggccaacatggtgaaaccccatctctactaaaaatacaaaaaaaattagccaggtgtagtggtaggtgcctgtaatcccagctactcgggatcctgaggcagaagaatcacttgaacccaagaggcagaggttgcagagagctaagatcatgccattgcactgcagcctgggcgacaagagcaaaactccgtctcaaaaaatagaaaaaataagtggctaagtcagtagtgaaactacgaagctaacttattacatttttcaccttttgaactttcaaacttgagtcatttatggacatctttgaagggaacagttattataaactctcactgttgacctaattaacattataatgtcaattatatatgtatagaaagaattctagatatacactcctgctaatatatttctaagattttttaatgttttatgatatacaaatttggatataagaaaaattataaaaccaacaaaattaaaactagtaaagtgaatgtaacgagataggctgtatagttcacaccacacaatgtcgtttagtcgacagtggaccgcacagataacagcagttccataagattatagaggagctgaacatttcctatgcctagtaacatcacagctgttgttaaggtcctatcacaacacattactcctatgtttgtgatgacactggtgtaaacaaacctactgcactgccaggcatatagaagtgtagcttatacaattatgtacagtaatacttgataatgataatatttgactatgttactggtttatgtatttgctatattatattatacattttatcattcaagtgtattccttctacttattttaaaaaatttgctgtgaaacaggcagggtacagtggctcatgcctgtaatcccagcactttgggaggccgaggcaggtggatcacctgaggtcaggaggttgagaccagcctggttaacatgcagaagcctcatctccatgaaaaatacaaaaattagccaggcatagtggttcaccctatgatcccagctactcggaaggctgaggcagaagaatcacttgagcccgggaggcagtttgcagtaagccaagatcgcgccactgcactccagcctgggtgacagaacaagactctatctcaaacaaaccgaaacattaagtgtgaaacaacctcagcaggtccttcaggagggattccagaagaaggcattgttaccataggagctggcagctctgtgtgtgtcactgcccctgaagacctcgcagtaggacaaggtgtggaggtggaagacagtgatattgatattcctgaccctgttaggcctaggctaatgtgtgtgtttgtgtcttagtttttacaacaaatatttaaagtacaaaaatgaaaaaattcaaagtagaagaaaaggctgatagaataggatataaagaaaaaatatttttgtatggctgtacaatgtgcttgtgttttaagctgtgttatcacaaaagagtaaaaaagttaaaagaaattaaaagtttagaaagtaaaaaaagttacagtaaactaatgtgtattaaagaaaagtatttttttacaaatttagtgaagcctaagtatacagtattttttaagtcaacattagtgtacagtaatgttctaggccttcacgttcactctccactcactcactgactcacccacagcaacttccagtcctgcaagctccattcatgataagtgccctatacaggtgtgccattctttttatcttttactctgtatttttactgtactttttctatgtttagatatatttagatacacaaataccattgtgttacaactgtctacagtatttagtacaataacatgctgtacagatttgtagcctgggagcaacgggccatagcatatagcctaggtatgtagtaggctatacagtggcagtttgtgaagtgcattctgtgatgtttgcatgacaacaaaattgcctagagacacactcctcagaatacatctccatcgttcaggctcagcaatgcatgactgtattagtaaactaaatttccactttcaatgagaattttttcagtgtagcttgttttgagttcattttgcctatacactataagtttgtgataattcaattttgctactacttttttctaatcaaactactatcaaatctccacccacagagcatacttttatgtaatttgctttcacttgggccaaatatcatttttgtattaagttggcctatgttcttttctcaataggtaaccaaaattaaagcagtagcatttggcagcaattacaaacagaaatgagagcatttatgtcctggcgggagttggttgttaagtggccatccggaagttatgcaatatgttttctttctcttttcttttctgtttttttttttaagattgctattgaaatgaaaacagaaactgcaccaactgatgttaaagataaatacaaagccatcgtaattaaaagagtatgtcacaaatgcaagaataggcagaaggatcactggaactgattagaatgtcagaatactgtttacataagaagtagtgcatactgaaactggcaatttaaatgaacggggatcctgcagtgtaaaactctgaaataaacaaacaaataaataaacagggatgaagacaaattttgctaagaaaattatgtgactatactttaaaaaatagtttctattttacgttagatgctaaaatgaattccaaagaattacagacttcaatgtgcaaagaggaagaatgcatagaaaagtgatactaaaagcaattcagtatttttctgttctctaaattttaaaaagcccttgtggctgggcacagtggctcacgcctgtaatcccagcagtttgggaggccgaggcgggtggatcacgaggtcaggagatggagaccatcctggctaacacggtgaaaccctgtctctactaaaaatacaaaaaattagccgggcgtggtggcaggtgcctgtagtcccagctgctcgggaggctgaggcaggagaatggggtgaacccaggaggcggagcttgcagtgagctgagatcgcaccactgcactccagcctgggcgacagacagagccagactccgtctccaaaaaaaaaaaaaaaagcccttgtaagcataaatacaaaggaaacttggtagatatggcaacataacaattaaaagttcatgtaagtacaaaaatcaacaaattaaaaactgagaaactggaaaaatatttgcaatacattgatataaaaatcataatatgtttttaaaaacttttaaaaactagcaacaaaaagtaaaagatgaacaaccaggtgatggaaaaaaaaaaaaaagatccagaattgttcagtaaaggtgtaaaaagtgtttccaatcaaagaaatacaaactgaaacaagaatataatattttattttggttttggttttgtttaataagcagaaaatggtgaggcatttttgacaagcaattttgcaagacagatcaataatctttaaaacgtatgtagttcttgagcaaggattttcacctctaaaattatatttcaaagaaataattgtagaccacatgcaagattttttttacagattatttgtcataaagttatatataattgtgaaaaatgcaaatcaatgatatctgtcacccagaaaggaaggaaatggttaaatacatttaagtttagccgtataacagtattccttaaaaataagtctcctaggccaggcacagtggctcacgcctataacccagcactttgagaggccaaggtgagcggattacttgaggtcgggagtttgagaccaggctggccaatatggtgaaacctcatatctagtaaaaatacaaaaattagctgggcatagtggcgcacgcctgtagtcccagctactcgggaggctgagccaggagaatcgcttgaaaccaggaggcagaaatttcagtgagcctaaatcacgccactgcactctaggctgggtgacagagctagactccgtctcaaaaaaacaagaaacatcacctaaaaaaaagtctttgaagactattaacatggaagcatgataatggtataattttaataagaaattatgatagaacactgatagaatattatcccagttttacaattccacatgtatttacatgtacctgggaaaattataatgaaaatgttaacacatttttttcttgtcagtaagtgcaggggaaccttacattttctttatggttttctgattattccaaatattgtaaaatacacattattcatatacttttaaaatgtggatcttaactgttttcctttaatctgctatcttacctttttaaatctaggaaatgtatgtatctcaaaatggtaaaactgaatatttaatattctagaaattaatgttttataaatcttaattttcttctcagtaatattgtataattttaaatattggcagattgtcagctatggctgtgcctatttaaagccaaaactcctgccaattttgtgaaaacttacgctcattatctagatttttgtttgtagtacgataaatattttcaccgtactttacctgctttggcaaaagatagatggcagaagaaggagctgattaaataaccaataaatacaagagaaaatctgggacattttttgcttttattattactttttataccattatgctggtaaattatttataatattatgattatgctaggattatagaacgaaaggtaataagttttatggattgtcagtaataataattactgtaaattgtcttttaaaataatgaaggctaaaatacttaggtattgagagtgttttcttcttgctactctgtgatgtatcgttgcagcaggctgagataatggaaaaggctgagagctacaagccaaaaagactgggtgttgagtctctaattccacttcttttttttttttttttttcaagacagagtctagctctgtcgcccaggctggagtgcagtggtgtggtctcagctcactgcaaactctgcctcccgggttcacgccattctcctgcctcagcctccagagtagctgggactacaggtacccgccaccacacccggctaattttttgtatttttagtagagacagggtttcaccgtgttagccaggatgttcttgatctcctgacctcgtgatccacccgcctcggcctcccatagtgctgggattacaggcgtgagccactgcgcccggctaattccacttcttattagctctgggattgtggacaatttctctaggcagagcttcctcgtctgtaaaatatgaatgagtctaatatgtatgcatctagtaatctgatttaatcacaaaatgggactagactatacagtccttaaagaatctatcactatgacttctctcagtggcctttttttttttttttttttttttttacagagctggataataaagagcttagaattttattcctgaaaggcaactagagtgctaggcattctgggtttctgatagaagacatgcacataagctttagcaaacactcagaactctatgctccctaactacaacttcgccagagtgcagaggccaactcttttcctttaaaaaactaactccaggatgtgttcacatggtcaataagatctatagttctttgctgatcatcccctgggaaacttttaaaatgaagtctgacacattacaaaccatgcacagaaacaaacaatatcagtaaaactctcaagtaatgcgtggttttgagccatgtagagtccaggtaagccttccaagcttggttaggtgcaaaacatactttctccagtatgtaaattaataggaatctttttttttttttttttctgagatggagtctcactctgtcagccaggctggagtgtagtaccacaatctctgctcactgcaacctcttcctccctggttcaagcgattctcctgcctcagcctcccaagtagctgggattacaagtggacaccaccacgcctggctaatttttttgtatttttagtagagacgggttttaccatgttggccaggttggtctcaaactcctgacctcaggtgatctgcctgcctcggcctcccaaagtgctgggattataggtgtgagccaccatgcccagcctataaataggcatctttgatggccttttaaaacaaccagactttgtaggctatctgcaaaagataatagtttgaaattttaatatttatttaaatagtcctcctgatggtaactgatcactaacttttgaagtgcgttgggttggactcagtaaaaatctcagcaatagcttataggaaattattcttctgttttctaaggcaggaggctatgcacccgtgtcatctaaaagagtggcccatggtgctatggagcaagccaaatcttcattgcagtccagttctgtcatttaccaaatctgtgacctccagagagctgttttattaatctacccctcagcttcttcatctgtaaaatgggacaatgatagcccttctcttccagattaggcacctaatgcagaacctagtgagatctaaatatatattagctacatctattattatgtttataaagacaaaggataaatggtagtcctgttttgtcccactcaaagctgttctctgagccacaaaaagactgtttcagctgcatgccaagttaacacattgcagttaagaaggaaaagcattgcagttaagaaggaaaagcattgcagtagagactagtccgtgaacatctttgtcctcaccattcctatcgccttcttttaaatgaaggaggcagtgggtttcttatattttggtccccatgattttgcaatttatagccttgataacctggccacagctaattaagccaaggttcggggctcattccttaggccgtgatgtgcaacttggcctgtaccctctaacatggcttctcatgagaactctacctaacagaaagttctgtgttgaatagcgatgaacggattcactccaaccttctctcagtgactttgaataaaagatatgcagactgtatagcagcctaaagagtgggctctgttccctcgcaaattttagcatactcattgagaagggagggagctttggggagacagtgagagaagagaatttaaacattgtgggcaatttcttctgcccttccatttgctgtggaattttccagccattttatgttctgtggatttttcatgcttgatatggttggtttctgggatgtgtttcagtcaacattgacccaaaaaccatgcagtcagttttctgtctaaaagccaaagctgtaacctcactgatattgcagaaatgtttctatcactttctgacccctaaaagtgcatgtctcttagatcatagctttgctggtatcaagattacatttttaacagtataaaccttttacatatgcagtagcaattagaatgctctccccaagaggaggacattctctgaaatcccaagtaggagtgaacccagagtagcatagcatatctgctaacttgattccatctgtctttgttgcaacatgctcactgagcatatgcccctaaatgaatatgagatgaagacaggatctgtggtccctcccgcaacattgatggggtaagtttttttgctaggctgagtgtggttcaaatatttttgtacaatatatatcctaaacacaaacaactacttcgtctgttgcccacccaaaaatatgctgatctgttttgtgctgaagtatgatcgttcgtgttggcgtccttgagaagtaatgggataaggtacttgaagggcgatttaagagctttccagagcagcccttggcttttcttaattttccagttttgcaacaacttttagagcccaatcctcatgtaagctttggatccactggaattaaaagctcagactttatagacaaacagacctgggtttgaatcctatttccatcacttgcctttaggaaagttgctcaacttttctgagtcttcattttctcatctgtgcccaccctcttattgcagtgaggcttgagtggtattcacagccctcggtgcagtcacttccatacataagagccactgttgttgttaacatagtttagaagttaagagagtcacaggcgtcgtaaaccctcagatagtaccagtcatgaggaagcagaattcactaagcggtgggtaggagggtgcacaagtagccaggtatacaagtagccgggagctgctgagtgtcccaggtctccatgaggatcaatcgctcaatagcttggatagtctgcgtgtggataacacatcagcaaggaatagagacaacgccttaaaacagactttcagcatttctggtgtcgaaaggtcctaacatgaggtctcactaaattcgagatttcatcagcctgagaagaactcagggtaaaataagagtagtaatacacaccccttttaacctgggttagaatgcgtttatgagtgtgaggtgatcttcaagtataaagccctatgtggatgtaacatgatagcagattataaatattaatagcattttaagtcaaagataactatttagaattgtgaataatagagaagaaagactgtgggcatcactgtacctcctaccctcagttaaaacttactgaaggaactgaaggttaaacattcttgataaccattgtatttctgcagtgtctcagaagtattactagaagacaagcatgggatttagagttaaactaaccttgggttcaaatcataatgctgccactccttgactgtgtgatggtggagaagttatttcacttctctaagcttcaaattctctatcagaaatgttttttctgtagctatctgcttaggaacaaagagaaaggcagcttcctgcatgactcagcttccagcttattattattattattattattattattattattattgttattatttgcttttgacaaagtgaactgaggtcccaagtttttatttccctttcacagagtcaagtttattggtataatcctgctaagaagtacttaaaacaaaaactagctattcacaaacaagtcaaatatataccctctagagtgtgttgataacgtgacttagtacatgaagagagagcatggtgttcaattgtgcaggtcaggtgaagctagtctttcatgcctcatcacaagtagcagatttccattaagaattggcaagctctcaaagctcagactctcccagagcagagcaaacaggcagatgcgaatacatgcctatcccagcagcatctgtttatgccagtggggagaaaccatcccctccacacacggttaaacaagtcagtgtgcagcctacctccagggcccttctcgttttgcctgggaatgtcctgggtggcttgtaggagatgaggatgcagcttggggcagccaaacctggggcatttcagaggcagagtataattcatgtggcaatacctggctctttatggcccgtagttttacacctaccatcctctgcacacagaaaactttaggcagaaatggagcatgcacaaccaggtctgcatatccgagagtggtcatttccttgcaaggcgtgtcgcttgactgaggggactagggggctgcagaggggctggcagatgtttggcttttggtgcagatatgagccaaataaattgaaaataggaagaaggagtacatgacctcacccaaattttaattcccatagaatagttttttgtttgtttgtttttagcgttgtatgcctaatagggtaaatgttattcaaaaaatagcccaggtgttagaaagacaaaatagttgttacctttagggaaatggttgtgaacaaaaggggcacacagggggtgtctgggccactaataatgttctgtttcttgatgtggattcgagttacatgggtgtgtcactttatgaaaattcatcaagggccatcaagggctcggtggctcatgcctgtaatcccagcattttgggaggccaaggtaggcggatcacttgaggtcaggaattcgagaccaacctggccaatgtgatgaaacccaatctctaccaaaaaaataaaaaataaaaattagctgggcgtggtggtacactgctgtagtcccagctgcttgggaggctgaggtgggagaatcacttgaacccaagacgtggaggttgcagtaagtggagatcatgccactgaactccagcatgggtgacagagtgagaccccatctcaaaaagaaaacaaaaacaaaaggtctggcacggtggctcacacctataatcccagcacttttggaggctgagcagactaggatcacctgaggtcaggagttcgagaccagcctgaccaacatggtgaaaccccttctctactaaaaatacaaaattatccgggtgtggtggtgcatgcctgtaatcccagctactctggctgaggcaggaaaatcgcttgaacccgggagagggaggttgcagtgagctgagacggtgccccattgcactccagcctgggcagcaagagcaaaactctgtctcaaaaaaaaaaaaaaaaagaaagaaagaaagaaaattcatcatgctgtatacttataatctgagtatttttcttcatgtaggttattaaaaaacagcagaaatattcttctctcaaaagaaatttctatattttaaaatatgcatatttatactatacatatatttatatttaaattatatatatatatttagtaaggaggggaatacatataacttgatacaaagtctgcactaagttagaatatatctaatgcaaattaatacttgagtgcatattaagatatatcaaaatttaaaaattggtcaaggtttttaagtgctttgacagttacagtaaggtaaggttctacataaaataacatgagtattgtcagcttccaccttacatttccaggaatagtcatttttcatgcattcattatattcttttcagcatcatttgcagagtttttgaacttctaagctgtaccacacagaaatgccataacactcattttgactatttcaacaaagtattataactaagccattaattgatccactagctttgctgttgggaaaatttacttattttgtaaatacagccacattgacttttaaagtcatctaaataagcttgttattaaataaaaatgttttgaaccttaaaactgctttaaatgattttaaataaatggtttatatttttttctcagtagtaataatttttctgaagtatttgcttattgtttttaagtgatttctttatacatatatatgtatatttacatactatgtgtatatattaggcaatattaaatgacctgaagcttttgatcaattctaatagaacagacaattgcaattctaaattagctctcataaaatggaacattttgcaagtagctaataaatatttgttgatcaatagttataccttgaatcctttatctattagaattttccagacaacaaactcatattgtttctcctttaggttcatttggatgtatcaacatagtaactcttgttacaaaaatattttaagtttaaaatcaattatttggttaaattctgtatgcatattttaatagttaatagacaaggtaaaatcagctcacttccatgtgttcaatatttattgcttgaaaattaaggcttataaattagagtatgctaactatgcctttttgttatagatcctcagcgctgttggttgtattatggaatagttaagtataggctctgctctccagacaccaaaggtttaactcagctctgtctttcaccaggcttgagcaccaaaggggaagtcagagaaaaagtaacagcaagtgaaataaaaatagaattctcaaaagcaatagttgaaagacaagaccacagaatggtatgatcaaagtgttgagagaaagagaaacagaaattgagagtttgagaccaaaaggtttttcattaaagcaatctctaaaggatttacttaatttttttaaataaaagaaacccagaagaaatgtctgaggtgtaagaagtattgatcaaagacattaatgaagatataggttaaaggtttttaaaactgtgtaataaaatattaacatcaaaattaatgtgttttaaaaaggagtaaatgaaacaattaaaaatgaagtctgttagaaagagaataatcaaaattacagttttttaagatccttgtattttaagaggatttaaaagagtgattaactttagactttcttaagtatgtaagatagaattccaaagtgcccactttttaaattttttattatttattttttgagacagactgtcattctgtcacccatgctgtagtgcagtggcatgatcttggctcagtgcaacctccacctcccaggttcaagtgagtctcctgcctcagtttcccaagtagctgggactacaggtgcacgccatcacgcctggctaattttttgtatttttagtagagacgaggtttcaccatgtcggccaggcctatctcaaagtcctgatctcaagtgatccacctgcctcgccctcccaaaatactgtgattacaggtgtgagccaccacacccagccttcaaagtgcccacttaatattaaataatatataacttcaaaaccagaatgggggaggaaatggattaagaaaacaaatataaatcatctattcagaaagactaaacaatataagacaataggaacaagtctgtctttcttgcttttacatgtgtgcatgtgtgtgtgtagtctagatacctagatagttagataaatagatatagatagatagataaacagatatagatagatagatagatagatagatagatagataaacagatatagatagatagatagatagatagataaacagatatagatagatagatagatagatagatagatagatagatagatagatagatagatgatagagagagagagagagagtgtgtgtgtgtgtgtgtgtgtgtgtgtgtgtgtgtgtgtgtgtgtgtttagtccatggcagtggactaaatatactagctaaaagatcttgtcaaattagtttaaaaagaagctaagtggtttttttaagacacatctgaaataagaggactcagaaagcctgaatggaaaataatgaaaagagacataatatgcaaataataattaaaggaaaaaccgggtaactataatagcaggtaacaaagacttcaaaaacctttttagaaggtagaaaggatactgaattatggcaagcgattcattttgccagaagaacttagcaattttaaacttgaattcgcaaaatactctcaaaatatataaagcaaaaattgacagaagtgcagggagaaattgataactcaaatatcatagaagaaaatgtggcatattaatttcagaactgatcatttaggcacacgacaataagtaaaaatagaggtttccaccaatataatttaaaaacttgattgacataaagtctaaacaaaataaagaacacacattcttctaagatataaatgaaatgtttaaaacatttatgactttctaggggaaggtatcttaaaaatacttagaactgaaggacaataaataatcctataaataaatattcatgagatgcaagacaaagatagttgtagttattttacactttaaatgcttaagtaaaaaatgagttaaggctagaaactcatagctaaattcaaataaagtaaaagtatgtgatgatgtaagagcagagcttaatgaaataaaacttgaagttatagtagggaggatcaacatagtcacaagttagtttcttgaaaacagaaaatcctccagcaaaattggttaagaaaaaaggagaacaccacaaataatcaatacaagaaatgaaaatggagataattataggtagcagacactttaaatgacaataagagaataccatgaacaaagctggccaaagcatttgaaaatttaggcaaaatggatgaattccatctatagtatatatgtatcagaatattatttttattgaaagatattgtcactgggtatcgagttctaggttgacagttcattatttttttctttcttattttaaaggtgtggtcctactgtcttctggattgcattatttcctgtgagaaatctgtcattgatatgtttgctcctttatgggcaattgtgtcctttttctctggctgcttttaagaatggccttatgatatacctcagtgtagtttcttccattcatgttttaatttaaagccattatctcttcaaatattttcatcactctcccaacccccacttttggaaattcccattatacatattgtaccacttgactttgccccacagctcattggtgctctttccttttttcttttttcttttctagtagcttttttttcctctgttttttattttggatagtttctatcactgtcttcaagttatctaatcttttcttctgtagtgtctaatctgctgttagccctttccagatattttttctttttttaatttttttttttatttcagtaggtttttggggaacaggtagtgtttagttacatggaaaacttctgtagtgggtgacaacccactctttgggttgtctgtttactctgctgattacttcttttgaggtacagaagctttttagtttaattaggtctcatctatttatctttgtttttgttgcatttgcttttgggttcttggtcatgaagtctttgcctaagccaatgtctagaagggtttttctgatgttatcctctagaatttttaggatttcaggtcttagatttcagtcttcgatccatcttgagttaatttttatataaggtgagagatgaggattcagtttcattcctttgcatgttgcttgccaatcatcccagcaccatttgttgaaaagggtgtccttttcccactttatgtttttgtttgctttgtcgaagatcagttggctgtaagtatttgactttttttctgggttctctattctgttccattggtctgtatacctatttttataccagtaccatgccatttggttgactgtagccttatagtatagcttgaagtcacgtaatgtaatgcctccagatttgttatttttgcttagtcttgctttggccatgtgggctcttttttagttctgtatgaatttaggattttttttctagttctgtgaataatgatggtggtattttgatgggaattgcattgaatttatagattgcttttggcagtatggtcattttgacaatatttattctacctatccacaaggatgagatgtgtttccatttgtttgtgctatctatgatttctttcagtcctagccagagcaatcagataagagaaagaaataaagggcatcaaaatcagtaaagaggaagtcaaactgttgccgttcactaaggatatgattgtatacctagaaaaccctaaagactcatccaaaaaacctcctaaatctgataaatgaattcagcaaagtttcaggatacaaaattaacatacacaaatcagtagttctgctatacaccaactgcaagcaagctaagaatcagatcaagaactcagcctcttttataatagctgttaaaaaaaaaaaaaaaaaaaactcaagaatatacctaaccaaagaagtgaaagatctctacaaggaaaactacaaaacactactatcttttgtatttttgtttcagtttcattgagttttactccgatctttgttatttcttttcttctgctgggtttgggtttgctttgtacttgtttctctagttccttgaggttttaccttacattgtctgtttgggctctttcagactttttgatgtaagcatttaatgctatgaactttcctcttagcaccaactttgctgtatcccagaggttttgataggttgtgtcattattatcattcggttcgaagaattttttaatttccatcttgatttcattgttgaccaaatggtcattcaggaacaggttatttaatttccatgtatttgcatggttttgaggattccttttcaagttgatttccaattttattccactgtagtctgagaaagtacttgatataatttcaattttcttaaacttactgagacttgttttgtggcctatcatatggtctatcttggagaacgttccatgtgctgatgagtagaatgtctattctgtggttgttgggtggaatgttctgtaaatatctgttaagtccatttgttctaggatatagtttaagtccattgcttctttgttgactttctgtcttgatatccagtgctgtcagtggaatattgaagccccccaatattgttgtgttgttgtctatctcatttcttaggtctagtagtaattattgtccaaatttgggatccccagtgttaggtgcatatatatttaatattgtgatattttcctgttggactagtccttttatcattacataatgtacctcttcgtcttttttaactgatgttgctttaacatctgttttgtctgatatatgaatagctactcctgctcacttttggtgtccatttgcatggaatatctttttccactcctttaccttacatttatgtgagtccttatgttaggtgagtctcttgaagactgcagatacttggttgaattcttatccattctgcaattctgtgtcttttaagtggagcatttaagtcatttacattcaacattagtattgagacatgaggtactcttctatttatcatgctagttgttgcctgaataccttgttttttgtcaccgtgttattgtattgtatgccctgtgagatttatgctttaaggaggttctattttggtgtatttcaaggttttgtttcaagatttagagctccttgtagcaattcttgtagtgctggctttgtagtggtgaattatctcagcatttgtttgtctgtaaaagaccatctttctttcatttgtgaagcttagtttcactggatacaaaattcttggcttttaattattttgtttaaggaggctaaagatagggccccaatcctatctggcttgtagggtttctgccgagaaatctgctgttaatctgataggttttcctttacaggttacctgatgtttttgcctcacagctcgtaagattctttcctttgtcttgactttagataacctaatgactatgtgctaggtgatgatctttttgtgatgaatttcccaggtgttctttgagcttcttgtatttggatgtctagatctctaacaaggccagggaagttttcctcaattattttctcaagtaagttttccaaacatttagatttctcttcttccttgggaacaccagttattcttaggtttggtcatttaacataagctcaaacttctttgaggctttgttcattttttaaattcttttttctttttttctttttttttagtttgagatggagtctcactctttcgcccaggccggagtgcagtggtgctatctcggctcactgcaagctccacctcctggattcacgccattctcctgcctcagcctcccgagtagctgggactacaggcgcccaccaccacacccagctaatttttttgtatttttagtagagatggggtttcaccgtgttagccaggatggtctcgatctcctgacctcatgatccgcctgcctcaacctcccaaagtgctaggattacaggcgtgagccaccgcgcccagccttaaattcttttttctttgtctttgttggattgggttaattcaaaagcctcgtctttgatctctgaagttctttcttctacttgttccattgtactgaaactttccagcgtatttttcatttctctaagtgtgtctttcatttccagaagttttgattgtcttttatttatgttatgtatttctctagagatttttttgtccatatcctgtattattttttaaatttctttaagttggttttcacctttctctggtgcctccttgagtatcttaataatcaacctaccgaattatttttctggcaatttgaagatttcttattggtttgaacccattgctggcgagctagtgtgatcttttggggtgttaaagaaacttgctttgtcatattaccagaattgtttttctggttccttctcatttgggtagaccatttcagaggaaagagctggggtttaagtcctgctgttcattctttggtgccatggggtgatgccttgatgtggtgctctccccctttccctagggatggggctcactgagagctggactgcagtgattgttattgcttttctaggtctagccacccagtggagctactggactctgacctggtactggggagtatctgcaaagagtcctgtgacatgatctgtcttcaggtctctcagccatggatcccagcacttgctctggtcgaggtagtagggaagtgaggtagactgtgtgagggtctttagttgtagttttgtttagtgcatgggttttcttgaatgttggttgtgctagcagttagttggcctccagccaagaggtggcacttttaagagagcatcagctgaaacaagcttgtcctaagtttgcctgaataggtatttgggcttctcaggtgatgggttggaccatagcgctcccaagagattgtattttctgtcttcagctgccagggcaggtagggaaagaccactgggtggagccaggattaggcgtgtctgagctcagcctccccttgggcagggcttgctgcagccactttgaggatggcggtgtggttctcaggccaatggagttatgttcccagggggattatggctgctctgcagtgtcatataggtttccagggaagtgggggaaagtcgtcagtgactggcctcactcacttcccacacagccagcaaggccagtctcactcccactgcaccccaccgatagcactgagtttatatccaggtgccggtgagcagagctgaggtcttgtcccagactacaagcctcccagctgagaaagcaagcaggactttcaggccccacctctccccacctgctgtagcttctttgctcatatctacactttctgttcaccccctaccccacccctgccccagattgtgcccagaaaaattcatatttggtcaaaattattacaaagttcagctagaagtttccttttccctgttgtctttccccagttccactggcagccctccccaagaacctctatgaggtaaagtcagaaacggcttccctgggcaccaggaatgcctacagggctctttctgctgcttcttctagttttatatttcactgggctctctaaattcatttcagctctaggtaaggttaaattcttctcctgtgatctgaatttacatgttccccagtgagggtatgtgttcagaagtggactttccctcctcacgctttgggcactcacagtgtgaatttcactttgttgagtgtagatatttttatatcctatattatgcttaagctttgttctgggatgaaattaacttattgaaaacagttgatcctttggagacttgcttttagacttcatgaggtgagaccagcacagcccttttctagggctgattttttcccaataatgttataatttccttttgagtactgtacctaataccctgagttacaaggttttgcactcagactggtgggaacatgaattattcttaatctgtgtgagtaggttgttccctcagctcctttcaggtgagttttctctgacccaggttgttttattacacacatgaatttattggtaccttgctgaagacttaagggacacttctgcagatcacttaagttttctctctgtacagctctctcctgtctggtattctgttctgaagaccctagactaccaactctgtctcctcaagtaaggagctcaccaggttcctaagtttcccttccctgcactgagacccagaaaattttatcaggcagtaggctgaagcaattgtggggttcacattgtttgtgtctgtctctcagacataactgccctgccctgcctgatctctatgactgttttatatattttgtccagtcttttagttgtttcagacaagagtaagtcaaatcctgctactccttctcggctggaagtagaagtttctagtcttatgatttttaactgttgtcagctaattaaaatgtaaagttttataaggacttcataagtgtatgcaaatgctcctaaggctttcctggatgtcagtttaggcccccaggcttcaggattaatctttaattaatactctgagtggagacagggaaaagaagggtgaatgaagtttctgtggtctaagaaatcccaatagacaacttctggagaaatgacaagagagggacataagcaatcaaaaagaagggcgaggccgggcacggtggctcacacctgtaattccagcactttgggaggccgaggcaggcggatcacgaggtcaggagattgagaccatcttggctaacacggtgaaaccccgtctctactaaaaacacaaaattagccgggcatggtggcgggcgcctgtagtcccagctactcgggaggctgagacaggagaatggcgtgaacctgggaggcagagcttgcagtgagccaagattgcgccactgcactccagcctgggtgacagacaaagactccgtctcaaaaaaaaaaaaaaaaagaaagaaagaaagaatggggaggggacatatgcatctccatctcaactctctaaaactaagactcagacagagattttggtgaaaaatgtgtgcctaataaaatacttgctctaaaaattagattctagatattatctgaatatgtgccagtcactattctaagcattttacatatgtggatgtatttaattctctgacaactgcataagtaagctattatcatctccagtttatggataaagaagcaggctaagcaaattccccaagatcccatagttaaaaaatggcatggctcagatttcaatccaggctctgtaactaatatattatctgctaagaatatcagtcttatcatgtttagttctctggcttaaagtccacaacataataaaagtgaattgtagatgctgagatgaagatattaaatgtaaatacaacaaatacaaggaaaaataaaaactgacaatttgtttaaaagggcaaggacatagaatcctctgaaatagacattgcactgagaagtctatcactagcatattaaggaatgaagactcagataatgaacttgctgttaaaaaagcaaacctctgttaataacttttaattaaacctttgattatatttttaaatgttttttatttcttaaaaaacagttttgggctgggcaccgtggctcatgcctgtaatcccagcactcgggaggccgaggcaggtggatcacctgaggtcaggagtttgagaccagcctggccaatatggcaaaaccctgtttctactaaaaatacaaaaattagccaggcatggtggtgcacacctggtagtcccagctacttgggaggctgaggcagaagaattgcttgaacccaggaggcaaaggttgcagtgagccgagatcacaccactgcactccagcctgggtgacagagcgagactccttctaaaataaataaattaattaattaaattaaataagaaacagttttgcatttgaataattctgacaccaaaataatttttatcctggaatacactattcaatagtggtaaactttgttatatggaaaacatttcttatttctgagcaatatcaggtaaatgaatcaggaattatttgaattagaaggtattgttactaaccccctcatacctccaatgtactaaaactaatacatcttaaaattccttttaatcatttaatttttcttttttccaaaattttccccacataaataaagtagaatttagcctcttctacttcaaaaataaagtattttctaacaatgtttatcattataagtttctcagggctcaaatgtagaacatctttttgatagcttttcactctttccccaaacatatcccagttttatgagaccaagtacaaatatcttcctgtcacacatcatcaggagaatcttgccaggtgcagtggctcacgcctgtaatcccagcactttcagaggccgagacgggcggattgcctgaggtcaggagttcgagaccagtctggccaacatggtgagaccccgtctctactaaaaatacaaaaaaaaattgctgggcatagcagcaggtgcatgtaatcccagctactctggaggctgaggcaggggaattgcttgaaccaggaggtggaggttgcagtgagccaagattgtgccactgcactccagcctgggtgacagagcgagactccatctcacacacacacacacatacacacacaaaatatggataaaatatctagtgtgagaggaacagcagaaggagaaagtaatgtcttgaggaaggtgcgaatcatctgtaaatactttttagagtaatggaattcctagacagacagcttcgcaggcagtattgccattcagtatcattggcaaccttcctaaaaggaaaagagtaatgttaatgccatttctgaaggtatgaattgaggattttgattctttttccataaatacttaccttgtgaaaactcctctgcaatctctactgtcagtaagttttataaatgctgtatacaagtcttcaattcaccattgcctgcttgaggcttatttattttttgagaaagaagctggagaagtcatttgaaaattcatgggtagttcactcttcaaggttgtggtgtgctcttcaaatagctataaaaatttccaagagacaggaccactgaccctgcgcttcgtagcaaatagctttacttactcattatctgactagcgtattagttaatcatgtaaacaattatctttcttttcaggtggcaataattcatggcatctcctcccccttccaccccacacatatacttatttattgtcacagcctgatttataattgttttttaggatttcttcatatcctccctcctacctttacccctgagttcagaaaataataaacactctaaatctccaagcaatggaactcttctaagagttaagctaaagtctatcctaccaccttgctatattaatgtcagctcatttgatgtgtctgtagagcaggatttgtttggcaagctttttctgtaaaggaccagatagtatttcaggctttttgagccatgtggtgtcggtcacaacttttcaactctgccatcatattgtgagagcagaagtagacaaggtatgtttaaaaaaaaatgggtatggttgtgctccaataaaatcttttttatagacactaaaaacttgaatttcatgcaaattttatgtgtaaggaaataattttttaaaaatctcttctttaaccttttaaaaagacaaaagccattcttagcctgtgggtcgcacaaaaacaggcagcaggccatgggccatagtttgccaacccattatctaaacggttaacagaatgcttactacaggttttctgaccctcagcactagtaatactttgggacagataattctttgttgtggactgtcttttgtttttgttttgagacagcatctcactctgtagcccagactggagtgcagtagtgcgatcttggctcgctgcaacctccacctcccaggttcaagcgattctcctgcctcagcctccccagtagctgggattacaggtacccaccaccatacctggctaatttttgtatttttagtagagatggggttttgccatattggccaggcttgtctcagactcctgacctcaggtgatctgcccgcctcggccccccaaagtactgggattacaggtgtgagccaccgtgcctggcctgtcttttgtattttaagatgtgtcatatcatctctggcctctgcctactaaatgccattaacaccctacatcccccaattgcaacaactagaaaatctacagacattgacaaatgacctttggggacaaaattgcccccagttgaaaatcactggtctaatacactgaaaacttagaatacaccgcataaaatatgagctggtaggctgcgtagtataagatagcgtcatgtgtcacctgagagatagccattggattctcatgcttctaatgtagaaaccataataccgtggtcttccccttacctacagtttcattttctgtggtttcagttaccagagatcaaccaaagtctaaaaatattaaatggaaaatttgaaaaataattcatcagttttaaattgtgtgctcttccaagtagtatgatgaaatcttacaccatcccaccagagacttgaaccagccatttgtccagcatatccacgcggtagctgctacctgttcctgagtcacttagtagacttctggattattggctcaacagtagaggtattgcagtgcttccattcaaaaattccttactttacttttattatggtatattattgtaattgttctatcttattagttactgctgttaatattctattgtgcctcatttataaattaaactttacatagatgtgtatgtattggaaaaaaatatggtacagctgacccttgaacaacacagatttgatctgtgtagtcttcttttatgtgttttttttttcaataaatacagcaggccctccatatcaatgggttctgaacctgcaaccaaggcaagacacaaatatagtattcacaagatttgaaacccatgtatatagagagctgactgacttttcatctgggagggttctggatggctcacttccatacttgaatgtgctcggattttggtatagaagggggtcctggaaccaatcccccatagatagcgagagatgacggtatacatagggtccagtattatctgaagtttcagacattcactggggctctgggaatgtataacctgcacataaaagagaatttccgtactacctccaagttaataaccactgaagaaatcctaggcttaagagagcccgttattggaacttagatggtggcgttagagtgcttatgctttggacttaggagtcagtatcccttccccccagctttgtctctttctatattcctttcccatttttcctctttccacctccttacactcaaaccatacagtgtgcacctgacagtggactacaaagattaatattcgatgaaaggactttgtccatttgaccagaccacttgaatgatgaggtgggagccacagaatacatagttgatattaaattaagaatctaggccagacccggtggctcacacctgtaatcccagcactttgggaggccgaggcgggttgatcacttgaggtcaggagttcaagaccagcctggccaacatggtgaaacccgtctctactaaaaatacaaaaattgctgggcgtggtggcaggtgcctgtaatcccagctacttgggagtctgatgcaggcgaatcgcttgaactcggaggtggaggttgcagtgagccgagattgcgccactgcactccagccggggcaaaagagcaagactgtctcaaaaaaaaaaaaaattgagaatctaaattaatttatagaaatcctttttccataaatttatcttttctccaagttttcttctgatatgcaaagtgtgagacacctactcttagcttttagatagtttacaggccaatgacacacagtagatgatgttctgccatgatgtctcaaaggcagagaaacattcttatttttatcaacactttctcatccccatctttaaattattggtataaacaaacttctgcttctcactttagattataattttatcattttttacaattcatcaaagaaagtttttctaaattgcacggaaagttctatagaatgctgagttatgtattctaaagaatatttctccttcccattttttcatagctaaactgtcaatatttttaccttaacttcctacaaagtcctatagctatttgattacttgatgtttcagtataaaaaaaaattaggtcaggtgtggtggctcatgcctgtcatcccagcactttgggaggccaaggcaggtggatcacctgacgttaggagttcaagatcagcctggccaacatggtgaaaccccgtctctactaaaattacaaaaattagccaagcctggtggcaggcactggtaatcccagctcctcagatggctgaggcaagagaatcgcttgaacccgggagacagagattgcagtgagctgagatcgtgccactgcactccagcctgggtgacacagcaaaacttaatctcaaaaaaaaaaaaaattaataatgctgcttctgcctgaaatacatgatttccagtgagtgaaggaccacttgctctactgaagtaaagctactttactcaagtctctgaaggagtaagagagtcctgcagggcacatttgaacagctcactttcagatacaagtgataaaaaatggagcctcagcaacaacaacaaaaattataacttttaaagagatagaacaacatggtttgaaaaggaatctggatttttgcctctggttgctgtcattgacagggaaagtcttatattttctgaacttgtttttaaatccccccaaatagagggattagactgtgtaattccacaaatccgttgattttatgacctggctatagcttgggaaagcaaccacatagtaccgttgttacactccagagctattcaaatattgttatcaaagtggtgccaaaaatttctaatcaaatatttggaagagtttggtgatgagtcgaaagtagcctgtatgtctctgaattctgtgatgtttctcatttttcctccccgtacagtcttcataggtatttagacaagtaaacacctgtaaaggaagaatgtgggcaataagaatgaatataaatgataaatcacataatctgatgtaatgaaagacttaagttattacagaaaacctagaattaaatgaaatatttaaaaagtgatgtcttcaggaagtctacagttcagattcaagggtggcaaatactgtccatggagaccagtagttctcaggagggtgactttttttctccaggagacatttggcaatgactggagatatttttacttgggcatgttgttgatatctagagagtagaggccacggatgctgctgaacacctccaatgtgtaggacaatgccccgcaacaaagaatgatctcgcccaaaatgtcaagaatgccaaaatggagacaccctggtgtagacctatgatagctctgacttctttttttttttttttttttttttttttttttgagacagagtctcactctttcacccaggctggagtgcagtggcccgatctcggctcactgcaggctcgatctcccaggttcatgccattctcctgcctcagcctcccgagcagctgggactacaggagcccgccaccatgcccggctaattttttgtatttttagtacagacggggtttcaccgtgttagccaggatggtctcgatctcctgacctcgtgatccacccatctctgcctcccaaagtgctggagtgctgggattacaggtgtgagccaccgtgcccggccgatagctctgacttctaagtcaactgtgttcatcagtttcatatctcccctcttactttccaccatcacaaaagcctctgcctcctaccaaatgttagtaaatgcagtgaatgttagcaatctatttgaaacaaggtttcttggcattcatctagctgtatggataaagttttaccagcacaaactctgtatgcatggggtagactggatcagacagagcaatctgaaccacaatgttggatttccttcaagcttgagaaatattaatactaccatatatacaggcggggcatggtgggtcacgtctgtaatcccagcactttgggaggccaaggcgggtggctcacctgaggtcgggagttcgatactagcctgaccaacatggagaaaccccttctctactaaaaatacaaaattagccaggtgtgggggtacatgcctgtaatcccagctactcaggaggctgaggcaggagaatcgcttgaacctgggaggtggattttgtggtgagccgagatcacgccattgcactccagcctgggcaacacagcaagacttcatctcaaaaaaaaaaaaaattaccacacatactaacaatatgaaagttctaattcatatttaaggaaacatctgcttctacatgtgtttctatctgtggttctgaaaagcaaatcctaatttttatgaatgataatttctgggcctctttttgtctttccccagatgttccctgctttgttgcttaagagctgcatggcacagaccataaaggttgtgagctcttcccatttcaagaaaccctggggagattcaaataaacaaattcaaaatgccccttagagtctttaacagaccagaattagtacgttgtttgtttgaaaatctttctttttttcggatataaaactatacactcaagactaaatggaggcagtacaattacacattttgactgaattgtctcatcagtaaaagtatcacctggctaattgtaactctttagaattggcctaaactagaaaataaacaaggaccttattcaagtatttcctattatgttacatacatacaagttaccaattagaagttgatatacactattttgtttaaaaataaaattcagcaagcttctgatgatttattctgttcttgtttttcttaccagttttactgccaaaataaactccttctcatacaaagtctgggattataccacagagttactataattggattcaactttaatagaatattacaatattaattttaatagagtatggtttcagatattaaaaagattaatgtacccaaaaacataatcattgttttgttttttttttagacagaatcttgctctgtcacccaggctggagtgcagtggtgtgatctcagctcactgcaacctccacctcctgggttcaagcgattctcatgcctcagcctctcaagtagctgggattacaggtgcatgccagcatgccaggctcatttttgtatttttagtagagatggcattttgccatgttggccaggcttgtctcaaacttctggcatcaagtgatctgcctgccttgaccttccaaagttctgcgattacaggcgttgagcaaggcattgagccaccccacctggccacttcttttaaattgcataattttcctgttctctatttcatccaatctaaaataataatgagttttaaatacttatttttaacattttttttacacctatgatttgagaatatatatatattaggccgagtttcatttttgttgcccaggctggagtgcaatggtgccatctcggctcactgcaacttccacctcccaggttcaaacgattctcctgcctcagcctcctgagtagttgggattacaggtgcccaccaccatgcccagctaatctttgtatttttagtagagacagggtttcaccatgttgtccaggctggtctctaacccctgacctcagatgatccaccagcctcggcctcctgaagtgctgggattataggcataagccatcatgcccagcctgagaatagatttttgacatttttaacttgattttccgagaagaaaaaattacatatttttaaaaataataaatacattgaaatctagattttaaaacatgtttactttctctcaaatttgttagaaatgtcacaacaaatagctttttcaacctatgaacagtatttgtagaagggaaaaatgaggaagaaatgggcacatttttctagtgattgaatggtggtgtctacatcttgaataattctcactgcatatcgttgcttgaattgtagatctgtatggcatgtgacttgcctgggtctatgatgttgtcaacagaaagagtcaaattctgtaaaatatttgaagagatttcttctgagccaaatatgagtgaccaatggtcccgggaaatcctgaaaacatgtgcccaaggtggtcgggctacagcttggttttatacattttagggggacataagacatcactcgatacatgtaagatatactttggttttgtctggaaaagcaggacaactggaagccaagggtagaagggggccttccaggtcataggcagattctcatgatgttgcccagatgtcctattgtaatttcaattggttgagtttatctaaagatctggaatccatagaagggagtgtctggattaagataagtggttgtagagaccaaggctcttattatacaaagcctacaggtagccggctttggagagaatagattgtaaatgtttcttatcagacttaaaaaggtgccagactcagtgaattctctcctggattagggaaaagacctggaaatggaaagggattctctacagaagttagatttttccccacaagagacagctttgcagggccatttcaaaaattgccaaagaaatatattttaagacaaaatacttggatttctttcaggacctgctatctgtcatgtaatgctatactagagtcaggctggatttgggtgtcttattgctacagaaagtcttaagatctctattaatgttaatgctggtcagctgtgcctggattccaaagggaggagggtataatgaggcatgtgcaacccccactccccatcatgacctgaactagtttttcaggttaactttggaatgcccttggctgagaggagaggccaattcagatggctgtggggcttaaaatgttatttttggcttatgatgtggaggcagaagtaacctgtatcactgttgtgccaaagtctctaagagctaatgtgcagttcaccaagttgtctccctatgagagtcagccatcactgcaaacagcaacactccaggttgattgtggttctgtcagcttcatcctgcaccccagagtaaagatgacatagtggggagcctgtcttacaatgagcatatagcagatgcaagaaataaacatttgccttgttaagccactaagatgtcagggttgtttgtcctgcagcaaagcccagctcatcctgactgataaacttatccattcaagtgatcagcttttggtgtaaatgcccctaagaaaactgataaagcggccgggcacggtggctcaagcctgtaatcccagcactttgggaggctgaggcaggcggatcacgaggtcaggagatcgagaccgtcctggctaacacggtgaagccccatctctactaaaaatacaacaaaattagcctggcgtggtggcggcgcctgtagtcccagctactcaggagactgaggcaggagaatggcataaacctgggagacagagcttgcagcgagccgagattgcaccactgcactccagcctgggcaacagagcaagactccatctcaaaaaaaaaaaaaaaaaaagaaaagaaaagaaaactgataaagcctgatgcactacctacctatgccttgccaaagaatggtaataatccaaaaactgtttaatttagaccttcactatgcaatgcatattttatctaggaacacttttactggtatcagtgatcaaaattatagagcagggggggaaatgtgaggaaacaaatctcaaatgtcaacatacgtggggatcttgtttgcagatgaggaagtgcattctcaaagctgtgtgaattgtcctcatcatacagctattttcattgtattctttcacaaaaatatgtatgtggatggattcttaggtgttagagacggggaggaaagaataaaggagactcaaggcataggtggaaaccgtgcatacagatggtatatctttatgtgttgagcatttatatcatgcatctgctaagtactgcaatggaaacaaggataagacgcacagacttccctaaagaaatgtaaaatctcaatgacaaagaaacatgtgaagaagttagtatcttaagcaaaatgatgcaattcatagtaggccactgtgtactggaaaagtaagggctattctattccaaagtgtgatttttttattgggtgagggggacctgagaaagcttcatggagggtgtgatagttaatactgagtgtcaacgtgattggattgaaggatgcaaagtattgatcttgggtgtgtatgtgagagtgttgccaaaggagattaacatttgagtccgtgggctgcaaaaggccgacccacccttaatctgggtgggcaccatctaatcggctgccagcacggctagaatataaagcaggcagaaaaaccttgaaaagactagactggcctagcctcccagcctacctctttctcccatgcttgatgcttcctgccctcaaacattggacccctggttcttcagttttgggattggactggctctctttgctcttcagcttgcggatggcctattgtaatcatgtgagttaatatttaataaatttccatatatatatctattttattagttctgtccctctagagaaccctgactaacagagaggagaggatatctgaactaagcctcagaggaggatgaatggcaaggagaagaaacatgtctccaggaaactgaggcctgagggggtagtaatttttcccgagcatatgataaatgacagtgatttgggaagacttcatggcatgaatgtatgtgagaaagtgggcttgcgagagcaagattggaggagttggttatggaaaggcgagtaaccagatataggctgatagatggagtaagcatagagaagggcattgttttgtttgcttgttttttttaattttttaaatgttttatagatatgggagtcttactacattgctcaggccggtcttgaacttctgggctcaagggattctcctgccttggcctcccaaagcactgggattacaggtgggagtcatcaggccggcttttaaagaagggcattgcagtaggaatagaatgaaaggaagagatgaatgaatggaagagatatatgagccatttcaaaataagaatcacaacagtggaactgagtggctgtggataaaagctaaaagggttaagtcagggttgggaccaacagaactagaacaatacttgtattttggcccagatgacaagggctgaagggcatccagtgaacacccagaaactgaggacgctagactgaagcccaggggaaaatccaagctagtgaggtttttctcttatgagttatgggaggagcaacttggagggaacacttattgattgcatctcttgtaatatccacagcaaaggcatatgaggcgaggctagggaaggagatagaggaggagtgtggtcagagacgcaaaaggcatcaaataaagctgatgtggaagagaaccaggacgctcattgtggtatgaaagtcaagagagagagcttcagggaggtgggggattcgcaggtttaaggagaaagcaaagagaatgaggaccaaggaaaggccattggatttgaagtttgagattttctttctttttttttgttttgtgacagagtctcactctgtcaccagcgtggagtgcaatggcaccatctcagcttattgcaacctccacctcctgcgttcaagcaattctcctgcctcagcctcccaaatagctgggactacaggtgtgtgccaccacgcccagctaatttttgtatttttagtagagatgaggtttcaccatgttggccaggctggtgtcgatctcttgacctcgtgatccacctgcctctgcctcccaaagtgctgagattacaggcgtgacccactgcacccggcctgaactttgggattctcttggtggttgtagagaatgcacttcattagctttagattctgggacagtcacattataaaagacaaggggaaataaagagggtatacaggacactggtgtatactgtccactccagatcagtggatgaagaggatctgcaccctaaggggacagcagatttatcccattgctttgttgtgttgctttgtcgagatgggagatacctgaaagcagaaggaaagcaacataggaagacgctcaaaaataatgattttcttaaatgcacatgataatttatggctgacactgacattttctcagttacctttcataataacattagagaaatgacataaggttgcagagtggggggcagtgggtttcttctgactccacttcggttcccttcatagcatgaacacatttgtaagggagaaaacgaggcaggaatgatgcacattccgagggtgggagtgaagaattaggagtcacaggtaggttagcatgtggaagagaaggtgactgaaaccagaggcagagaggagaaagtggactgagatttacatgttttactccctgaagagactagcagtccctatttccaccaagggcagaaacattcaaacattctgcatacctttccttttatgcatgaaataaaatactggcatttgaaggaagaggttgataatgtttatttcttagaacattcaagcttggcagttatgtgacttatctctagagcctctcagaagtctctggggacgcaggagtctttggagactcacactttctgcaaaagtgcagaaagaaatacaattacttaatgaatacctactgtgtactcagcaaatcctttatctgtcacttgtgttaatttctagaaattacataactaagagtctccatgaattgcacttgttttcttaagagggaaagagaaaaaaataccttctttccttaccatttaagccagtgctttttaaaccaggatctgacactccgtaggtgaccatagatgtagtatcacagatccgtctgtttccaaaatgttacattctgattttaagatcccctgaaagttgaaatttctcttttgctgcaacaactcacacttgagaaaaattttcacaggagactttattttcttaaagcagagtttgttaatatgaattctcacaggactgtggcaattcatttttcttttaatgcgttcattactctagaccaagacatcaatttttgtgcaaaccttgtttcctgctgccacctggtggaagccacataagagttttacagaggctttggtggtgctaggagaggggccagggctcttcctcagtcacagaatcccacacagtgatcaaagagcagatctttctattaaactccctggcagcaaaacagtagaggcttggctctctgccccgggactgtgcagaatgtcacaggtcggaagcccagagcatttttctcttcttttatctttagactcttgtggctctcagaccttgaatataattctttgctgaaaattctttaaaatcattatcttttctttcttccttttttctttctttcttttttctttcctcttttttgctatgctagacaggaagaaagaagggaatggcattttaatgtaaagaagattgcactgaaattatattacttgcttaattgtattaattcactgcaataacaatttaataatatgacaggtcatttacatgctaatcatttgggtctcttgtccagagaaatcatgaggaagggctgggaagtgctcttattatgatcaaaataatccacactctcctagaggagtgcataggtatagaactgacattgtttgtttaataaagtttcattcaaggcaatttggctggttcttttatcaagtgtaatgggaaaacaagccagtcctgatgttaaacactccaatgatccctcaagctttttattctgtaataagttttacagcattatgtgttacccacgacagtcatttagtcggtcaatttcaggctagtgataaaagtttgagtaatgggaaagctgtgttgatgttccatattctttgtgagatgtctatgaattaatgctcccaggtacacactcaatttatatttaacagccattactaaatgtaatatctaagtaaaacccagttatgacctatatatatggaaaactaattaaagctgttggaaacaacctatttccctttggattatttatgtaaatacatcgaggtctaaaaattcagtacaagtcagatgtgttcctgcctagggctattatataaagctcagaaaattttatgagaaaaatgatgattcttaaggattgagcttcaaatgtgaatttttctattttataaggatatagcttgggttgttaagcatcaacatagcttttcaaaatagttttttattctcacaagtttaaaggccttgtaaaatctcttctattaaatatacatatatacatacatattacatatacaccaattgactaacccctctaagtgctgtatctgaactaattttaaaagaatacccgtgtttttcagctcccaaattgaaaagattattagttagtaccgtgatttctgaacttttaatcaaattttcattcattttataattttgaaattttgacaatctgagaatcttctatgattaaatatattctttcttcctttcttttttctctttcccttccttccttccttccttccttccttccctccttccttcctgtcagtctgtcttgctctgttgcccaggctggagtgcagtggcatgaacatggcacacttcagcctcgaactcctgggtgatcctcccaccttggcctcccaagtgttgggatagcaggtgtgagccaccaagcctggccttataaccaattaaatgaaggaaatgatactatgacacagacaaccatttttcaatcaagttattctgccatattaaattttcagtcacctttctattgcatttattgaatttctactttttaccagttctaagcctagatctgtctctcttaaattattaaatgtcttattttcttatgaaacaaccttcagatgtaatacacagaagaaaaaggagtctcaggaagtttagtttgcccaactagaaattgagcacaattacttggtgtgttgagggggatttgaaactatgtccttatgataattgatagttatgataattgatgacaaaggggttttagaaagacctcttttgcttttagaaacacttctctttgcactttctttaatgcccattttttagttttatgaattaaataatatacatttatttaaacaaaagtatcaacatttctcaagtatctataggttacttatctactcaatgcaactaacaatcaaaaactagtgctccaacaaattaaattttccaaacactgaaatattgatcacaatgtctctaagcatttcattgaaataaaaattttgatgtatctaattttcctaaatattttaaatgcatttcaatatgcaaaactctcacaaaattgttgtaaatacaaaggtaatcagtatttttagattaaaatcagttataaatgtgctaatatagtgaatgtgacccttgtccggactcacatttttcttcttagtcttttcctgggttatattcttaacatatcagctatttttctatttttatagcttcttagggttcaaaaatattaccatatccaaatgaaaactaactacctgagagcagccaactgcaggatctgtgtcaggatccagctgattcttggtgaggacacagatccaggtgtctaaggagattcagacactagccagtcatcatcagattaagctgcacttaaatccacatatatcaaattgtttttttttatttttacaatggtgcgttactaccatgatgtcttcacaactgatttgagcagtgttgcaaatcccatttcattatcccatcgttgtgatatatagacttggcctgttggaataccttcttggaaatttaaaaaaatagtttattaagattattagggccattgaagaatttcctcctaggagataatgcattgagtctacctttcagtcctcctcctcagaacacgtgcccgaactatcatttttgagatcaccattgatttctttctacagcgtggtcactggtaccaataaaatgctagtcttcattcctatccagttattatgtggggccccatgttgttagtctttctgatttcattatgatactaagttttaagggaaacttgacttcctatttttgtgtctattgtactacccactatagcgactatatagtaaggaatataaatttgttttcataggaaataaaatacccacatatattaaatccccattaaacataccctatttcatttacccttctttaaattataactatctttttatatggcttatattaacttttctctctcaagcatcattttaagctaatgacctttcagactagacccaacttctttcagtcaaccataattcatgctcactttctccctctctctcatcaaatcatcgaaatttgatcagcaggaatctctttaacttgactccattgattttttagtgttttagtacagtctccaacattcttaaaaacatatttgttttctagcaataacaagatgtcccagactcattccaatttgttttgttttactgccccaaaacatggaatcagcttccctaccataagtagtaaagagtagtagagaatactattaaagtccaaaatctgggaactagggataaacaggagagttgatggtaagtaaaaccagtgctgctgcttaactatatttactaatgtcagagatggaaaatacaagttattttaatgtcataagctcacagtaattttttccaaataagattatatattgctatgctctacttttctcaaattatgtgattttattgaaaatgaaaacttttattttggaattgaaatatttgaccctcttctttctgcttaggggaattatttggaaagatttcttatgcctagttctgtagggttccaaaccatgtatactttcacaaaatgcatgtgtgcaatagcacacatgctatttccagcagcaagttgaatccttgtatctagcactgatggtcaatatgttttgcattttgctttcccacctccaatgaattagtataaactatgaccttcattgatatttctttagtttttatatttgtatgaatcagctacttcaaacccttaataaaatctacaacctctccaataaacccaaagttactagatggaaggaaacaaagattagagcagcaatcaatgaaatagaaacttaaaaacagaaaagatcaacaaaactacaagttggttttctggaaaaaaataaacaaaatcaataaaattttggctagactaagaaaaaaaaagagaagactcaaataaatgaaaccagaaatgaaagaggagacatcataacctataccacagaaatccaaaggatcacaagaaactgttatgaacaattacacagcacacattgaataagctaaaaaaagaataaattcttagtctcatagaacccaccaaaactgaatcatgatgaaacagaaaatctaaacaaaccattaatgagtgaggaaattaaatcaataaaaagcctcctatcaaagaaaatcccaagacctgatagctttactgctgaattctaccaaacatttaaaggataaaataccaattttttgcaaacttttaccaaaaaatgaagatgaagaaacattctcaaactcattttaccaggccagcattaccctgataacaaagccagaaaaagcaccacaagaaaaaaaattacatgcccatattcctaatgaatatagatgcaaaaaccctcaacaaaatactagcaaactgaattcaacagcatactaaaagaatcattcatcatggtcaggtgggatttatcccagagatgcaaggatggttcaatatacaataattaatatgatgcaccacattagcagaatgaaggacaaaacccatatgatcatctcaatagatgcagaaaagtcatttgacaaaatttaactttctttcatgaaacaaacactcagcaaattaggtacagaataaatgtatctcaacacaataaagagcacatacaacaagcccatagctgacatcatattcaattgagaaaagttgaaagctcttcctctaagattaggaagaagacaaggatgcccactcttgccatgtttattcaacatagtactagaagtactagccagaacagttaggcaagagaaagaaataaaggcatccaaattggaaaggaaaaagttaaattgtctctgtttgcagatgacatgatcttatatgtagtaaatcataaagactccatgaaaaaactgttagaactaaaaatgaattcactaaagttgtaggatacaaaatcaacatacaaaaatcaacagcatttctatatattaacatgaattatccaaaaaggaaataaagaaaacaatttcatttacaatactaaaaaagaaatacttaagaaaaatttaaccaaggaggtaaaagtttataatgaaatttataaaacattgaggaaagaaattgaagaacacaagtaagtggaaagatatcccattttcatgaatttgaagaatattgttaagaattcagtactacccaaagtgatctacagatttaacataatgcctataaaaattccaataacattttttacagcaataggaaaagtaatcctaaaattcgtatggaaccacaaaagaccctaaatagctaaagcaattttaagcaacagagagatatcacatgacctgattttaaaacctaccacaaagctatagtaataaaaacagcatagactagcataaatacagacacatataccaatggaacagaataaagaccccagaaataaattaatgcatttatggtaaataggtttttgacaaaggtgccaaaattatggggaaaggacagtctcttcaagaatgtatatccatacatagaagtgtgaaactaggctctcattttacaccatatacaaaaatcaattccaaatgaattaaagacttaaatgtgacacctgaaactgtaaagctactagaacaaaacatagggaaaatgctctatgatactggtctgggaaaagattttttggctatgaccccaaaagcacaagcagcaaaagccaaaatagacaaatggaatgacatcaaactaaaaagcttctgcacaacaaaggaaacaatccaacagactgaagagacaacctatggaatgagaggatgtattcacaaaccatacctctgataagggattagtgtccaaaaggtataaggaattcaaataattcagtagtaagaaaacaaataacttgatttaaaaatggacaaaggacctgagtagatgtttctcaaaagaaggcatacatgtgccaacaaatatatttaaaaggtttaatatcactaatcagggaaatgcaaattaaaaccataagataccacctcaaacctcttagaatggccattatcaaaatgataaaagacaacaagtgttggtgagaatgtgaagagggaaccattacacattgttggtagaaatgtaaattagtacaaccattagggtaaacagtatggaggttcctcaaaaaattaaaaatagagctaccatatgatccagcaatcccactattggctacatatccaaaggaaatgaaattagtatgtagaagagataagtgcactcctatgtttaccgcagcattattcacaatcgctaagatctggactcaagtgcccatcaacagatgaacaggtaaagaaaatatggtatatatacatgatggaagcttcaaaaagaaggaaatccagccatatggatgtacctggagaccattatgttacataaaataaactaggcacaaatcaagtatcctatgatcccacttacatgtggagggtaaaaaagttgaagtaattggaacaaagagtaaaatagtggttaccacagagactgggaggtggtgggattaggtagatcttagccaaaggacacaacatttcaattagacaaaaggagtaatttcaagagatctattgtacatcatagtgactacagctaatgacaacatattgtgtatatgaaaattgctatgagagtggattttatgtttccattacaaaaaaagataaatttttcagataacgcatgtgttaaatacctttatttagccattctacaatgtgtactgtgtatgtacatgtgtatatgtatataatctcaaaacatcatgttgtacaccatacatatatacaatttttacttgtcaatcaaatagtttttaatttttaaaaatttacaccttccttttggaataaatatcccagctctcaaagctgataagtaatgaagtaaggatgaagctacctgatttggctgatgtatggtccagagaaggcgatgcatatgggacaaaatcatgaattaaaaaggcaatttttctttagattaaaaaatgtcaacaaatagcaatgtttgttattctaaggaaaaattatttatgatacatgaaaacataaagaacatccaaagctgagaagtattctttcttcattctttttatagtcttcatcttaagtgacttcaatacataccatttatcagcatgtctgttacatcttatattgaactgtttccatggaacatctccatgggtcagactgtagcctcaaagatactacaagcaaaagagaatccagcagtgtagtgggagaaggaggaaaaccttccctgactgcttggaaattgatgtatttatgacatgaagaagttaaaagactaggccaagaggcacaggatccagataaaacaacttccctcgggttccagagacatgaaaataaagaatttatagttatcaggaaggaggtaatttgctgaaattcccatcacagatccaaaaacgaggaaggaggcagacatgtgttaatagctccgaagtggcctggaagtcttattttgccagtgatttaactgaagatcaaatacactcatgtaaggaaagcagagaaagcttgcataagtctctggcctggacctggaaacccagtctgctttatttccttgggggagcaggtttcctaattcttccacgacatttgttggttaaatgttgaccaacaaaagcagaatgttacattgtgtttgatgggaggggaaagtccttgttttctatctagtctggggaatcatacatcaatccacacaggaatatgcatcaagtgtttccatcttaatgagtggcatgattccagaagggcaacaggccaggagagctctaaagcttccctgaaaaaatggagaggctggttgtgttttgttcttgccttggatggatgaagaaatggaagcaggtgccccattgggaccatggatcaaatgcacttaggaacttaaaggaaagtctaggggctctgagtgaaccagcacctcctgccctgctgggggttagaggcttcactggctagtccgaagcctagtggttttgagtaagaaaagaacttcaaaacattttactgtgatttaaaaatcctccatggtgagcatgcccagcttttgttctctcgatgtacctccaatctctcaagaagacataatttagtaacgctggggttgctgctactataaatgctttgattaacattagaggaagaggacgacagaaagcagcttctgtcccagccaattaaagagcttgtttaaagtatgaaaatgatttattagacatgcaaagagggttgcaaagaagaaagacacacagtctcaatttaaaaaaaaaaaaaaaaaaaacaaccacaaagctttggtccaggtgcctgccttctgacaacacagataaacagtttagttgataatcccccacatcttcttcttcagcacagcaatttgttccagttatcatactttctaaatagaataaaagaaaatgatgctcctttataatatatatagggtttagataaaaataaatagcacagtccacatgctttaaaccaaagattgagtctgtgtgaacagaaataccagatagctgtttgatacagcatttcccaaatagatatatctgagagctctgctaaaaaaaaaaaaaattaaatttttttaaaaaggaaagctagaaaaaataataataaatagagccttgtgatcatatatgtgcatcaacaccggctatatactcctttcggaaaatcacaatgtacgtgactcttgcagtaaagaaatgtgtttaacatttttacatttttaatacagcatttctcatacatatttgactgtagaaaccttctctgatatgacgactattgtcattccctagaattagtattctgttcaacatacttggaaaatacttaactagccaatctatttacaatgggaagagctataaagtccctcagtcattaacagctaatacacttgaaagattgttagcagaaaaaggaaaacatgacgtcaggaagctggggccatggattttgtcccttacacataccttcgttttacagacatcacaatgacaaattcaccctgacccaactgaggtcacatcagcaactgaatgtaggtggattgtctgaaacccattaccgttgtccacccaccatcatagaaaattattttaaatgtatgtattatagtaagagtactcttgatagtattattttttctttctttcttttgagagagagtctcactctgtcacccaggctggggtgcagtggtacaatcacagctcactgcagcctcaacctcgcaggctcaacctcccaagatgctgtaactacaggccagtgccaccgtacctggctgattttttgtattttttgtagagacaggatttcgcaatgttgcccaggctggtctcaaactcctgagctcaagcgatctgcctgccttggcctcccaaagtgctgggattgcaggtgtaagccaccacacccagtggctaatattacttaaaccatataaaactaggcagtggagaaagggagtaagagtacaggctccagattcagacggactttctctgaagtccctcctactgcccatggggacttgaacaagttacttaatttctctataagcctcaatggcttcatctgcaaaggagaataatgacagcatctattttttaatgttttgtgaaacatatggaataatgcatagtaagtgcatagcacagtaaatgacacatattaaacatagacaaatattagctgtaatattttatcatcattttctttacaaataatagtgtttttggtaactaagactaagaagaaaagaaggaagacagaagttgaatgtccttgcagatggggggcaaatctgctggcaagatttgtgatgtgtgttgctaattatctgtgattaactggttaatagattagttaaatcatcctgttggctctgcggaggatgatctggaaggggtggtactagagtcagggagacaaaagcagtgggaaaagataacagaggatgactggagagactttggagctggaattgacagaatttggcacctgattttgcatgggcatgagatttctggcttagaagagaccctgaagtttcataatatggacggtgatattactaagatgaagaccacaagagaagccactcttggctgagcgcaatgagtttggttttagacttgctcttgcaagcttctggtaggaaatcttaatagttaagcacgttctgatagaattttggcacttggctctaggaaggaccctgattagacatagatggagctatcaatgggaagatagttgagatcacatagataaatgatacacagagagaagagcacagtggcatagtggagctcagaggaatgtaaatatttaagagataataagaggcagtggaaccaatgaaatgatgaaccgagagtaaagtagaaagatgatgagagagaataacgtcctgaaagttaaatgagcttgagtcaacaagcacagaaatcagggctacaggctacatgccaagcctctgaacttcctccgtcctggaccatggaccaagctcagtcctgttttccccagagacccacagaaacgccagtttgcctcctagtgtaaccctgcaaagaaagcaatgtcgttctgcatcaatgctgatgagcctgcgctgttcagtatctgtggggcttgccaagctactcctgctcatggaaacctcagtcaggagcgaggattccttggcagatcgtccctgtgttctctgcatgaggtctctgatctggctgcaccaataacaagaactaatgtcatgtttacccttcacaaagttcaaaataacggtacttcgaaattagccaggcttctaataagcagtctgagaagtacacagactccaaaacagtgtttgcagagcttctgtagaaaagatcatctgcatcagaggcagctgagatcctaatgaaaaagaactgcaagactgagtgattggaaatagctagggttatggctcagcaagctgccttttcagcaagccttgcagatgattctgatgctcaccaaagtttgtgagccactgatgactacagaaatagaatatcaggctgaaacacacaaaaagagcaccatcggggaaaaataatatgaagaaaatactacatttttagtcctggtccctaatccttcaaagagttgttatgctttgtggaaactaatcaggtctagtctcccacctttcaaattatttctgttaaaatgttctcccctcctgcccagaattttctaatacacagtggaatgctttattgctctctttaagcatgtcaactagagcaggagaaaagtttcccatgtattttcttcaaagaaaaagatgtttaaagtttaatattaaaagaaagagtcatgaagtagtttaacatttttttcacagggcgcagagagttgcttctgcatggttatttttactaagtactttccaatttatactttatttttctcaagtataaaaatggatcttcctacttaaaaacaccaatgtccaacttcatggtcaaatgtaaactttggaaattattacttgatttctgttagtggaggaattagaagagtttttgttccactatgttattccaacctcatctcctcgtttgtcaagattcttaagctgaacgtttttctgcgtgcatgcatgcatgtgtgtgtgtgtgtgtgtgtgtgtgtgtgtgtgtggtcacagtgaaacatagattaaggctgagaagtaacaaccagctaattattataagtatagatataggccatggatattaaagtacccccattttgtgttgatacatgaaatcatagaaatttcatgtatcatagagattaatcacatagagattaatttagaccataaaaacatttcaattttcaggaatcccttattaaaataatttttgaaaaaacaggggtgaatattcatgaagccaccacgtcataaaggtttggttgatgaatagtgagagtaggggtgaatagaggtaaagcaggagacacattggcaaggtcagggctgcaagagacaggagagcatcgaaaccaaaccccaccttcccacactcctaaagactgtccagtgagtaattttcccatttatacaagagcctggtctatgaaggcaaataaaatggaaggatttaccctcactgggcattgaagcacaaaccttgcccaaggccctgtcccgagcaaaagagcttccctactgggaaagatcaagatcttaatatcccttaatataactcaaataatcattagccaacctgagagaagaggacaggctctgagtctgaggagaagggttggaagggtctggttagtgcctgaccttcctataatataaagctacttggagatattagagctagtgaatgccttctcccagccaaatccatgctccaggaatgggcacagagttgcaaactaaagatcaattgttcatcgtggtacatgtctttgtgaggtattatgggacaaacttcagttcatatgggaaaaccgaacccttcccacgtggtccgtgaaaacccagttgcacattttcagacaacttctttatgagtacagggcattaggaagttgaaccagcccggccaatttagaacaactggtctctttaacatgagcattccccgtcagtgctaccaaactcctttccatgtgtcccatgcaaccagaaaatgtgttgtttaaattcagctcgtgtcatttgtaaaaaaaaaaaaaaaaaaaaaaccataaaaaataaaaataaaaataaaaaaattaaatagtttgacaagataaatcagggactttggaataaagagttagtaatatgttgagtagtttgtcacatgatatcatttttaagctactcttttttgggggggcggggcacggagtcttgctctgtcgcccaggctggagtgcagtggcgcgatcttggctcactgcaagctctgcctcccgggttcacaccaatctcctgcctcagcctcctgagtagctggaagctactctttctaaataacttcaacaaatattactgatgtgataacaaggcttgatttcatcaagcagtaactctgtctccatgtggatagcggtcttttgaagccctcctcggctgttagagtgcataacccacagctctcaaactggtggagacaaggtggtatgtttgactaattcagtgacgttcggtaagcacctactatgtgcccagcaaggtgtcaaaaacagagcaaagaacaaaataggcaaagtgattgtatatatcactttttatcctaggtcaggataagcaagcagtacataaatttttaaaacaggtattttaggtagtgatacatgctataaaaattacatggatagagaatgaccaaagatgactagattgaatttaccacttctttgagtaggtggcagtggttcaagttggtgactgagttctaaacgatgggaaaaagacagccctgcagtggtatgtgggaagtgttctgggcagaaaacatgttctgaagctggaacaagcttggtactttaaagaaaagaggctgggcgcagtggctcacgcctgtagtcccagcactttgggaggctgaggagggcagatcatgaggtcaggagatcgagaccatcctggcaaacatggtgaaaccccacctctactaaaaatacaaaaattagctgagtgtggtggcacacgcctgtagtcccagctactcgggaggctgaggcaggagaatcgcttgaatccaggaggcagaggttgctttgagccaagatcacgccactgcactccagcttggtgacagagcgagactctgtctcagaaaaaaaaaaaaaaaaaaaaaaaaagcatgcttgtgtgactggagcctaataagcaagtgagagaatagaattggatgatttcagaggcagagacaaaatataaggaggtcctagctgggcacagtggtgtgcatcatagttccagcaactcaggaggctgagcaaggaggatcacttgagcccaggagtttgagtccagcctaggtaagatagaccccatctctttaaaaaaattttttaaattttcattaaaataaatataaggtctttacgtgctatgtattccatgaagtccagagctatgaatgccatagagtaggttctcagtaaacatatgagacaaaatatggctgagggtgaccttagatcaggctttctgaatcttacagaaaaatcttcttttgaatctcttttagctgaactttgaagagaaggataaagtagcatctgtttcaggtgccagggaagcccagaataaaaggctcaggatgacacagccgcatcaacatccagtgtttattggccatctgtcccctaggaatgtcttaagagctcatgctctatttacgagaacagccggggacagtgagaggaaggaagaaattgctttataaaaaagagtagctgcattcttttgtgtgtggaaagagcactattgtggaagcgacgaaacccaggtgtgtaaaaatagaaccgagtgttcacattaaactttccgtgcctcagtttccccacatgaaaagtggacataataacagcacttgagtgagaattaattgagataaaacctgtgttgaaatactgcttagaacatgggaagggtctgagctactatttattaataatgccattatcatagattttagctacatttattaataactccatgaatttagaatgttaatggaataaggattggagaagaaaaatttgctatggccagtgagaattccttgcaagaaaaaagcattgcaattgtgtgtgtgtgtgtgtgtgtgtgtgtgtgtgtgtgtgttggatatgggcagttgtagtgtggaacacctcagcagcacccaggcctcacttgtggatggtacaacctcaggaaacttactcttcctcagtataaatgagaaggtccccttttcccccaatggctgcagtgttggtctaggatgaggtcttctctaccctcatctgcgtagttccaggatggactttctcctcaaaatcacagtccaataaacaaaagtaatgaaaagggtctaacttccgtttgtatctcatgaggagcatcaaaaaccagttagttcctagcatagcacacagcactcttgaattctttcagccattcccagggccctcgcttctctaccctgcccctcccatccctgtcaggtcctgagctcctccttgctcctccctccttttttttttttggttttttttttttttttttttttgagacggagtctcactctgtcacccagacttgagtgcaatgtcacagtcttgggtcactgcaacctctgcctcctgggtttaagcaattctctgcctcagccttctgaatagctgggattacagacatatgccaccatgcctggctaatttttgtatttttagtagagacggggtttcaccatcttggccaggctggtcttgaactccttccctcatgatccactcgcctcagcctcccaaagtgctgggattacaggtgtgagacaccgcgcccggccacgctcctccctcttttgaagacttgttggactcttgtctttccttctccttcctctttccttttccttttgttctgtctaaactcctacagaacaaataaatcaatgaacgaaacacctaggtccttcccagtgtgaatcctttccattaccatccacaaaggtgaccaccattaaagctgtgtgtgaaggcttctagacattagtcctttattctgagtttaagcaaatacacacacatacagatgcatgtatgcatatgcgtgtatgtgcatattatatatgtggggtatatacacatatctttgtatcaggcacataaacaatgcacacatacttaataggtttgtgcaaaaaaactgcaattacttttgcaccaacctaatattactataataaaatggagctgtgatatacattttattctgaaaatagcttgtcccttaacaacatacaatggacaatttacatagatcgattttatggtttatgccacattatgtcacattttttgtccaaatgaatgcatgtttcttcaaatacatacagtaataaatgtatacattgtggttacttccattttttgctatttgaaactctttataaacatttatatacccaaaggattataaatcatgctgctataaagacacatgcacacgtatgtttatagcggcactattcacaacagcaaagacttggaaccaacctaaatgtccaacaatgatagactggattaagaaaatgtggcacatatacaccatggaatactatgcagtcataaaaaatgaagagttcatgtcctttgtagggacatggatgaaactggaaaccatcattctcagcaaactattgcaaggactaaaaaccaaacaccaccgcatgttctcactcataggtgggaattgaacaatgagaacacatggacacaggaaagggaacatcacacaccggggactgttgtggggtggggggaggggggagggatagcattaggagtaatacctaatgctaaatgacgagttcatgggtgcagcacaccagcatggcacatgtatacatatgtaactaacctgaacattgtacacatgtactctaaaacttgaagtattataataataaaattaaaaaacaaacaaacaaatcactcacaccatggaagcacaaaactaaaaagttcagtgtgtgtgtgtgtgtgtgtgtgtgtgtgtgtgtgtgtgtgtggtgttctacttgaggtagaaggtaaaagattaaggagaaaaccaagtggattgaaatctgcaataaagcgaccattctccagtactaaatgcacttgaaatttattcccctgcatctgtaggtaaatgtccttctgttcttgaaacaataaatccccataaacttcccataaagttctgcagaagtgaaatgtgagattggttcccttggaatccattcagtgctttgtttgtgcatcttccaatcttaattttagagcccttgttcttcgtccagagcccctagactgggaaaaggtcagaatgcaacatgtttcaaagctgctgtgctctgggtggctgtcagactgttggagagaattgctttcaaaacccagagtatgccaccatctactcagtttcagattagcgtaacccacagcaccatgctatggcaggggaagctataatctttgctttttgttatcatttaaattcacttttaaaaatattaagattctcaaacagccagattctgaacatgcagtcttccccattgctatcaattatgtctaaggcaaaaaaagaggaccaaaacttctattttttctaacttttattttaggttcaggggtacaggtgcaggtttgttatatagttaaactcgtgtgacggggggttgttgtacagattattttgtcacccaggtactaagcctaatacccaatagttattttttctgctcctctcccttcttccagcctccaccctcaagtaggcccctgggtctgttgtttccttctttgtgtccctgtgttctcatcatttaactcccacttataagtgagaacatgtggtatttgattttctgtgtcagtttgctggggatgatggccttcagccccatgcatgttccctcaaaagacatgatctcattcttttttatggctgcatagtattccatggtgtatatgtaccacattttctttatccagtctgctactgatggacatttaggttgattccatgtcattgctgttgtgaatagtcctgtgatgcacatttgtgtgcaggtgtctttataatacaaagatttctacgcctttggatatatacccagtaatgggattgctgggttgaatgcaaaacctcaattttacaacttgaaatattgaagcgggaaatgtaagtgaaatcccaaattggcatgccatactaaatgttattgtaataacttatttaatatttgattatccaagcacgtacttttgtaccacattctgctcaataaatgtagaaggaagtgccgccattttggattgcagcagtacctcttcgtgcagtgaaaatcttttatgttgtggcccagccagaccctcagtgcagtttgcatatagctttggggcctgtagtgctgtggtaaccattgttgaaccccaaatatccaagacaggtctcagtcaatttaggaagtttattttgccaaagttaaggttgcgggcccatgacacagcctcaggaggtcctgatgacatgtgcccaaggtggtcagggcatagcttggttttatacattttagggagacatgagacatcaatcaacatatgtaagatatacattggttctgtccagaaaggcaggacaactcgaaatggggagggggcttccaggtcataggtaggtaagagacaaatgcttgcattcttttgagtttctgattagcctttccaaaggaggcaaacaggtatgcgtttatctcagtgagcagaggagtgattttgagttgtgtctgtcctttgtccacaaggatattccttgtgagggaggtatgtagctttttttttttttttatcttagtagctatcgtttttaggaatacagtggaggcaggtttgccctaagcagtacccagcttgacttttccctttggcttagtaattttgggggtctcctttcacatcatccacgcagcagcaacttctggtgaacacactgttcattattccaggcaccacttatgcagtctgtctttccctgatacaaattctcagatttctttgaaattaaaactgttctaaatctgcatactggatattacttcattcacattatatttattttaattatgtaacacaaagttgtaaaacttctgttagtcttaatatagactcatatatgtcctgtgtcatcaatgtgaattccattttcaatcctcacctcaggatgattacgagcaaagcacagtgtgtctaagctccaatgcttcacactaaaaacagcaacaaaggccaccagttgcaaaacagaatcgttctcgctctcagatgtgttctttttatccttaaaatcagagcattcatttccgtttggatgcactatttatttttatatcagaaattattttcacttagcagttgaatggaatttgtttgcaggctttctttcaatagtatttccttcttcttgaggatatatgaattctaaggaaactgcagcacattttgtaaaaatccaaaccaattatctcacccctgcctacaaagaagtctttgttatttttctattattattaaaatatatcagcaagattttttggcctttatagttctttggtatttcaaaatgcttctgtatgatgttattgctttaaatcatcacaaaccctgtgaagaaagaattatttttctaatttacaaataaagaaactgaggtcttagaagactgaattcatttcctcgtctctctttctttgcactatgggttatcttgatgctttactgatcctgctctcccctgagacatgtggactctgttactgttttcagcaggaaaatcatggttctattaataggacatgtgaatctttttatttcctgtaatgaaaagagcacaaaaaggaaactttgatttgtgtaacgtaatcgtatggatcatatcaacccattaccctgggtatagagcagtttcccagtttcacatccgtcattctgctgaaatgggtggcttttttccacattttactcacctgatggatttgatataaaacctgtttttctatggatgtgaggctctggaggttttgtagtctatcaacacataaaggctgcctggcattacagcactcctgctctgcacagtggtggagtgtagctaaatgcagctcagtctttttacagctcagctatgaccatccttcattacaacagggcagatgataaaatggaaacttaatgctattagatcatgaattccaattatatgaagagagatggaggtaagagaaattagatgccaaaaggagatacaataaagacagaagtgacgttcacagggctggcagttctcagaaccattgtcacccatcattgtcagtaccacctgaggacccggtgaagatgactagcatatcagatatctgagaagggaaatgctgagtgtgtccaaacatccaaacaaataatgccaaacctagaaaagcttctgtccatatgggttaaatagctcttcaattctgaaactgtcaaaagtaggctttgcagatggtcatgtcaagcaatgataataactggtagtggaattcccatggttcaaatttattaaaaaaaacacactattttcatttattcaagaaacacatattgaatacctgtgtgtcaagctagatattacagttagaaatatatagaaagcacaatctctgctctctgaaatttgcagcctagcagaggagaggaacacatgaaagtaattataataacaagttagatgcaatgatagatacaagatatcctaggaggacagggaaatagtaccatgcccagtccggggatacgtcagaaagactgtctggaggaggtggcatctgaactgagtcttaaagaatgagtagaaatcaagtccaatgtggtatatgaactgagagagagaaggggaggatgttgtagaaaaagacaatccaaaaagaggaaacagtgcaaataaagctggaatccacacacaccattgtcatggtgggaacaatggtagctgcatgttgctgaaatatacattctgaggctaggagtagaaagagataaggctggcaaagcaggcctatgcttactatgccatgtcaccgagcttgcaatactatatattctgcaagctatttggaaccgttgggatttgatgcatgagagtgaaatggtcggttttgcattttattttattttttattttttttttttatttttttgtgatggagtcttgctctgttgcccaggctggagcgcaatggcacactcttggctcaccacaacctccacctcccaggttcaagtgattctcctgcctcatctcccaagtagctgggactacaggcacctgccaccacactcagctaatttttgtatttttagtagagacagggtttcaccatgttggccaggctcgtcttgaactcctgacctcaggtgatccacccacctcggcctcccaaagtgctgggattacaggcatgtgccaccatgcccggccttgttttgcattttagatggatttctctgttggctttatcaaggatgaatttgagatgagcagcagcaggaacagaaccaagttaggaggctgctgccacatccaggcaagagacaatgcagagccaaggcagcagaaggaatggagaggaggagacacagcacagactatttagaaggtgtggctatcaggccttggggattgactggatgctaaggaagggctcccaggttcctgccttgaatggcagagtgggaaaagctctaccttctgagatggagaatactgtggatatagttaatttggaagaaaaatgcttgctttcagatatttagagttagatctctactatgagtttaaggctaaaataggcatttcttactggacagctttaccttgatgatttatactgaagatctaacttatgcacaaatttgggaatcgttaacatatgattagtacttgaaatcatgaaatgggtgaaaattactcaggaaaagaaaaaaagcataaatattcatccctgggacacaggaacattttgaagttgtcattccccagagtcacccccacccccatggcacttcagtgtactgcacactttgagatatatatatatatatatatatatatacatatttttttttcctaataaatagagacgaggtctcactatgtcgcccaggctggtctcaaactcctgggctcaagcaatccaccggcttcagcctcccaaagtgctgggattatagacctgagccactatggccagcctgatagtctactccttaacctacaggaagcagacatcaatttgttttacaacctctacatgcaaaaaatactacatagtcttatttttactaaatcaaaactttgtttcttgctaaatcttcttcccctctttgccagggtgtaaaagattcagtcttgttattccccgctttctggaatcaatcacatagcaacctttagggcttacccaggacagaaattggagtgaggacaggaaggccacaagttcccatgacacacctagctattcacgtctccgcttctagttattaactttgagccccggtagacctaggattactcaggcataaataatagccccccaaatgaaaagtgggaaattgtagagccctaatgtggagagcctgaagagcttcataaaaaaatcttagacttgttcccaccctccaaacatgtgaaacacacaactgtttcaaacattttaaatgtaccgaaattacctcataagtaccctttatatttaaatgcactaataatgggattgacatgtaagaatttccatgactaggaacaagcccgttttaccacaagccccagaacctggctataggtcagctcacagcagtgcaggaagcacctcaactgctttcaccagcatattctttttctctgtgggaccccatccccattctagcccaaaggacccgaatcacagagacacacagggtgaaatatttatgttgttgactcctcccgcaaacttgtcctctgatcattttgtgttgcagccgtgaaacaggcttgctggacgggaagaaatgctgcagagagagtggctgactcaaacccatggacagcattttattaataacttgcagcccttcattctaagtgaagcttgcccaataaaatgaggcctagagctgaacaaagctcctcttacctaacctgaatgtacaaaaaaggtttaattaaggaagtaatttttttctcccgtaaggaaatcttgacaaatagactcaaatttgcatgcaaatgaagccatctggttgattgttgtccacagtccccagctcacaggaaacaatagaaggccctttgcataactcagagaatctgcaaatctctaacatttgggtcactaataattttcagagtaattagtctcttcagagctgctatttacattggaaggtgtttgccatttacagcagaagctatagatattcttctaggtgcagccccagtgtgagccatttggtgacctgaggaaatcactcaatctgggaggggaatgacaagaccattggccactggagccagcctggcagcgacactcctcaccaaactgcagcccagagtgccttcacgcagtcttctccatgcgagccaaacgcagactcttctagccaccatctcttcccccttcctaattccccatctcccctctggggagggaggagacagggcaggggcaggcacaccaggcagggcctctacttctcatcacctgtctctgctactctgcagttatctcccgtaaacatttgttcaaatgcaatcatgtccattgcttgggtaactctaccttcttagtcgtcaggtccctcctcctttcatcagatttttacttaatggctactctacaaagcgtaacacagggctggtgctcaaggatgatagctctgattcatgtgtcctgaatggaattaccaaaaaattaaaaaaaaaaaaatcagtggagatgaagagatagggagtacagagttttggaagctagtgagggagcagaggaaggaaagagatgacgaggacaaaagggcagacatgggtgaggttgagaggagtaaaccagctgaggaagtgaccgctgcaggcttagctgtcaatcctggggtttgctgctccccgtggttggaactggaggacataatgctctgtgaaataagccaggcaccgaaaacaaatactgcaagctctcatgcatgagtggaatctaaaacaacagactcagagaagcagagaggaagatggtgggtacagaggctggaaggtgcagggaatggggagatggtcaaagagtgcagttaggaggaacatgcttggttggttaagttgtattgcacagcttggtgaatgtagttagtaatagaatatgtatatttcacaattgctaaggatgaatttcaaatgttcttatcccccaaaatgttaagtatttgaggtgatggatatgttaagtaccttgatttaattatttcacttcatattcataaatcataacatcactttgtaccccatgaatttatacaattatacattgtcaatttatgatttctaaaaaagcattagtacctgtggtaaatcaggctcaggggaaaagcctcagggtttgtcgtcttactgttcacacattgaaggaaaagaggctcctcttccatctttccccattccttggccaagcccttgcacaggctgactgtaagtgaaattaaagaatatcagtgtagtagtaagtaatcacatttgttgatcttttgttttgtgcctagcactctgctaaatgtatttcatgggttatctcctgagattcttaccataccctataaaagaggttccactgttattctgttcctggaccaaatagggtcgagctgcttattctcaccacccaataagagatgcagatgaactgggaaagaagagaggtgttttgttttgttttgttttgttttgttttgttttgttttgttttgtttgagatggagtttcgctcttgttgcccaggctggagtacaatggtgcgatctcggctcaccgcaacctccgcttcccaggttcaagtgattctcctgcctcagcctcccaagtagctgggattacaggcatgcaccatcatgcctggctaactttgtatttttagtagagacagggtttctccatgttggtcaggctggtttcaaactcccgacctcaggtgatctgcccgccttggcctcccaaagtgctgggattacaggcgttgagattctatttctgtaactgggtacagggagaacacctggaaattatcgccagatcaactcaaacttacaaagttttccagagcttacataccttgtaagctatatgtctatgagtaagtgtgcatttatctaaagacataagtgactcacttcttttaatttataactaagatctgagtcctgaagaccttcctctggagcctcagtaaatttacttaatctaaatgggttcagatgctggactaatgacccttgtctcctgctaaatcatggaggtttggggagttccttcagacccccattaaacttgtttgtggaggcctggggagtttcttcagacccccaatgaaacttgtttaatcctaaacaggtcctgttaagaattccttcattatcttgccatgtttcaaggtccagaaaaggcctaggcaaactctcggtgggcttttgttacatcctaacctttgtataagggcactgcttctttcagcttttaatatttaacttaaccattcagtcagtgctgaaacagttgttatggaggcctgcattagtaagacctggtctgccacaattccactgtacacatgaggatttaggaaggccaaatgatctgcctcacgttgcccagtaggtggagatggtagagccagaatgggaacctggaggtcggcttcctcagcctgcacacggaaacagtgcagggaagcttcaccaggtgacagcccagagcagcccagggactcacttcctgtcatcactcccaccccccaccacctcatcctggtagtaccacccgcgccaatgcttctagggctcttgctggacccacaggtggactgtgacttcagtctgttacctccttctcttcattctccacgaaagaacttcagcacatcacaagttcagttacttcactactggcagtaaaggaaaatctgtaagtccaggctgttgacaggcaggtgggaagcaagctgtggagctccaagaggcccaggaaccggaggcaggcaagggccgggctcagagccggaggaatggcggaacgtctatgtgagggtcagtcacaccccagctccccgctatgaccctgccagtgactgtcctactctacccatgcaggaagtgggggttcacactccagacaccaggcaccaaaaaatgggggtaaagctccttaataaaaacagaggaaattgacttaataaggttgacccctctccttagccttcttcctgtcagcttcccaagcactgagcaacagacatatattcctcatgaggaaagtagcggattcttctctcaagatattgaacattcagtgaccaaaacaagtcacagatactgacattcggagtcccttcaatgggacaggggactctccatgtgatcatgaagcccaaacatcaaatccaccaccatcccagacacacacactccagattgcagtcagctgtctagtacttgactgttcggtataaacagacaggtgagagtcaccaactatgtaggataatgtcagagatgtcataaaagaagggacccccaaactcacaatccagggtaggggtgggtggcaggaggtctgggaagaaacagaggcgacagagaaagcagaagaaaacttttgataattaaattaatattctcagagagacaagagaagatattgagatattgcctccaaaaaaattagaatggggtgctatgaaaaaggggactatcagagaacgagaaataatacttggaaatttaaaatatgatagctgaaattaaaacacaatgacagtattgaaaataaagctgaggaaatttccaaagaagtagaacacaaaggaaaaagatcaaaatgtggaacaaaattagaaaaaaaaaaatctaaaataaataggtgtttgagaaaagggatcagagaaattattaaagtctcagacctcatatgggagaaaaatctatatcaaggcaatcatgaagttccaattaaaagagttaaagaaaagatcctgaaagtttccagaaaggaaaaaaatgtaggttgcatataaggcttcgtaaacagaaagcagttgctttcccggtagcagccctgacagcctgacaattttctttctggagtttctcaattaagtgcgaaagtagaataatgactcatcagaggaacatgggtttagaaagttaacctcgagtatctcttttctcaaggagctacctgagaatgtgtttcaggaaaatgagagtgtagacctaggaagtggatgtcatgagatcctgaaacttggggatgtaataccaaagtgtggcaaaaggaagtccctgcactaatggcagagggaggtcccaggacaagggctgtgcaggaaccctgagaagaccccgtccaggtgggaacagaggaaagagagccatagaagatgcctccaggggacaaaaacgtgactgcagatggcctgatgtgtgcaatgttggaaaatgtttgagaagagttttactgctgtgttagagaatctggagagaattcgtggcagatacatagaaaaataagcaaatgaaaaaaataattatggattttaaagaaactaaatacaagaaaatacaattgcaacaaacaaaaatataagaaaatacaattacatacaacaaaatgcaagaaaatacaatttaaagaaaatacaagtagattttattggttggcttttaaataatattacatagtcctaaaatatgaatactgtgctaaattttagtattattattattattattattattattatagtgtcttactgttgcccaggttgaaatgcagtgacatgatcacaattcactgcaacctcgaactcctgagcacaagggatcctcctgcttcagccacccaagtagctagaactacacagctattttttttcagagacaggatctcactgtgttgcccaggctggtcttgaactcctggcctcaagcaatcctcccacttcagcctccccagtcactgcaattacaggtgtgaggcaccatgccaagcttgaatttcaatataaccaaaaatctgtgatttagctatttggggagaatatagagaaaggggctggggaagcaggcttataaaagtgctaaattctcatcttatattcaggaaaatcagtagagaatatctaaaaggtataaatcaataagtagctccagaggtttttttttttaaaaaaaaatacagctgtttaattgaaagagttaaaagtgtgagaaggtgtctctaaggaattgggaaggggcgggaagcagggaactgctttttgctttagtcctagcaccactagacttttataactatgtacatgtaatactttgttagaaacaaaaattaggttgaaaatgaaatgctgtccatcagaaaatgtgctcagaaagcttgaagttggaatcctatactatcttagtctgttcttgcactgctgtaaaaaaatacctgagactgggtaatttataaagaaaagaggtttaattggttcacagttcccgcaggctgtacaggaagcatgatgctggcatctgctccgcttcttgggaggcctcaggaaacttacaatcatggcagaaggcaaaggggatgtacacataccccgtggatggagcaggagcaagagagagaagggaaggtgctgcacactttaaacaaccacatctcataagcactcaatcactatcacaaagacagcaccaagggcaatggtgctaaactattcatgagaaaccgcccccaggatccaatcacctcccaccaggccccacaacattgggggttacaattagacatgagatttgggtgggaacacagatttaaaccatatccaataccaaataatcactggtcggattcaagtaagtggctgctatgaaatttgtgtgaagatatgatagtgcattttctattgatgcttaattggggtttaaaatgatgtgatgatggagaccagcaagcctgctttgcaggctcagccccgctctcctgcactagctagaggtgcctccctggttcctcttgccacacgtgatgagccctggccttgcctaacatgcagtcacaaagcttctcatgtgattgactcacttccaagctgcagagccttcagtgtcatctcgatcattctgtaaagcttttgactccagccccgggctgggtctccagtccctctctacctgcctcattattctgttactgttgactgacccttccagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgacttccccgtgaatgagtctattcaagagatcaaattagattgaagttgcttagtgagcatagaattagaataaatggaattgtggtctatagagatatttcatcacacttgaataactgatggaactacttttctcctctctgcggatatttctgtctgaataaccagtgctgggcctcaaataaatactgacatgttttacttttagctttcctttttctagaatcattttagacaactgcccttctgttaatacatcaccacctcagaaaataagaaggtacttgattggattgaaattttaaaatgttaattgcattcgtatcctggggatacagcctaaagagacagaattgctttgcttaaggctgaagtctggctggggactttgatctctgcaggctctcgggtccttaaagggctctcacccaattaggatgagctgaatccttctggccctgggcctcatctttattccctcccagcttcaggactctctgatgagcgagagcgtagatttaggttttctcacagaggtgcacctgaacgcctcttgctgtgtagtaaggcagatgttgaggggggaggaaggcttacccttgataactagcaacttgagctttgcaaagcgcctttctgttcctgttaccagtagcctacactacatcatacaatattctcctccccaagaagaaagcaacctatttgcctattttctcctactgaaatctatgattttatactttgtttaaaaaaaaaatagcagccgagcatggtggctcatgcctgtaatcgcagcactttgggaggctgaggcaggtggatcacttgaggtcaggagttcgagaccagcctgaccaatatggtgaaaccccgtctctactaaaaatacaaaaattagcctggcatggtggtgtgtgcctgtaatcccagctactcaggaggctgagacaggagaatcgcttgcacctgggagggggaggttgcagtgagcctagatcgtgccactgcactccatcctgggccacagagcgagactctgtctaaaaaaaaaaaaaaagaagaagcttaagactgcactaagattaggaacacattaagaacagtttttaccctaatgaagatatttacaaacatattttgcactagttccctgtttatgtattacctgcgacagtaattaataggaatgccattggctgagacagcttcagagccctagatacctagggaagcaagccaaatcctcttcaatgtaaatactgaaacgaaactaagcttatcagcaatcagaaaccaccacctaacctctaactaaagactttccacattaaccaatcaaacggtttctttgtcttgcatccacaaacacatttctctctctccaaccccgcaccccagtagacaacttgaattctggtgctgcccaattcacgaatcactgaatgtccaaataaacatgttaagattttaatatgcctaagtttatcttttaacatgcctggggacttatctagatgttgctatattctagacatttctaaaaacaaaaacaaacagcattaattaaataagaccatattttaatatttcataatttaaaattatgacttaagcatggcagaaccaacacaaagtaacttttatttgaaaatagtagctcaatttaatattgcatatgtgtataatttgcataaaaggaaggaaaaatatcatttgtgtatgaatagaaactaatggagtgcacttagttgattcattgtgccttttggagaaaagatatagcaaataccgtgttttttaaaaagcatacatttggagtttagtatcagagctcaaggctttagtaactgctttaaatcacacccatatattttagtctttagctgtgacagtaagtgtactcagaaatgtgcacattaaaaaggaatttctcccctgaagatgaagttgagagccaactcttgatcccatattaaattcttagtccatctgtcctaatggagtctgagtaacgcagtttggtgtttttattgcatcctgcgagctgcttttctcctggaaacactggctgctctgtcaggcaatgagtggggagaggcagctggtacaatcacatcttctccaagagctcaaggacagaggctggctgagagccatttggtgggctcactgcctcatccccatactatacaacaatcccacaggccagagcctcacctgcagtccccaggaggaagtaggaagggaagagaaggcaactcacctctgagagtttggcgcaggagaggtgaggaaactgccctagcctagtctggtcacttctgcctcgttcccggctcctcacctcctccaggctccgtcagttgtattcctgaagcacctgcaccaggtgtctgggtggccgttgacacaggagtgagcactggctcttccaaggcagaggtggatgaaaagcaagagcaaactaccaaaaactttgttcttactttgtcatcctgaggtttatctcagatgctgcttgcaccagaccaaagctaccagtacatatgcaggagttcaaaacagcccccacccacccacagagtaaccccaggggcttctcccaattgttgtgtctattggcatttacttcttagagtcccataggactccttggtaggaaccccaactatatcaatctttattgttatataattataaaatattgtttatcataaatattataaaatattttattgtacaatttatagaaattctatattaatatttaattttatatagattgtatatattaatactttaaatatctttatatgtaaatgaatattatatagacacacatataacttttggaaagtcaaaaatatatttgtgaggatttggtccaatgttgttcaacagaatgagagaaaataatgactattgctaatggtacttattaaactcaagcaatgggtatctgttacatgactaggctgatcagggtgtgagttaacctgatttttttgttttcttcccacagggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtgtgagtataagttgcttgtcaactcatggggagccactttcgtcacctcagggtggtccgggtcctgattgtggaaggccttttgattcaaacgtggaaggtttcctttgttccaggagcaggactagaggtggacacacaagcctgagtttgggctccaacctcagtccctgtccttgggatgctctcagggaagcaggcacatccagattctcaagcaattagtcaagaagatgagagagaacacaccgccctgagaatgtgggagaggaatgtttatcttcagcttcatgtcttgtgtggctgttttccaaagagacagggtcaaaaataggtgaggggtgtgtgcattgacccgaggagcagggagtgaggaaaatcatgtcaaggtcaaggaagacaggaatgataactagtgacatccgtgtgagttcaggaggccacggagaccacaggactgggcaattccatgacacagagtctgcaggattcctacagaggacccacacctgcccaccctctgcaagtgagttctggatgtcatgtacttagccaaagatacagagacaataagaggcagagcaagagaggatgctgcttagctcagctcagctggccttggagcaaacatcctaagggggcgttcaggcttggggagctccgtcagtggaaggtgggggttagctgcacaagacttgagaagcgcaatgcttgccctacctggaccctttaaacatcagggccccaattcagctttaggaagttacaatcccctgacttccaggccagttgattatttgcaaatgttgaactccgttggctgtgagagtcagggagactccactggctgtgagagtcggggagatcaaccacaaggacgaggccaggctatgtcccctgtccctttacaaaacctcagccttacactcagcatatcaaaaagtctcccttccggccaggcacggtggctcacgcctgtaatcccaccactttgggaggctgatttgggtggatcacgaggtcaggagttcgagaccatcctggctaacacagtgaaaccccatctctactaaaaatacaaaaaaaaaaaaattagccaggtgtggtggcgggggcgcctgtagtcccagctacttgggaggctgaggcaggagaatggcgtaagtaaacccgggaggcggagcttgcagtgagcctagattgcgccactgcactcaagcctgggtgacagagcgagactccgtctcagaaaaaaaagtctccctttgccaagtctgtcccctttaaatgagtgcttatgttcctgggtctggtctgagaatgatcccaaatccatttcccatttctgctgaaatgctattggattcacagtagcattcttaggttcaattccacaccgtcaggtaaattgctcaatctctttgaatcctaattttctgatttataaaaaggaaatgttaatttgtgggattgtgatgagaatagaatttaaatactcataaggcatttattttggtatctagtagttattgtaattatcatcttctgaggatgcccatggcagatctgatctgagccaggtctgattgaaagggaggctaaggctatcctggtcctagaattaaaattaactaattaattaaaatcccccctttactgaattctggataagaataattgaaaggggattcttgcttccctcagttaaaattaactaactgaatcaaactattttctgacttctacataagttggatcaaattttagaaagattttatggccacaaaagaaaattgccagttctatatttgagtggttctgtaagtttctataaaagtgcttggattcccccatctttattttatgtcctcaagttttgtaaagccacgcctgggtaagaaggaacacatactagatagagggagagcaggtgtttctactcagccctcggggtcaaagaatttctctactttcttctacttttttctttttttttgagacagggtgtcactctgtcacccaggctggagtgcaatggtgcaatcatggttcactgcagcctcgaattcccaggctcaggtgatcctcccacctcagcctcccaagtagctgggactacaggtgcgtggcactgcacctggctaattgttgtggtttttgtcactgcgggatctcgccatgtcggccaggctggtctcaaacccctgggctcaggcagtgtgcctgccttgacctcccaaagtgctgggattacaggcatgagccactgcacccagccactaatttctaattatgaaaaatctttagagctgtcttcagagttttccaggtctttccacagtatgaaaaccatgtggcccatggttcacagtatgaattacagcctccttttgtcaaatacctttactttcactgtatcctttactctgggcaaaaacatgtgaaacgttcaagacccagattcgagcctctaatcttccctcagagccccctgtatctactaataaccagagagggtggaaagacattttcacgatccccaaaatgtcacatattagatgcccatcattatatgtcatctccatcagggttcaaaggagcctcatggagagggaggcagacttctgtatttaagaaaaactacaaagcaaaccaaaagtggtgctttcatgaagaacatggagaaaaaaatggccatgatggaggcttgttgctgtcgctgtctcatcaatcacactttttctttaatttttttttatttttttttatggtgtctcgctctgtcgcccaggctggagtgcagtggtgcaatctcagctcactgcaacctctgcctcccaggttcaagtgattctcctgcctcagcctcccgagtagctgggattacaggggcccgccaccgcgcctggctaatttttgtatttttagtagagacgggctttcaccatcttggccaggctggtctcgaactcctgacctcgtgatccacccgcgtcggcctcccaaagccctaggattacaggcgtgagccaccacgcctggccgctgatcatactttttcagtcagacacttcgccatcaggattcctgagacattgggtagagaattctctcaggcccacttccttgtgtgaggaatcactctgcaaacctaattgttttcacaacagtggcgggctaccagaggggcctcaggaaacgttgattctgaagttaaactctttagaactgtctctatgtttttcccatttagcttgttaggccttctgatctctttctgataggaattcacattttttttctctaagcgtgtctcagaggaatttggtcacagttcatgactacatattgctttccagaatgacagttctgttaattaattacattgtgcccttctgtcaagagtggaagattctcgactcagaaaacaatgagtcagtgtacactaagttaatgagataccatcagcatcttatgcacaagtagaaaaacacagagataaaattagggcaatctcactcattagcatgctttaatggtaacattttaaccctatacttcatgtatttactattcatatttattcattcatttaatgagtatttactgagtatctactatgtcccaggtacagtgctagtgctgaggtaatttagtcaaatcaagtgtgatttctttccctcaaagatctttctgtttgttttagaaagcaggcaagtaactcaggagttatgataataacaaaaatagctcagcttcattcagactttcaggcctcgttccaggcgttttacgtgaatcatctcacactcctaaccaccctgtgaagtgcatactagcattcacatctccattttacaaacgaggaaactgaggcacagggtgagcaagttgcctggccaaggtcatacagccaggaagtggcagagctggtgtttgaccccaaacattatgtgtctgtcccaaagtcattgctgctaaccttaaagcacactgcctcacagaacagatagcaagaaagaggccgggagcactgaggggaatttttaaacctgactggcttgacaaggagcgcctcccagggatggaatgctttaattaaattttgatggataagtagaagccagtaaggtgaagaagtgggggaagaacaggagccagggaaaaaaggaagtttcaggataacaccaaatgaacgaaggtgtcggagactgaaccgaaggacccaggaggggacaggtgcagtggggaggggcaggggccagcaatagcaaggtgggcacagatgagcacccaatgcactctgccagggggagcatctgactcaacatgaccctgaaggctatggagagccagggcgtaacttgatcaggtttgcattcaccagagaaaagactggaagccagacaaccagccatgggagcctctgttaagacagaggcagaatgcatagaaagagaggaagacagtgatgaagcattgtagatatgaaagatccttcaatgagccgagatcacaccactgcactccagcctgggtgacagagcacagagcaagaatacatctcaaaaaaaaaagaaaaaaaaagaaagatccttaacagatagattccacagacattcaacaaatactcgtgagggttaagtggacgggaagatcctagaatgaaaccagtgtttctagttttgatgttgtgtgagtggggcacctttcatgaaggagtctgacattcaagagcaaaatacaaactgcattctggatattttgagactgagtctctgtgggctataggaggatctaatcaagtggacacatctagaggatgctgaatggacaagtccagaacccaacagagaggtctcagaaactcagtttgggagtcatcatcacttagaggatcaggaaataagcattcagtaccctcagcatggatgagattgcccaaaacaaatgtgtagagagaggaagcaagatgtacaagaaagacaaccagctcacacctgtcatcccagtactttgggagtagcagtaggtcacacctgtcatcccagcactttaggaggctgaagggggagtatcacttgagcccaaaagtttaagaccagcctgggcaacatggtgaaaccctatctctacaaaactaaaaataaaacattagccaggcatggttggctgcacctgtagtcccttagcctcctgcccagaggctgaggcaggagaatccctcgagcccaagaatttgaggcagcagtgagctatgatcacacagctgtaccccctagcctgagtgacagagcgagacctcgaggaagggagagaaggaagggagacaaggaagggagagcaggaaggaaggaaggaaggaaggaaggaaggaaggaaggaaggaaggaaggaaaaagaaagagaaagagagaaacagagaaagaaagaaaagaaaaaggaagaaagaaagaaaagaaaaccacattcaaggaatagaaggaagaaaactagtttgcagaaaactaacagagaagtaggaagacagtggtacccagaaaccaaatgaaaaagacatttcaaaaaggaaaaaaagagggttagatattgctgagaggtccctaaaacaaggacataaagtgaccatcagatttaacatgtagaggtcacggtcaaaaagtcaggtatcactagggtgagtggaagtggatttggagatcaagagagggtggttttgttcattctagtttgaggatggtagagactttagcattcatatagttgaaggagaaaactatggtagagaagggggattggtaatacaggagataaagggactggctgaaggagcaaggtccccatggctgtgggcatgaggtagacccagcatcgcagcacctcacaggggtgagaggaagaggcggaagtaaagagaacagcgtaaaccgcccactaggaagtgcctttccaaatcagaatttgttgttgttgttgtgtgtggacgtttgtttgttagtatttttgagatggcaaagaaatattgttcaaaaaaaatttatggagcagatatcagaaaacccagactctaaacttttcttcatcactaacaaccatggatctgtccatgtattttttcagttacccctaagggattagcttgactgctctagatcctttttctgactgagagggccatcataaccagggtcccaacctcgggccaccacctcctgagcacctgccctactgctggtgctgggaggcgctggggaagctgaggtggaaacaggagaacccagcatccacctcctagtgaaggagacaaacacattagtgacagtgtggatacataatttcattgagagctttgcaagtgccaggccctgttctaaagcttttgtaggttattaacttttgtagtttacacagcaagttttatacacattttacagctaaggaaatgagagcatagagttgacactgccgaatccagatatggtgcatttaatcgttaaaataagtaaattacaatgataggcacaaagtattatgaacaatcggtggagaggtatgtgacctatcctgggaatgaaggggaagatgagggaatgcttcagttgggtcataaaaatcaggcaaaaaagttaaaggaatggggaaaagaattctaggaggaagaggcaatgcgaacaaaaacacaggaatggggagtgtgatgggcgtttgggaaactacaagcattttgtattgttagagtgtgaagtatgacacaggcagtgaagatttggggtcaagtctcagatctcattctaaatatatggtcatctaaatatttatctagtatttattgagtacctgctatgtgtgtacctaaaatgaacgtaagaagaagacatggccccatcccagaggcacacaccatctagtgggaaagactagtaatcttaatctctctctgtctctttctctctttctctctctctccctctctctctgtctctcttttaggttcaggggtacatgtgcaggtttgttatattggtaaattgcatgtcacggggatttgatgtacagattattttgtcacccaagtaataagcatagtacctgataggtagtttttccatcctctccctcctcccgccctccacgcttagtacacgtatccatgcgtactcaatgtttagcttccagttataggtgagaatatgcaatatttggttttctgttcctgtgttagtttgcttaggataatggtccccagcttcatctatgttgctgcaaaggacattatctcattcttatttatggctgtgtagtattccatgatgtatatgtaccacattttctttatttgagactagtaatctctgttattataaaactgtgtgtgtgtgtgtgtgtgtgtgtgtgtgtgtgtatatatatatagttttttttttttttggacagattctcactcactctgccagctgggctagagtgcagtggcacaatcttggctcactgcaacctctgcctcccgggttcaagtgattctcctgcctcagcctcccaagtagctgggatcacagacatgtgccactatgcctggctaattttttatatttttagtagagacagggtttcatcatgttggccaggctggtctcgaactcctgacctcaagtgatctgcctgcctccacctcccaaagaactgggattataggtataagctaccacctacagccagcctataaaataatattttggataggataatattagaggtacgaacaatatgctgtggttacttagatgaggcaatatttacttctgactggagaaggagaaaagtttccttgaagatgctaacattttaaaagagccacaaagtaaatggaaaaggaagtttcaggtttagaatgccaaaggaaaaaagcacagcatcatagatggcatgaacacatcaaaaaggtgtggctccgtcatacacccatgctgcgagggttacggaacattagttaccattatatctccagggtcaccacaatgcctggcatgtggtaggaactaaataagcatttgttgaatgaatgaaatgaatgaatgaggtgctagtctgaatggagagccccagaaaatctaggtggagaagcagatcaccacgactgaggtgctggcgatccaaatatagacaaggaataatatgtggaaaggtggaaggacaggtcacggttagtgaaattttggaactcacgatttcacaggaaagcagtttgggcggtaagaagaatgaaaattgaaatggaattttgtaggttgtatcaaaaggctgcggagaaagtcagggcactgggaggccagagtagtgttggttggtcacctatgtcactgttgaggtcatcaatggtgaagacaagaggtgaaatggacagggaatccatgacccaaactttactgtcctggggttcaaacagtgaccacaatatgaacggggagaggacgagtcacaggtggacgcgaagccgtttgaagactctggagccatagagtggaagaagtacggagaagggaagaataggccaactgttcgcctggccccaagatatgggccactcagaaaaggggttacaattctaagggttgtaagttagggtccccttagggtggactgcaatcagaggaaggaagtgtttgaaagtgtttaatgatacaacaaatagtgaccatagagtctatttttgtttaacaatttaaaagagattttagtctgggcacggtggctcatgcctataatcccagcactttgggaggccgaggtgggcagattgcttgaactcaggagttcgagaccagcatagccaacatggcgaaaccccatttctactaaaaatacaaaaattagctgggcgtggtggcacacccctgtgatcccagctactcgggaggctgaggaacaaggatcacttgaatccaggaggctgagattgtaccactgcactccagcccaggtgacagagcaagaccctatctcaaaataaataaataaataagattttagaggacatttgtgaaggggatttttggagggaaattttgaaggaaaagctcactgagtaggtaacattcaggaaaagcaaccagaaactgttgtaatactttaacataagcttccatgttgcccaagtttgagatttttaaggtatcaggataacttggagggaatatttgcatttagcagacatatctccacaaaaatgtgcaggcagcggcctaatgtcctactaatcttaggaaataatatgaggaaaaactttcatgttcaagatgcagccttatgcaatatacatgctcaagaaagtcagaagaaaatattctgcaatatacagaaactgatgagtcagaagaagtaaactaatggcaatttatcttccagtatttcaaaattggaacaactttttatttttaaatagtttcactcttgtagatgtgaagaatgtctaattccacttaactgggctgttgttctgttggggtgttatttaggatgttttaaaaaatattgtgttttttattagtacaaatcaggtgttagcacctggatttttcacacatatattatatttatttatttagaggcagggcctctctgtcgcccagcctggagtgcagtggtgcaatcttggctcaccataacctccaccttctagacttaagtgatcctctcacctcagcctcccgagtagctggtaccacaggtgcacgccaccacactcggttaatttttgtattttttgtggagacggggtttcgccatattgcccaggctgatcttgaaacctggactcaagcgatccacccgcctcagcctcccaaaatgctgggattacaatcgtcagccaccatgccgggcctctggatttttctttttaattatccaagccaacttgggttatcaacatggatttaggaagaattttagtgtttctactactttgcaagtctaattatggtttcaatttatattcaacatttggaatctgaaaagtgattctgacttggtcattactatacataagaaaaaaaactattctctccccaaaaataaaatttgaagacctgaatatttaataacaacacttgtgattaaaaagaaattctctaacttctcgatttaaacctttgatttgaattacagaccaaaaagaagtttggaagtgtaaactaaaatgaaatttgtgctatattaaagcttttcatataatagctttttgttcttaataaatattaaaagatatataaatagttggtaaatcaatttagattaaatttatccagatttctttgccaattacactgaagggacagttatttgaatgtacagtagaggtatcctagagttatgaagatggattttagaatagaatgtcttctggatataaaaatatttcaagttactttagagtttactggtccactcatgtcctgatctggaaatttccagagaagattgggaattcctcctaagctggccagacagagtgacatctctctacagattctagagttctgcctctctcccactacacttcagaggtggctttgaaagaccacccaggcctcctgaccagccctctcacgtggcagctcctatgggtgccacataaccgcagtctctccacatcgcctttcctccccatcgtggagggtaccttcctggtaccaggaaggatcttccatttgaagatacaactgccttcttggtaataattcctttgccttgggcccacatcctggattccaagtaaccaagggcaggctacttccagtcacacccaaagagatggcttgtccctcggctggggctcaacttctgctttggaaaccagctgaagtccaggacacaggctccccaagacctcactagagatctggtgtccttagactctccctattaaactccagcttatttacatagtcacgggcattttaggacaataaaaagaaagtaaacatcagaggcaggatttcctcaaagacattacattgtacatacatgacggtatgtcctgatttctttcatgcgatgctcgaaaataacctaagtaatccacatcgattactgcagagaagccagaagagtaactattcctggggatagctgatgtcaactaggagggggtgcaaaggaactttctgggtggtagaaatagtctttatcttaatgcaaggaatgattgcatatgtaaaaatgtatccagctgtgcattaagatatgcacattttaccgtgtataaattacagctgaatggaaaagtagaaaaagagaaaaactctgctctgagaaaatcttgaatgacaaaaaagttaataaatcactcaatttttcaactacacttagagagaccaggattctaagctgactgaccagagaccagtccttgaacctctccagactttatcatatccacttgtaaaacaagaaggttgaacaagatggtatttaaggtctcgtctaccatgaacaattcggcaaacctgccggagaccatcagccatccagtgtggcttaccacctcccaacctaagtgaactcacagccaagcagcaccttaacttttcatgccagggttctcagttctcctaaggatgatggggggagggatgtgccacaataaaacacatctgcttccagtaattccagtcagcatatatgctttcaccaaacgtagtcaggagatctcctaacattattgccacctaattgtaaatgctaactaaggagccatcagaatggcccacgatacctcaagctcaacatatcgaaactgaaatccatcattttcactcaaaagcccccttctgtgctcccacttagttaatgtcatggccatcttcttcattattcaaattagaaaactcaatgtcctatttaaagttttactaacctccccataggggatagactgttttatcttgatagaacactgcatttttaatataaagaaatgctattcttcctgtaagccatcataccagaacaatgccacagaaagcatcaattcctactagtcataaaaggcagctggaacatagatgtgaacataatgaaatcataccaaatgtctctacctcccaggatggctttgctagttgaaatccctggattctggattcagacaggctcataatttgactccctcactccagtccctctatcctgataaccaccctccctagtgaggccaaatttctacagatctggtccagttactcctttccttacagaccaccatgattccccctgtgccttataagacaaagtacaatcccaagcttggtaagtgatttacggcctaacttaattttcaagtttttttcccctactccatacaagctttgcccctcacccaccagcaccatgtgccacagcctcagctatgtccagctactgatattccctggacaccactacagtttcctaagactgactatgtgtctgcctgttccggaattgcttccccttcattgaaatcctgcccacacaaaattttttttatcattttgcatcttgatttataatataaaaaataagacagaagacttcatttccccaaaaataccaaaatttttacaagacaattcattaggtgcattgcctggaaagtagcaggaatcctcattagtcagcatcttcacatagcatttgtctgaatggagtagtttatcattactccaaagacatactgaagtttcattaaaattttttgatgtaatttttcttctatctcactctcttggattctaacgttttcttttctcttttcttcttcttttttttttttttttttttttttttgagacagagtctctctctgttgcccaggccagagtgcagtggtgcaatctcagcagctcaccacaacctccgcctcccgggttcaagcaattctcctgccttggcctcccgagtagctgggaccacaggctcacgccaccacgcctcgctaatttttgtatttttagtagagacaggttttcactgtgttggccaggatggtctcaaactcctgaccttgtgatctgcctgccttgacctaccaaagtgctgggattacaggcataagccaccacgccctgccaacactttccatattatttactctatgtggtagttcatgaaacctttcccttctaaaagatggcctgttaaagtgtcaaaaagaccaacaactagaattggcctgcctatgaccatctgtaagacaacagaccctctaagagaagaaatcaaagaagtttgaattcacacattctgagacagacggaagaaagatatgctattattgctggataatgaacacatggatttatgagaaaagcagaaatatatatgaaaaatttaaattataataaggttagagactttccatctgccattctaggagctaacagtatctccataggcttgatatttttataaaaacaagtgcttcaagaaaagagttaacagtcagtcagtgtgtgttgctaatgctggagaattgattcaactagggatgacacttgggaccaattaattcaaagctggctttaaaaaaaaaaagtagatacaataaatcagggagtagagcttcatttaaatatagtgagggactgggatagattacttgaaaaagctcagaaccaaagattgtctcaaaaggccaaagacaactataagtaaaacaagtgctaggtttctataagctatcaaacactgaaatcaaaaccatgaaagaaaatactggccaactggatgtcaactggaaaatttatacaaagtttgttaatttgtacttgtatcccctcaatctataaaaattttaaaacatgttttaaagcaacaagaaataaaaacagtttgttataaatgaaaattttcaggaagttatcgttctcaagatgcattttactgaaattacaagacaatttttaatagcaatcaagtaggaaccttgaggagaaatggggaaacgtaaagacttacatgaaatcttatacgggagtgtggtcacagtaaaaatatatcttctttaaaaagatgtttctatttcttttgtattgctgttttacctttaattttttaattttttttttttttttagtttaggtacttctcaatttttaaggggattgtgctctagaagtttctgatctagttgttcagaacctgaaatgtattttaatgtagacaccgcattgtatatagcactcacattccatagctaaccgtaaagagctctgctgttgctgtagttgagtgttgattcaaggtacacaggacaggctgagatctgggtcctggcttctggaggccatgagatgtagaatagaaatgttgaagaacaaaaagaattgtttcttgtatttctgaaggtcaagcttgagcatgacaaacttctccacagggaaagtttttatttgcctttttgatagtcaaatcacggtcctgcctctccttttgttgggagcctcattttggtgggttagtaaagggaacatctccaacattcataggagcatttgtttaaagggctcccacgtggcttccagccacttctctccactctgaaacttctatgaattagagaatccccctaattcattcaaatatattacggcctatatttttttaatattacaatgatctgacacagttgggtattgaaaatagagtaaaaccattacaccacaattatcccttcatccctgatgaacatcctcttgtccatttttttaatcatacgaataaatgaaaaaaatgtgataaggtcataagagagttaggaacattatgtaatcttctttaaaaataagataagctgctctacccagtaaaaccctaggtttctgcagccatatgacagtctgatatgcatgctatggtcggtcacggtggctcacgcctgtagtccagtactttggaaggccgaggcaggcagatagcctgaggccacgagatctagaccagcctggccaacacggtgaaaccctgcctctactaaaaatacaaaaattagctgggcatggtggcgtgcgcctgtaaccccaactactcaggaggctgaggcaggagaatcgcttgaacctgggaggtggaggttgcagtaagctgagatcgcgccactgcactccagcctgggtgacagaatgagaatctgtctcaaataaagtaataataataataatatgcatgctatgctctggtccatgaagaccttccacacagtgatttagaggttcagactccttttctctgtggctccaccatcgtctagagcccgggaagtctagctggcaaagagagaaagggaggatagagaagcattctctcttcttgaccacactgaaccagcgtgaacacattccttgccctcctccctttggtaagagctagtcacatgtctccacctggatgcacagggaccaggaaggcagttactggctgggtagcagctttgcgggagtgatgatgaaaaggggaaagaaaccttctgtgaatggttagtggtctcttttacaggtactatgacaccaaaaaggagtaaactttaaagacaccaaggtaagtttccaggagatgcagcatttgatttgcattgaaggatgacaggcaaaaatgagataagggcatttttctggagagaaaacagcataggcaaatgcaggtgggggaggaagaccgtgcaacatagaagcaattgaaaggaataaagccgaagcccaaggaccacttcaaagatacctctctctagagaaatgacccaccgcctatctgttaagagtttgacaaatgaaatctggctgaacctcaggccttgtcggaaattagtcattttgcttgcctttgcggatggtgttaaaatgatcaaatttggttttctgcatctctgagtttgattcctctgatgagaactgatgcgaatgccaactgactttttatgaagagtggttgatatttagtattctacagagtctttctgggtaagtgtaaccagagccagtgaataatagaagcagtgtatatctgtcaagtgtaattataacactgaattatgctcatcctgcattccggttcctgtatacattagtttaaacatcagaacatgctggcatttcagacctgtgaggattttactttgaaaaatagcatgcccttgtttttagccatttttaacaggaaaaaagaacttatatcttgttcaaaattattttatggtaaagtttgaccactctgttttttaaaaaaatcttctcaagtttctaaaaatagggaagaaatgaggaatatttcagtctagttttaaatgccctctaattttctgtatttaaataaaatcgtatacaataaaataatatcttattttgataaactgaactttctgattaaatagttgttaaagttacagaatagagttgcttataaagtcaccaatctttgccagagaaagtggaaattatcagattgtaactttaaaattatgcaagtattgtttatcgttgaatgatttaaaaattcagagcagcaaaaaggacaaaacaaaaattcagctataatcccatattccaatatatttaaattatcattttggtgtctatatttctaaacatttttctatgcatttatatatactttttttttacaaaaatgagatcatagggtacatactgttttgtaacctacttttttatgtaataatattttaagaacacattttcatgtcatttttcttaagactccataacaatatttttttttcaactgagaacaaggaccataccagaatctccaagagggcatgtgtagtttgaaaacttataattttatatttagaaagaaaacccaaaaatagctattgttttggtaatataacctacagaatataaagcatagaaatttccaattggctggtcggatgtttatctgggatcttctgaggtttgttatattaccattagcctcctacatggggcatgattagattactatgtcaacaaatgggagcacagattttgaaagattgtgaaatacagtgcctcaactgccaagcattccatttaacccacagtcccttgctgttgggcttaacttttgaaagataaatttccacacattctgatccactggcttctggttgctcattcccaatcataacatatgatagcatactatctattttaagtatgtgatatgcgattgctttttatcacatactcacatatcacagcctcaagctgcagggcagctcaaatgatgaaagtggaagacaggccgggtgcggtggctcatgcctgtaatcccagcactttgagaggccgaggcaggtggatcacctgaggtcaggagctccagaaaaacctggtcaacatggcaaaaccctgtctccactaaaaattgaaaaaatagctgggtgtggtggcaggtgcgtgtaatcccagctactcgggaggctgaggcaggagaatagtttgaacctgggagggggaggttgcagtgagccaagatagtgccactgcactccagcctgggtggctgagtgagaagaagagaagagagcagaggggaggggagggggggaagggagggatggggaaggaaggagggagggagggaggaaacaaggaaaccacactggaaggaggaaggaaggaaacaaaccacattgggaagagagggaggaaggaaggaaggaaggaaggaaggaaggaaggaaggaaggaagggagggagggagggagggagggagggaggggaagggaagggaggggaagggagagggagggggaggtggaaggaatggagggaacggagggaggaagggagggaagggagggagggaggaaggaaagaaggaaggaaagaaataaacaaacaaggaaaccacattgggaaatccaagcaaagatgggctcagcaggtcacatggtttggatatttgtccctccaaatttcatgttgaagtgtgactcccgatgttggaggtgggaacctagtggacagtatttgggtcatgggggcggatccttcatgaatggcttggtgctcttcccatggtaatgagttcatatgagatctggttgttttaaagagcttggcacctcctcctcctctctctcgcttcctctcttgccatgtgatgtgctgctgttccttcaccttccgtcatgagcataagcttctgaggccctctctagaagtcgatgccagcactatgctcatatagcctgcagagccaagagtcaaataaacctcttttctttataaattacccagccctaagtatttctttatagcaaggcaaaatggactagaacagctggatagtactgctaaccgatgaccctatccccaaagctgtttccattcattctctttgttgagagtatgtcaaaccatcccaggatggaggctggagatgagtttaaccccacctgcaactgttctctcgatggagctactctacagaaaaatcatgttccattagttcactaaatcgtaacaaaagtaaatgtacttgtttgaacattgtacaaactagtcctaaaagggttctcacgtattttatatgcgcagtctttagggaggcaaaaatgttttatgcaatctatacaagaaagttatattttcagctgttatccaaaacaaaggaagcgtactctgtgaaaaattggtattattgtttaacaatatccatttccagaggaatgcttttcttaagtagaagttggctgacacaaccataagggatgctgtgaagtgatttctgtcatttttcatacatggaaacatatgaactcaagggtctactaactcttctacaactttaaaggagcacttatcctgggatactttcaaacctgagattctgagattctatatttttaatgttcaacccttagtttcctcatttctaatattcattactaagtagacgataaagatcaagttaagcatagcttcagaaaaactaataaaataatttaaattggttatgcatctcttgtgacgattctaaggcaaaaggcacttttatagaagtctttcacactttaagaaagcttgctatatagaaaatgattcagttgggcacagtggctcacgcctgtaatcccagcactttgggaggctgaggcgggtggatcacctgagttcaggagttcgagaccagcctggccaacatggcaaaaccccatctctactaaaaatacaaaagaattagccagatgtggtggcgcgtgcctgcggtcccagccactcgggaggttgaggcaggagaataatttaaacctgggaggtggaggttgcagtgagctgagatcacaccattgcactccagcctgggcaacagagcaaaagtctatctcagaaaaaaaaggaaggaaggaaggaaggaaggaaggaaggaaggaaggaaggaaggaaggaaggaaggaaggaaggttctcctttcctctctaatgtctctccattcccatttaaagtctctgttgatctgcagcataattttacttttttctccactatttgtccaatactgcaaatgcactgtagttgaagagaatctgttgttgtaatggaaaacagaatcaatctctttttatactctgagcctatagcatgtagtatatatgtcctcatttggcactttttaattttcattacagagatcttctctgaagtcatatcaaggtgacactgaaaggatttgatagaaaggaaacaatttgtggcaaaacagagagagaaaaatactacctgtgatacaacctatcggcagagtcacaagtcagtccacagaaaccagaaaacagacgtccccttggctgctttccttctgatagacttatctaaagctctcactagcaagcatgctccttccaaagccatagcctttcatcctcagagttcatctttggcttttcctcattatcagtgtccctatcaagatagccatgcatagcacagttatttagaaggcacaattaattgacttgtatgctgtctccttgtaagcttcagcttggtctgtgttgaaacttgtcagcttttcccccaattcatgttgtttcaacctgcagttttattacctcctttggatgccaaattctcctttctccttgcactctccaaagccatgtattttgatgaactggctctctctgacatcacctcaaaccaacttaataaatcacccctagtcttctaccaaagcacatttccttaaatgagttttctcattttgccgcacaacctgaatatggtcggaagaaacacttctttgaagtccatcccctcctcaatctgctctcctcttcatctctaggggatccttaggtatgagtttcagagtttctctaaagcagcttctgggtttccctttattacaacactctatccccagagtaaccatctgggacctttatctattcttccaaaatgggtactgtctgcccaatgaacagctgtgctctttccaaacaagagggtatttaaaacccaactgcaagtcctacatggggtacaggggattgttgccagccacatatcattttggaactatttttgccttctttctttttaaatcatataggcctattaatattcaaggagttattctcaaaaggtggttaaatgcatagaaaaactaaaattagaagagctttgcattttaaagacagctttctgtttttgtatggccaatggtatctcccttttgcttccttttctctgtggatgtctttgtttgtgaagttattttttaaccataataaaaagcttaaaggccaaaatacataaagagaaatacttcttatactcaagaggttatcgagataccagagattttaaaatgagttcgtaacattgattcctaagctccaggcatttccttgaagaatttccagaagacttcaaataaatttttcttgccaatgttcattttcagatgtgtttaacaccaagttttctggtgtgaatatgcatatatgactctaaaaatctctacattcagaaactaaaactatactaaaagaaaaataggtcattttttatttccttcataatatgacaggcaatacagtagttaggaaaactaaagctctatatctagtcattactggattttagtgtctctcagcctcagtttcctgactaatcagtgagggtgggctcaggggtcgaagtctattcactgaagcttttaggtcttaacattattggattcaatcacatacttcttttttttgagacagagtctcacactgttgcctggtctggagtgcagtggcgtgatctcggctcactgcaacctctggctcactgcaacctccgcctcctgggtcaagtgattctcctgcctcagcctcccgagtagctgggattacaggcaccctctatcatgcccagctaattttttgtatttctagtagagatggggtttcactatgttggccaggctggtctcaaactcctgacctcataagccacccgcctcggcctcccaaagtgctgggattacaggcatgagccatcgtgctcagcctcaatcacatacttctaagctgatgtgattgtttctgtttttgtggagttacaaccagttgcaaatttagagagaccacattccccataagactgcatatgcttctgacaccaattgcaagttcagaagttccccaaaccacccccaggtttgatagttctgtagaaggactcacagaattcactgaattctgctgccgaaggctgctatactcatgctgcattatgggtgaagaatgcacgtgaaaatcagacaggggtagaagcacagatggcagagtccaggaacagtaccagatgctgagtttacagtcaacctctctatatagattcaggagcacatttctttcctggaacgggtgtgtaacaatttgcatggggtattgccaatgagggaagcttcctgagcctccatgttcagagtctttactgagactccgttatataggaatgattgattgcccacatggctgacctcagtttccagcccctcagaaggctggagaatataagccaaagccccacacccttcatcacattgttggtcaatctggcatggtaaggccccatcttttttctttttctttttttttttttttttgagacagagtttcgctcttgttgcccaggctggagtgtgcaatggcaccatctcggctcaccacaacctccacctcccaggttcatgtgattctcttgcctcagcctcccaagtagccagattacaggcatctgccaccacgcccagctaattttgtatttttaatagggatggcatttctccatgttggtcaggctggtctcgaactcctgacctcaggtgatccacccgcctcagcatcccaaagtgctgggattacaggcatgagccaccacacccagcccaggccccatcttaaatgccatctggtgtggccctacccctaaaacacaatgttagactatctggaataacccaaggctcccaggcaaatgaagacatgcttaccaggcaggacatcccaagggcttagatattaccttcccaaagccaaaggcaagggccagacctcttgagggcaaggctaaattctctattacacagttctgaaaatctctctgttgaggacaagaaagcaaagattcctaggacttactactagaaggaaacctgaaactcctaatgtttcttaaagtaagattccaggaccacttgcgtcagaatcacctggcattaacaaaatgcagactccaaagccccaccccaaacctactgaatcagattctctgtaacagaagcattggaatatgcattttaagcattttcctttagcagttttttatgtaggccaaaacttgagaattgtaattaagatccaaggtccctgttcctacaagtagagtgaaactagcatgcaataaagcaaagggagaaaattctgcttcttattccactggtgagtttatcttgggcaagccattagtcctcaaacatcatatgtttgaaaataacgtttagctacatttgttttaaacagacataactaatgtagcatgctcttagactgagaaaatattcattgagttactttgtgctcttgggaaagatgcttgtggaatacaagatggaactccatctagttcggctggccttgggaaaatgagtggatttctcttttcagagtatccatgtgatcactgttgccttcctaggcaggagtagtttctattcatcctttcattcattcacaaattggtatctactgtgtggcaggcaatgttctcagtgctgaggagagaacaatgaacaaaacagaaaatgcctctgccttcctgaggccaggaccacatatatattattccagatagtgatacatgctatgcagactttttaaaaatcaggattaaaggggaaaggacagctgagagcgaagtttgttatttaacatagaatgtttagggatggagtttctaatatgatgacttgtgagcagagaagtaaacgctcagccacagagttatttgggtaaagtgaacagcaagttctaaggccctggggcaggagcagtttcaaatgttgtgaaggagaaagtcctatgtggtggaattagaggaagactaagaggagtggaaatagatatggggagtacagacatctctttcaaggaatttggaaacaaaagggtgcatagaaatgaaatggtaacttttgggatagataaggtcaaaagaaaggttttatagtgccagtggttgttaagagtagagatatgtctctgtgtgtgtgtgtgtgtgtgtgtgtgtgtgtgtgtgtgtgtttgtataacaacccagttgtagagggaggggagaattgtcagagtggtgtccttgagctggtaggaaggatggcatcccgtgtataggtgcagcagttggccttgaattaggaacatagatgaactctttacttctttctccttatctctctgattcccatggcgaccttattttcagccttcctgcctcttctcatgaccctttcgtgttaaataaatccttttatcttctgatgtacagttagtacttcattcagaaaaaaaatacaggaaacaaaaaaagatattgataacactgttcaccatagagtgaggctgaaatatctgttctaccaattaccagttttgttgtatgactcaaatgagatttattgtacagaagatcccccaggaagctgccacccctcgaaccttattttagaatggaaaaaacgtatcattaccaaaactaaacagtgttagctggtctgcccatcatgctcatgctatataactttccttctcttttctcttatcctgttctgtactgaatggccaaattttttctgctacttcaactgaaactgtggtctaatatctaaatgctccctcacctgctgagaaaacttagagccaaaaacacctggtattggtcagttgttaaatttatcgctcaatatactaagcttggagtgatttgttgagttagaatgagagcaaatagtgccacctgctggaattacacttggaaggggaagcgtgaacatgccaagagctctccatggttttgtcccaatcattactttaagcctttcagatgaagtcatgagcctgctttattagaaagtaatttcttccacctatattcttttctgatggcaatatgccaccttatgtatttctcttttagtatttctcttttctccctgtaatgattcagtatctaaaattaccattaagaccagctgtatttcattttatttctcttagaatctcttgaaaaattatagaatgttgccatttgaaagaaccttagaggttctccgtagtttcaaacacattttggacacaggaacttttgggaaactatggatataatcctcactttggacctcaaactgaggcctgaagcgtgaaaagtgaaaagaccaaacagctgaggctctatatcagttaagatgctttcagttacaataaaaatggcttgagcaataacataacagcatatctcacataagaaatcctaaggtagatggctctgggattaatttaaaagttgagtagaccaggtgtggtggctcatgcctgtaatcctagcacactgggagtctgagatgggtggatagcttgagcccacgatttcgagatgagcctgggcaacatggcaaaaccccatctctacaaaaaatacaaaaattatctaggtgtggtggtgtactcctgtagtctcagctacttgagaggctgaggtgggagaatcatctgagcccaggaggtcaaggctgcagtcagctatgatcacactgccacactgcagcctgggtgacagaacaagaccctgtctcaaaaaatacaaataaagaatttttaaaagttgaacaatgtcagccatgacccaggctcatcctctgtcctctctgtcctctgtatctctgacatttgtgaggcagctccagcaacattaagaaccacagcttcccacccaatattaaggggcagaaaagggactgtcttttccttataactcaccaaaagactccactcatgtttcattggctagaagggaattatgtgtctcatccaaagtgggtagctggcaaggagcctggaattgccatctttgccttcattaaatccagatccatcctgtgggccttgggtagggctgtccttatgcaaagtgcaagactctggaaacacagagattccagggcaaaatccggttagctcacaaagaaaaaagggaaagtgactaattattgggagaaaaatctccatgggtctcttccacttttgcctgccttctgagcaagaagcattgacagctttgtttataccttttttaaggatgtgtgtatagctaacagccttggaagatacagatagtgtcttcctctgggacagagggtagatttatttcatggccagagtaagaaatataatgtcactctccggggcagaaattgagcaagtttgctagtagctactgtaaaaagattggggtttcctaagtccagggtccctcagctgtgaagcaaacttattgcatgtgcagcatccacctgggatgccctgcattcccctgcaagggaaagcaatgtgaacgggaagctcaggctgcctgctgtgttgtgagtaaagaagtcctttgtctctgacccaggagtttcatgtcttctgccagcatcatcagactgtggccatgttaaactatggttctgccagcatcatcaaaccatggctaacttgttagcctgcaagtggggtaaagtctcagacccttcccagttcttgatactcatggaaaggcaaccattcatgtttggcacagtgttctttccaatgagccaggctatatgcatccaattctcaaatacttatttctggaaatgagaatttgttcggtatataagaaattcctttttcacaggcagaaacagggcaacacttcagtctccaactggagacacacattaagcgaggacagtgtcattggctcaagtgtcttttatgctgtctcccttttattcgctcactctctctataattatctcttttaaaatgtcagttgctctcacccagaagaccaagagcaatcagccacaaactgaacttagaagcttttaaaacacactggctgtctgactgggggatgggatttctcaaaggcttcccgcagcaatgtcagggaagctgacattgagtggctgagaaaaaagagccctttccttggctctcacagtgggtctttcagatccttcctgaggaagcaacggaaggggtgtggaatgtgctgacttcataaatatttctccagcagagcctgaatggaggctgtttgggaagaaagttgctcgtggggtcctttggccttgagtccctcttactgtatcccattagggtgagaggctctgagctacggcatcgtcctggcaactttcttcccttctccagaataaaatattgatgttaaggtgacggtgaagaaataggggatctattgggacaagcaaaaagtatagatattttctagcgacttctggcactcagagtttttccaagtagtgacagtttgaagacctggacacgaattcatcatagcagtaggagaatcacagaggaaattagaacagcatttatccctacgagtcaaaccttagggttaaactcaatttatccctaaattctatttccttgatggcagttgatgcctttaaaatgaaacaatctttcctacttagcccaggaaccctcgttctcttgctgttctgacaacttacatttaaaaaatgctcctgctaaaatacagtgttatgagaacagaacagatttaatctgaaaccaaggctactttttcctcatctgctgtatcagaactacagagaaagatcacacagcctgtgggtcatattatcatcttcctgcattctgatcatacttccatggaaaccttgatggaggtcactggcctgcaagttcaatccagtcccaatgacccctggaggcaggggcttctaatttagatgagatatttttctgaagtgtgtgtccaatgaccacaggtgttgaaatgaaagttctctcgctaacgacatgaaggatcaaaattccttggtacaattaggttgattaaattgagctctgtgtctaatatccctgtagctcaataaagttaatgcagctttccaaggggcccaacacagaggcagggaacagtctaggtcctgagagaatctggcccaccatggtttctaaattagaagtttgattgcttgtgacatcgtcttaaaatggtaccagccaaaagaagctgaattttccattagcccaggaaaaaaaaatgacagatatttaattaaactgcttagagattaggtggaaagcttattgatggacagaggggctgaatatctttataagcaaagttaggcactggtgtgccacatctttaatgttgagaagaattcacccagcctaagggagctgaagacgtgtgtgctgcttcagcctgaggctgcctctcctgtcaatcacaagaaaaaatatacatttaaaaagcttgtttataaagcactaggtggtcactgaggaacttaacataaaatataaaatgtgaaattagaaagctacttatagctaaagttaataaagcaaccacccaatccatttgccaattgttgagaggtgactaattgcagaggaaggttgatttggaggtgatctctaaaaaaaagaatttgtggtcagtgctagagggtaggttatgagaaggagcctacaacccagatggggaataaccaaggtttgcaacagacgatgtacgacagggattattctccagaaatgttgtgctacctttcaggtaggcacaggtggtcataaaatgtaggtcaccctcattacaccaacaataggtcaccctcattacaccaacaataggttaccctcattacaccaacaataggtcaccgtcattacaccaacaataggttaccctcattacaccaacaattcaagggtccccaactttcaaaagagtataaagatcaatgaaatcaagtttcataaattcccccaaagcagtagctctcaactctagctatgtgttaacatttcctggggagtttttttaaaataccagtgccaactcttgaccaactgagtccaaatctctggacacaggtgtttcaagagatctccaggtgactatgaatcacttcccaaggagctacttactgaaaaggtaaattgtatgtggaattagaagatatcaggctctgaaatctgacaaaccttggttcagttcgtgactccactaacttactgaatctaagacactcaacatgcgctaacttctccagacttcagtctccttatctggagagggtcaatgatggtcacatcttggaaggcttctaaaattaaataaggaaataaatatatacctgacacatagaccccccaaaacacccttggttattaatggttaatgattgacattttatccttcttccattgattttgccatcgacctttgtaggacgtgacaggcttagatgatttttcctctccctgctttgtttgtcgtctagaatttactgctatttggtatctgggagaaaaatactcatgtttttcatgctttctgctcctccagctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtaagtaatggaaaggtaaccatggcttccctctgttgatttttaagagcctgcacaatacaaaaaaaaaaaaaaatcagcctatgcaaggtttgatatagagatccttccaaaagtaaaggtgttggcctcttgtagtctccttcaagacagaatggaataaggaagaagtttcaggagacctagatctcgttccacttccactcttgggagctcactgtcctcagctataaaatcagagtgcaggctgagacatctctcaggtctctctaatatctgcaattttaggtttatggttttagaagtgtataaagttatttgatcatttggggcacttgtaactgtgtggaaggaaaggaaggaaggaaggaaggaagggagagagggagggagggagggaggaaatgggctaagttcagatttttttgaaatgataaatataaagccattcctttcttgcctattctcaaggttctaggcagagaaagatttagacttttcctgacataggaaaaaagatcagtacaaaaaagaaatttaaacagatcaaaaagttaaactacctatgcaagaagtggatccagacacccagtctaatctttttcacctgtctttctgctactgacatatttcagatgaacctaaaattacttcaaattcatacctgcttcccatggctagttgaattttaaattttgtttttgagaatattcatatgttaggaaattagcaacttttcctctgttgaatgaaataaagaagtgagtttgaaggactttgtggatgcatcatcttagacccctctctagggggtcaattgatcagtgcagtcaactgtggaagtctcagacaaagcaagataagaatgtgacttggttgctgttcatattcataacacctgccacttgggctccaccctacgttacagcctcactgagagccagttaattttaacaaggggcagagtccccacagtgtctttcatagttgtgttgggaagcttgaagagcggtagaatgtcattaaaggaaaggtaaaattagatctccattcattttgtgtgatgtcggccaactacaaaacaaaggtgtgggtcaatgagctttgaaagtgagactgacttttaacaaccacatcagctggggctataaaagagttatagatttagaaataaagtatttcctaattacaactggaaatcagccctttccaaatccttccctcaagttatagatcacaaaattacacattattttttaattagctaaatatcaggtccattgatccctgctgagcacagtgaagaaatttcacttcatcaacatgtgtggcccagattagctaggacaagtttcttcctaaatactgttaattctgaacatgctgggtagattctatctggttttcatcataacaggtgaccctacttgactcaacttctcgtttttttgaccctgcccctggatatagaagtccaactttagttttgttcctttctgttggctaactgtggctgtgtgtaagaattttgaagacctagtaaggttgtaaaatgaagagatggaagagtatttattatggtcttggaaggaacatcaattcacttaaagaaggtgacccaataataacttaagaaaagagcaagggcctgagatcagaattctacagaaccatggaatataagggataaacagaaaaagaatatctcaggaagaatgaagaggaatagaaataaggaaaattaggagagagtaatgtcacaagaggaggaggatttgattaaaaaggtaatggcaaataatatcaagcaccatgagtaaaataaggctagaaatgtgcgtgtgtgtgtgttttgagatggagtctcatcctgtggccaggctggagtgcaatggtgtgttctcaactcacgactcactgcaacctccacctcctgggttcaggtgattctcctgcctcagcctcctgagcagctgggactacaggtgcatgccagtatgcccagcaaatttttgtatttttagtagagaaggggtttcaccatgttggccaggctggtctcaaactcctgacctcaggtgatccacccacctcagcctcccaaaatgctgggattacaggcatgagccaccactcctggcctgtgttgttttaatttagcaattgtaaaaccattgatgaccgcagaaacagaaatttcagaacaggaggctgacgtgatgagtcagcaatttcttttgactagaaaatagtctctagtcccagtttctaattcctgtcaccttaaagggaggcacaaggcacatctctcagatatgagctactttagccaatttgtgaaatattgttcggcaatagaagtctacctcaggtgaagtgagaggggttgttacaaaaaaaaaaaaaaaaaaaaaaaaaaaaggacggccacggtggctcacgcctataatcccagcaatttgggaggccgaggcaggcggatcatgagttcaggagttcaagaccatcctggccaacatagtgaaaccctgtctctatttaaaaatacaaaaattagggctgggcgcagtggctcacgcccgtaatcccagcactttgggaggctgaggcaggcggatcacgaggtcaggagatcctgaccatcctggctaacacggtgaaaccccatctctactaaaaatacaaaaaattagccaggcatggtggtgggtgcctgtagtcccagctactcaggaggctgaggcaggagaatggtgtgaacccgggaggcagagcttgcagtgagccgagatcgcgccactgtactccagcgtgggagatagagtgagactctgtctcagaaaaaaaaaacaagactctaaaactaacacctagttcaacagctatgaatttctggagccacttatctccaaactattcagttagaatttagggacttaggtgttagtctcagttcacctctaatataaaagcattttcttgaccaactattaccatcttccctctctgagtatcttctatttctatgttttgtttgtttgtttgtttgttttacatggagtcttgttctgttgcccaggctggagtacagtggcatgatcgtggcttactgcagcctcaacctcccaggctcaagggatcctcccacctcagtccccaagtcgctgggactataggctcatgccaccatgcctggcatgaggtctccctatgttgcccaggctgatctcaaactcctgggatcaagtgatccttccacctcagcctcccaaagggccggaattacaggcatgagccaccatgcctggcctcttccaatattagacattttttattacatgcttggtaatgattgaacaataccagggttgccaagtggtcagtcttctcacaatggtgtgtggttaacaatatggtctttgactaccacctctgcctcttgccaattgagaaaccactgacaaattgcttaatatttctgtgttaattaggaatacagctcctacaccacagtattaaatgagatattccatgctaagcactcaggagagtgcctcgcctagggcccataattattatcattattattaataatagtagtagtagtagtatttgagacagggtctttctctgtcatccaggctggagtaaagtggcgtgatctcagctcactgcaacctctgcctcccaggttcaagtgattctcctctctcggcctcctgtgtagctgggattacaggcatgtgccaccgtgactggctaattttgtacagaaagggtttcaccatgttggccaggctggtctcagacccctgacctcaagtgatctgcccgcctcagcctctcaaagtgctgggattacaggcatgagccactatgcccagcaggtccattctcattaaatgtgagtttctttttcctttactatcctttaccttttattccctttattttcttcttcctccatgtaatagttacccttctcttaaagaagcctctttcaatgggctcattacttctttcttgaaatattgacttgaaatgtgatcacttccactcaccaaccctacaggaaagctcacatgcagagatgtccctcaatattcagaattattctgctagtcctcagcttacctgcagaggccacagagcagcaaactaaggcccaaggattttttcacagtcagccaagaaatcagaagttcatctgaaaacatcacaccagcatccctgcaacagctaagatatgtgacagaatggcccaagagctccacctaggttccggaaggaagggctttcatacaaattaaagctgaaacagactgcaaatagttcttggctttgcacacagagctctacagaaggccaccttccacccactaacctgtgttaatgtaattgcctgaagggtttttcttgcccgctacacaggtaaaccaaattcactgagacaatgttattgcagtaaataaagcgtttaattaacacaaggacagccaagcagaaggactggagttattactcaaatcagcctctctgaggactcagaggctagggtttttaaggacaatttggtgggcagggggctagggaatgggtgttgctgattggttggagatggaatcataggggtgtggaaaattgtcctcatgtgctgagtctgcctcagggtgacagccacagaactggttgagttctgcgtcccaagtctggatggaggcaggtggtttccagaatgcaaaaatctgaaaaaaaaatctcaaaagaccaatcttaagttctacaatagtgatgttatctataaaagcaactgaggaagccacaaatcttgtgacctccggccacatgactcctgagcattaagggattctagaaactacacctacattttaacagagttcaggcctctcccataattctaatctcatggcctttcattggttttacaaaggcagtttcaatcttccagccaggagggaaccagttttaaggagggacaattatcatccttgctttaaagctaaactctagctgggcacggcggctcacgcctgtaatcccagcactttgggaggccgagatggggggatcacgaagtcaggagatcgagaccatcctggctagcacggtgaaaccccgtctctactaaaaatacaaaaaaattagccaggtgtagtggcaggcgcctgtagtcccagctactcgggaggctgaggcagaagaatggcatgaacccgggaggcggagcttgcagtgagccgagatcgcgccactgcactccagcctgggtgactgagcaagactccgtctcaaaaaaaaaaaaaaaaaaaaaaaaaaagctaaactctaaaccaaatacctcccatggttagtttagcctgacctatgcccaggaaggagcagggacagccaggctgtgaggctagaagcaggacggagtcagccatgctagacttttcttgctgtgtgatctttgcaaaggtggtgtcattagcgaggccaggctcacatgtccttttgcaaagtaaccgaaaaaaaaaaaaacagagaagacacagttcacctcactgcacatctaaaatataattagaagctgtcatcccaaaagggttaacacaggtcttttggaagttgtaagaatccagagattattctggtttaatcaaaaagtaacaaatacatttaaaaactaagagacacagaaagaaaaaaagcacttgctggtatttgtctgaaaagtgcaggaaacttttcccattttttgatccaaaatgagtgtccagcatatgacgagctccctggatggcccagcagaagcacttaagccacatgttgatctgaagcctcagccagcccaggtgttcggacctgggctgtccgtgggccagatttttcttaggcggtggagaaagcaaacaagctcatggtcattgtctaagcatgaacaatgccaggctggattgagcaaagccagctttggcagagacatacaaggagtttggagccctgacagctgatagcagcggcaggagtgggagaaggcaagatatctgctgggcccccagcctgggaggctggctgccagcccagggcatggccaggagctggcaagcaaacaccactgcggggagccaagcaggctgttcaggtcagggagctaggacagggttagcatgcagcaagctagacactagccagagcatgcaactgctcttggcagtcattaagggaggagatcagagttacaagatctggaggccatttcagacagcttcaggaagaagtcaagctcctaagtggctccttgacagaggctaggtcatcttaactcatgacaaatgtccgtgctcaatttacttggctctggcctcttctgatatctctctagaggttaaagggaaccatctcttttgtgcagtccaaaaaggagttgaaaaatcaccctcagtgcttcaagctcttttgcgttgggcagaaagcctgactgagactcagtggaaggcacgctgtcttcaggaggactcagagactacctgagagtggggaagcccgcagcctcttcttcctctgacagtttgtctatcaggagacttttttctcctgggtggcaacctgagtttatggaagagttgaggtttattaaatggacgtataagcaactacagactgaaatgttataaccattctctgagtccaacctccccaaattctaaaatacagcttgtttggtcagctgcttctcatactctctgtattccaaaattgcaaatggatcattccagtgccatctgaaatgcagtatcattgagagaccaaagagaaaatcgcatttgtgtgtgaaggagaaaaatagaattctaataatgaaattcacccaaatctatgtatgaataaaatggctgtttctcatatctaagaaattgataataaaagatgtacaactcaggccgggcatggtggctcacgcctgtaatttcagcactttggaatgctaaggcgggcagatcatctgaggtcaggagttcgagaccagtctgaccaacatggtgaatttctgtctttactaaagatacaaaaattactcaggcatgctggtgggtgcctgtaatcccagctacttgggaagctgaggcaggagaatagcttgaacccagtgggcagaggtcacagtgagccaagattgtgccactacactccagcctgggtgacagagtgagaccacatctcaaaaaaaaaaaaaatgtacatctcaaattgcaggaattataacctagagaatgtgtgcctgcccctgtttcctgcaaacctgcctcaaaagcaaccacgtgaatgctgactgagacaccccggtgaaccccagggccaagtgcttcccatgcttcccctcaatgagtccacacgagtctataacatagataacattgctaattcttgttttattctcacattaaagattagttgacttaccgaaggtcgtgcatttaggaagagacagagatgggatttggttccagacagtctgactccaaagactcagcgctttaatcattcctcttgtcaaagcaaaaattgcactgggcaaagttgaacaggcaaggaagatcttcattcagggctgttgcgacagggtagagaagccagaatgcagtcgagctcgcctccacttcagctaagggcaggagaattttgtttctttattttgattttttggttttttttatttcactaaaatacaatgggaaagtttttacaagctgggataggagggatcatagggtgtctgtgtttgctgattggctctacccaaaggaaaagtaaactttcacaacttggagttaggctcccaccctcccgtggaggggagacagggtgctattttccttgacaattaccatttcaaagagatgactcccaagtttttgaaaaagccattcctgggttgtaaaactggcaaacagctttttaaaaaatttatatctcaaaagggcagagaaagaattaacaataacaaattttctaaagtaagtgctcttaaaaagtgaggtcaggggtctagggtggaatggaggggtcctatgtaaagtttagtcaagctgaaggcaaagttcaggccctcttggtcagtctataccagcgtcccctgactgagatgaccctgtggcccagagggtatgtggaaaggtgcggtgacactgggtgctcccacagcttcccacaacgtgcaggagaatccatcccaaggaagatttgcaggccccacgtgcaataccggccccttgtggagcactctcccagttatggagtctatgggagagactgaagttgacaggcagtggtgaggctggacatcaggcagccctggctggtattatgcagattataaagtcgccatggcaaagatctaggcctgcagagggccactgtcaaacgcaaagggtttggtttaacgagaagttaatgcaaaagcactcttctcagggaatgagacttcttacttgacagtctctatgacatggaaataatgttttgtttttgttttgttttgttttgagttcctttggtaaagcttttataaagtcgtcaaagtcagcatggatctctaagtctcagacacattcttcggggctttgcagactctctcagcagcatgtctcctgcgctctttcctgaaatactttcttcccacagattccacagccgtgtgctgtcctgcttatttttcctaccaagctggccatcacttagtctctcctgcattccctccttcctccgcttgaccactaagcattgcagtgtcacagagccttcctgtcttctcatccgaatattgtcttggatgatctcattcagcccaccatccaatggcttctgataataatttgtgccaatgtctctcaaatttaaatctccaggcctctcttctctcaggaactctagatccacttatcctactttctactttgtgtttcaacttagatattaaatgggcatcttagaataaacatgatgggaaacaactcttgatgcctcctggaaatttgttcctccaaaagccctccccatctcagtaggtggcatcaccatctaatccacccatccaccctaaatttggagttacccttgatttccttcttccctttctttcttctctttccctcatcacttcctatccaatagtaagccctgtgagtctacctccagactgtccctcaaatgcagctgaggcaggagaatagggtctggaggcagggaagataggcagattcatgctgacttcttggaactaaatcaaatgggaacgcttcagcaatgacaggaaggtgaacggctgtgtagcttcacttcatcctctccatttacttatgccacacactgagtaacatccttgccatttacatagggtgcatactgagtaaatgactttgtcacttgacttcgtcttcttcatttacatagggcatataccaagtaaccaatgggaaacctctagagggtgttgaaaccccagaaaattattattattcagaaataaatgaatacgtttatttatgtgtcctccccctagaacgtaagctacatacagcatagacggaggatagggtccaataacaactggtcaatggttacccaataaatatttgctgagcaaacatctggatgaataaataagtgattgtgatttttctgggttaatatccatattcaaaattagatcatctcctttccaaagcaagaagggtttttccttataaactttctccagaattcttttctcaaaatgtgatgatatttaccatcttgggaaatatctttttactgggaaccacagactgaaatcaagcatgacagaagcagaagcagcaaaaaaaaaaaaaaagtcacagagaaagtcagcatattatggaagacagcatttcaaatcagtctagagcctgagcatagttttcagtcttcctgatatcaaattggggtcttgcctgtttggcggtagctgtgatgctggctgcaatcctaatgcagagtttctaccccaacctttgtaactagttcttggttctctctgggatagaaatagggagtgatgtcgtaattagaaaccattgccatacattaaagagtaaattaatttgctggacaaaatctagcaaaaaaaattactacattgaaatcaatcgaccatatgcaaagcaaaaatgcaaataaaatatagaagctcctccaagaaatgccttctccttcacagttgttcactacaagggttaccagccctctattcttttctgaacctgctgggccaccacgctcagtcggctgctatcttctcaatagaaccatctccacctacgacccccacaaagggcaaaggatagccccttcccacttacagttgccatgtatgttttctgccctttgccctttagggatcaaaactaattgacttttgcaattccagctacctttcagtcagagcattaccataggaagtgagtgatgataggtacaatgtttgcgctttttttttttttttttttgagacagagtctccctctgttaccaggctgaagtgcagtggcacaatctcggctcactgcaacctccgcctcccgggttcaagcaattctcctgccttggcctcccaggtagctgggactacaggcacacgtcaccacacccagctaatttttgtatttttagtagagataggatttcaccatgttggccaggatggcctcgatctctcgagctcatgatccgctggcctcagcttcccaaggtgctaggattagaggcatgagccaccaagcctggacaatttttgctttttttaaaatgtgctcccaaataatcaaatcaacagtgtacttttaatgtcttttgagctcccaactaactaaaagataatctgttaactatattatatgggtagaaactttacggtgaacattctgaacctaagaaactaaaggttcaccttctcatgtgtcacaagaccaaatgcttcaggaactctggtctttcttccaacatcctcatggcaattggaatggtctgatgcagagaagacattttaatgtaacggtaccacttttgcaatcaatatggaaaaatgtttttcaacaaataaataatttcttatacagattttttatctttccgataaggactgaactaaacttcatgataataaatggcaactgtcccacagaaaaagattgtaataaaataaattagtatcaatgacacaaatattgaagaagggatagatcctcgcagccccatagttcctcccacagtacactatgagcgtgagaaaaaagaggcccacttttagtattccgcattcagataaacagggtcgtttcccatcagacgcttccctctcatgtttttatctcacagtttggtttctgctccttcgtgttttcaaggccccctgatgtgcaggatattgcgtgggtctctcttcctttcatggtcctattgtcacatcctgacaatgttcctctttcattttaatttcattttattacgttttttcttcaccattgccagcttcaccctctcgccatcgccgacacccactgaaacgtattttatggatggtcttctagtcccaccctctatatatttgttcaaagtatacatatcattgtggaaattcgtgttgtctcttgtgtgccatgctttatatgggtggcattgtactacagatcccattctgtttcttactctcttccctctgccttacattgttaagatctatttgagtagttctctgaatactatgtgcatagtgctccattatgtgtatttaccacgcatcatttattctatcccctaatgatgaatacctaggttttctgcaactctgccaccacgaataaccctccagggaatatatttatgtgcattctctgccacctgtgtgaggacgtcttgtgtgtgtgtgtgcctctgtgtgtccccagaattactgagtcatagagtatgtgtgtacctaatttcactaagcactgcttgacctatcagtttctgagtataaattttaaactttatttactgaatttctatcaatagttctatcagtggtagcttcgggtaattgaagtctattttgctagttagatgtgttcatgatcttcttgatttattgttccttgtaccagtatataatttccatctttgttccttatgacatttttttttaaatctcacagttttgtctctgctcttaaaactaccacactgctgggcgcggtggctcacgcctgtaatcccagcactttggaaggctgaggtaggcaaatctcttgtgcccaggagttcaggaccagcccgggcaacatggtgaaaccccatctctaccaaaaaatacaaaaattggctggatgtggtggcacacacctgtaatatcagctacttgggaagctgaggtgagaggatcgcctgagcccaggaggtctaggctgcagtgagccgtaattgtgtcactgcattccagcctgggtaacagagtaagaccctgtctcaaaagaaagagaaaatgactacactagccaggcataatgatgtgcgcctatagtctcagctaccctggagctgaggcagaaggatggcttgaacccaggaggtcatagctgcagtgagccgtgatcacactactgtactacagcctggggacagagcgagaccctaactctaaaaaaaaaaaaaagaaaaaagataataaatgaacaaactactatgctagccttcttgttgttgctaatattcctgttataacctggtattttttgtacaggtgtttgtatccttttgtttaaatgttcctcttagatttcatattgctgaaccttttaaaaatccatttggaccaattactcctataattttgacttggcagtgaaaataaagatgcaatattttttccatctatgttctcaagacttgtgactcctgtacatggatcggaaggatccctggggctgggggtctctggttcagatccacagctattgatgaaggtgttgttttttggttttggtggtggttgttgttgtttttcttacctaccctgtttaaacacttcatgagtgccttccatttgaactctaatattgtttgttctggaaataccagatatttcttcagatagtttcttgcctgtgtttattcttttcttatgaagctactattgtgcagatgttgacacttctaccctccgtaattcttgacttttgttttattcttctaatctctttattcattcctattgtcttcatggaaggtttcttgacccaatatcccaacccacgaaaatgttcatcagctttatccgttctgccattcagcccctccaaggatatctttattttgacagttatagatttttcacttcaatatctccaactaattcttattcttatagtttgtcattgtcctgtgtctccaatatcaggaaggtgggattctgctaattttgctgccgcttcatgtcggcaccataacgcaggtgtcttttatgcaaatcctacagttttctgctgtcattggttctgtgtcttcagcgctgcttcttgcccttatttcgcagtgcttgctgtcctcagaggtcctgtcatttcgccttctgagttcaagcatattcccttgagatttccaaatgccacctttgttattgtcttcctacaatgaaaaacaaaagttcagggcctgcattgagctcctcctggaaagttgagggggcaaagaaaaactcctgcctcaggacaaacctctggcattgtcatccctctcaaccctttcttgtttccagtccatgtccctcacccacctcccatacacacacacaacttcagagtacctcactcccacctagacaggggacagccatcttccactgtcattgattcttaaaccagtggtgtatctataccactaaatctagcctctcactacccgttcctccactaataagcatcttattgctatattgaagtgtctgtctcaaaaataaccaaatccaatagcctgttactgttgtctgattttccttgacttcttgctcttatttaacaattgtcactgtgccctccttgaaatcttgacatcaaaacactccagtcttctgttttctcagcctctctgccaactcgcctcccttttcccttttcctcaatccccaagcttctcttctttttcctccacccctttgcttggatggctgacatacccatgaggcttggtcatcagagctacactaatccctcacggatccatcccaggcttgacctgggactagcatccgcaaaggcttgtatgtgaagtctgagagtgaagagaacagggtgccagcttggataataacaccagggattcttgactccggatttaaaaaaagactagatacaaatgtttaaatagagactttaaaagacagatggaagcaggagagggggagggggagatacatgaagatcagcagaaagaggatgcttattttacttcaaagatgacaaaactcaccagcaggacacttaatatgaacaataacctaaagatatttgcaaaaatgtatttagacaagagttctaggctgatatatttgacatctgggtttattaaagtttactaaaatagctgttaataattttgaaatttggatccaactagaaaatatccccactttcagatgcaacttggaactgtaggtcccacagtaaagcaatggcttctgaaatcagtgctgtcagactgagcttagggaaagtatccatcatccaccattttagcagtggccaaagcccataactgccttggtttcaaaactgtagtactgagcttttgcactaagaaataaatatgatcttaatgacagcatcaaaaaagtgtcttctctttgttggcttagagattaatttggacattgacattcctggctctgtgagtattgcatttcccctttcagcttcagccatccttgtagctttagagacaatggtctgcccaggtgcaggggctcacacctgtgatcctaacacttttggaggccaaggcaggaggagcccttccatccagtagttcaagatcagcctgagcaacatagcaagaccttgtctctacaaaaaaaaatttttttaattaaccaggcatggtgacatgtgcctgtaaccccagctactcaggaggctgagacaggaggattgcttgagctcaggaggtcaaggctgcagtgaaccatgattgcgtcactgcactcggcctgagccaaagagcaaaactgtgccaaaaaaaataaataaatataagacaatgttctggcaggtggtaaatgtcttgcctcaggtattaatcactctatcagcattttgtatacctaagtacaacaatgtctagaagcatatcagacgtaggagaagaaagtgccttatatgatgtaagcccaaaaatcaaacggtggccagagcatagtaagagtgcaggcttaaaagctatccagcctgggtgtgagttctggctacttactggctatatgacagcaaatgaattaactctcttattctcagttcactcgtctgtaaaatggagataataatatctagctctgagagtaaagttctggaatagtgcctgatacttctagtatttaattaatattagcttttgaaataaccaatagtttaccatgcttatcctgccaccatagcctctacaatgaatcagaccacttagctccacccccattgcataacatttcacatttggacacataggagtgctttatactatggaaacccagtgtcccttcagtctctattttgaagctttcttctagtttaatagtttggattcacatgttctgcatgtcctttactctgaggacacaagaaaatccatgcaataataatgaactgaaaaaaatccatcctattgatggagttatgaatgagcactcatgagtgtcatctgaaaaagcaattttccaaaccccagttctctcagtatgtgaaagcttttttcatacttgccctccaatatctagctgacagagaaactactgatcaatacttgtcaatcatgcagctctgcactaaagaatatggagcaatttcctttaactctctacaccactgaagactcttggccattctgctgttctcagttcaaccagataactgggtttatattttacacacctgcactgacaccacaggtattttgttttgttttgttttgtttttttgagacacagtcttgttctgttgcccaggctggagtgccgtggcacaatctcggctcactgtagcctctgcctcccaggttcaagtgattctcctgccacagcctcccaacaagctgggattacaggtgggcaccaccacacctggctaatttttgtatttttagtagaaatggggtttcaccatgttggccaggctggtctcgaactcctgacctcagtgatctgtctgcctgcctcggcctcccaaagtgctgggattgtaggcataagccaccacacccagcccaccacaggtttttttttaacgggttcaagttgatgcttcagacctaagaaacaatggtagcatatagaacaggagaaatagcaggtacagaattgcaacttgggaaggcccagcctgcccaaacacatagctgcttttgccccctgacctagccagggcagctgtggctgccatgccagagagccaaggtcagggtgggtcacctagacacagaggagtcctagctctttttcccaccagtcactcacaccattccagtggcgggctcaagacctctatgctaattcacagctctccagtccagacacagccctccacgaatgataagatagcaacgacacccatcctaactctgtgctttcttttctctctctttttttttttttttttttttttttttgagacggagtttcactctgtcacccaggctggagtgcaggggcacagtcttggctcattgcaagctccacctcctgggttcaagtcattctcctgcctcagcctcctgagtagctgggactacaggcagatgccaccacatctggctaatttttgtatttttttattttttattttttattttttttttagtacagacagggtttcaccatgttggccaggctggtctcaaactcctgacctcaggtgatccacctgcctcggtctcccaaactggtgggattacaggcatgagccaccatacctggctctaactctgtactttccatggaaacagtgcagtgagaagagggaccccaaggtcactttctcagggaggtctagatcagcccgagcctgataacccttcctcattgtcttggtctgcttgggctgccctaacagaataccatagtctggtggcttaaacaataaacattctcacagttctaaaagctggaagtccaagatcagtgtgtccgtagggttgctttcttctgaggcttctcttcttggttttcagactgctgtcttcttgccgtgtcttcacttgatcttttctctgtgcaagagcatccccagtgtctgtccctcttcttacaagaacaccagttctattggattaggtctcacctttatggcctcatttaatgttaagtacttctttaaaggtcccatcttcaaatgcagtcacattggaggttagggattcaacagacaaattttgaggggacacagttcagtccatagcactcctgatacctctagtatcagatttatatacacatcatctcagccatatttaatttattccaactatgtgcttctatagaatgtgcctatactcaataatagcaataatcgtaacagctaccagtaactagaattagtgcaaagaagtgcattatctgttattaacacactcctacgcggtgcatattgttatgccaatgccacacataaggagactgaggcccaaataggacctgggaagctcacatgccatgagcggcgaagccaacacatagaagtagatctttgtgaccacagttcatgctttcttcatccctgcttgctgcctcccatacatcaaattgtgcctggcatcatcgtgcagctatttgtgatcaccttgggattaacctgcaggcaagaagcacgtcctcatcatcattttacaaatggctttcctgacgcctttcactcatgaactgatcatgcaacagctttgctcttctgagcatcctgcaaccgctctcatctcatgcctccttcccttccaacaggcctcccctacttgcaggatggtacccccttacctttttcctgaagccctctctccatggacgagctcatgatcccctttctgtcacttcctcagtggggcctatcctaaccaccctacttgaaattgcagcctcccccaccccactccaactctggatcccagctaaccctgcttgacttttttctccatagtggctaccaccttctaacacacagtatattttattttcttattgagtttgttgttaaatttctctttctgcctgcaagaatataagctctacaagaacagagacttttgtgtgttttgcttcaatactatgaagcagacaaacaaaacatctaaaacaaggcctggctcatagtaggcgtgaaataaatattttttgaatgaataaattagattttatgtgtgtgggctttagtgtgattccttctatggtgaattagtggccagtctctttgggcaaaagtactcaggaacccaacttagctctttattaagttctgaatttgaggacagtgtttttttttttataattcctcttgatcattgtttttgccctttttgtttaatttaatagccgattattttgtcccagtcttctgtgcattttacagttgtattattcattatgggtagttccagcattttcataattaatctttaattgcaatacttgcaaagcatttcacaagaaaaaatgatttacaaattaaacccacatctcaccttggataattatcacaggtctgactaatgtgcgtgaagcccttgcatggcagggggctctctacaatgacaatgtgttgattttctaattaacaaaggttaagtagcgtttttgcttgaagacctataatttaaacttatgacgtttgtcaccaagaaagatttctacagagcgcagaagtggaactcaaataattttcactgattctagtgcattaatgtcttttacataatatataatgaccgttttcaggacagaagatttttcttcatattgactagatcaggaaaagtaccttctagctcactgtcccatttaaataaatcagggactacctaagcaagaaaagagcctaatttatttagttttcctttatagagcgagaaatggcatttcactcacctgctttataaattatgaagagggaggacaaaactttttatttatttatttatttagagacagagtttctttcttttttgcccaggctggagtgcaatggcatgatctcggctcactgcaacctctgcctcccaggttcatgccattcttctgcctcagcctcccaagcagctgggattacaggtgcatgccaccacgcctggctaattttgtattttcagtagagaagggatttcaccatgctggccaggctggtctcaaactcctgacctcagatgatctgcccgccttggcctcccaaagtgctgggattacaggagtgagcaaaactttacttaatgaacacaacaaatacaaactagactacagtcatatgttacacccagttaaaagagggagaaaaaaaaaagtcagacatcggtgcaaagaaagaaaaagcaagcaaggaagagatttaatagaatttgagagtgtttactgaaattcagaaaaaaagacacaggcccagagggagagcctgtgaaccgtgagccagagtaattcagagctggaaggagtcacagacaccatctagttcagcctcctttatctgtggatggggaaaccgacgctgagagagactatgtaatttgatgaaagccacacaactgagtagaaatagttgatgatcctgagaaggaaagatccacaaacacaagtgcaggaagagagatggatccatgtagaacctaagaagtccaaagacccaagaatcaagacagaagcagagggagaaaactccgccccactaaatcctttctgaaatgaaccctgtatatataaataattaagtatccatgaatagatctaaatatctgccttaatgatataataaaaatatgatttactctagatttatttgctctgccaattgaccctttgaaaaatatctccattctcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaagccaaatgtccaacaatgatagactggattaagaaaatgtggcacatatacaccatggaatactacgcagccataaaaaatgatgatttcctgtcctttctagggacatggatgaagctggaaaccatcattctcagcaaactgttgcaaggacgaaaaaccaaacaccgcatgttctcactcataggtgggaattgaacaatgagaacacatggacacaggaaggggaacatcacacaccggggcctgttgtggggtggggggaggggggagggatagcattaggagatatacctaatgttaaatgacaagttaatgggtgcagcacaccaacaaggcacatgtatacatatgtaactaacctgcacgttgtgcacatgtaccctaaaacttaaagtataatttaaaaaaagaaaaatatctccattcttcatcatgttaacattcagagtcttttcaaactctcaatcattgctgaagatccatgaaataccaattgtttccaaattaaaatacatcccagatagacaaaaggttaacatgtggagagaagcaaaatcacaaacatgttagaagaaaatatggttgaataatcatattattttgtattgtagaaggtctttataagcctctgaccaaaggcaggaatcacacaaataagacaggtggatgtgactacaaaaacatgcaaaactttcatcgggaaaaagaaacaccatagagaagtcaaaagacacaaactggaaagatacagctgcaataaagagttatttataaccaagagttaaagctcatattgttattaatcaataagaaatatattctcttgtattcccagcaaaaagcgaagaacacaaagaaacaaaaaataagaaaagggaaaacattaaaattactcagctcacagtatttgaggtgatgcagatttaaacagtgaatcctttttgcccccgtcgagcagactggcatgaatacaaaaaggcactgaccaatattagaattgtgtggagaagatgaaaatctcataccctactggtgaattagaagttggtaaattcttcttagaagaaaacatatttaaagtgcctttaaaatgtatatgcccttcatcctagcaattagacttaaaagtatgattaactaattttaaagaatgaattctaaggaaaaactggacgacaagtgtgcaaaggttttcataaagattatattattatagtatcatataaaatggaaaattttaaaaacttaaaagtccactggtggtgcaagagcgaaataagtgatagtgcattcacagaataggatgctatgcagatactaagcaagatgttctcgttgtacatttattgcttggaaaatgttgcaaaggctgggcacggtggctcacacctgtaatcccagcactttgggaggccaaggcaggcagatcacgaggtcaggagttcgagaccagcctggttaacatggtgaaaccccatctctactaaaaatacaaaaattagctgggtgtggtggcgtgtgcctgtagtcccagctactggggaggctgaggcaagagaattgcttgaacccgggaggcggaggttgcagtgagctgagatcatgccactgcactccagcctaaacaatagagtgaaaatccgcctcaaaaaaaaaaagtttcatgatatgttaagtgcaaaaagcaagtttcaaaacaatgtgtatattatgattccatttcttcctttttatttacacatagtatgttcatagaaaaatgaaaaaggctgttccctaaaagtgaaagtagttaaatctgagtagcgtaacagaatctgttttgtattctgcttctcagtatgtttatagtgaccacaatgactattacattgatcaccaggcagaaagagatggggagatctaaaaatgatttctacattttagcatattttgatagaatataattgtcttaattgactagtgataaaaaatttttaaggccagacatttatttaataaaatgtcttttggaaagcccttattgcaaggacaaaagccataatggctaaaataatagaagccaaattgaaattctaacacacaaggtgtaactagagggttgaagttcttccaaatcaggcaaaggccctcattctcttcagcgtagaggtgtgaagcccagttgacaaacagatggcagaatgggaaatccttcaaagtagttgtttttaataacttcttttgccatctactctctcatagctttgatcaaaaaaggcactggactctcttcacttctctattccaatatgttagaagaaatcaaatactcccaagggagtcatgattaaaaccaatgagtcacccagtgagagaactgcaaggcttgggtttgcagagatggtacagcaactcatttgccacttcactgatggggttttgcaggcataagcagatgctaattcatctctgccactaaagcctttgatattccagtcctgtctgaccaatctactggagtttatgacttttcttaagataatagagtaagtgatcagaatcaatccccagcctactgatcttacctgaattccagtaaccctactgactactccatgtttaaagacctccaaatctacatctcagaaacatgtacatctatgagacccctgactggaaagttcttctcggtattaagtggtctacacagaacagggcttaagacaataaaccctgtttgttgccttaggaataagacagatctgatacagttgccactcaggaactatgagtccttgagtaaacttcttaacttctccaagcctcagtttctccatctgtacaatgggaataatgcaaataatatctactttgataagttgttgtgaggaccaggtgagtagcatatataaggtactgtatatagagtgcctagtatgtagccctcaatgaaggagaaacttgggttttatttttattaacagtattttcttttctaaatgctcatcacctatttctttcaacagttttacctactattcattttagattagtttccagaaaagttgttactctaagatgcaagcatgtatataaatttgagttcgtccttttataccagctgctttaaaaagattatagctaagaatactatagacacaattaaatccatttgtgatagaatgcctcaatgaatctttctgtgaaatttcttgggaatattttaatattttcatgctcatgaacctcagtccaactctataacttactccaaaaatcacagtgaacgtgcttattgtgctatatgtcgtgtaatgacatttagacaaaagcaatgaaatctgatctaacctagcaataaatgtggtatagctgatttctgtgtaaagttatcagttccagcttccagctaccccagacaaggagccttgggtagtcttgacatgaacttaaaagcaaagcctctcttgagacaagaaccaagatctacaatcacatttcaaacggatttatgtcttccaactaattgacttgttaactatgctaatacattcatgtctctgcctttatattttttcaataagtaatgctacagaactcgatgttgtgagattaaagagcaaagaatctagagatttctgtaaacgctttttctataggaaaccagattagacttccaaaacagctgatataatttttgtgcatctccaaatattttatttctgtaggaaacgtgttgcttctcagaagatggctcttttaattaggccttatagcctgcagggagaaaagcttcaactttctctatttagataggaccaacttgatagtgacaatactagatgtgctatgcagtgtcatctcctaccacagttgttcaaaatatgaagaattaagcaatagcagaggttattccctctgaactctgtgccttctgtcattcccaggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaaggtaaggtggaacccatttccagagccacttttgcgtgtctttttaagcccaaatcatctatttaatgatttttcatatgtaaacaagtgtaccttattctgaggttaagatgatcagaatttttctctcaacttaggtaggaattttccaaccaaaatcatttcctaatcatttttgtttgataaaatgagagaagctctgtgtatggtgcagaatttcttccagattctagcaaattattcactgcccgaaacactacaaaggcagtctcattacatcttaatggtgagtgataaaataggtggccttcaaaaggggaatcaggcctgaccctcccacgttaggatctccaatagatcaattgatcagtcaatttctgtagtgaatcagccagtgcaccccagtggtcttgatgcccccaccccctgcagttgctaagagactggattcaagctacactcaccagaaagctcctctggtcagtcattaacatcattattattactcttactcaggatgcctttgagtggctctcagcctaagctaaactgcagaaatgctgaaaaaccacatttaattggtcagcttagagcatctgttattacttggttattttagtcttgaataattcctttaatccccagtagattccgcagagccaatgagcagagtacaagagcccaatgcatatgcatgttatcatttgaactataccctgtgatcctgcttgaccagaagaagaaattgactcaactggtctgtggcttaatttcccatatataaatgagggatgaagagaggaggagctggtgcttttcctaagccacaattgaaatgcatgtaaatcactcctctctttctaaatgaatgtatagcatatgggtaaagttttctgtgagcggttggtgcatctcttaataagaagctttacataagtagcctgttcagactctgatgaatacatggagggttgtttacactggcattattcacacaagatgccacacacagaaggaggaattgttccataacattctctgtacctccaggctactgtttggcagcgctataatatgagcatacaaattaggccagacagggtatgaaaaatgagcatgagacaacaacaaaggtggaaaggaacaccattgcagaataataccaaagcacattaacagtgctattacagtgcatttttctgttcagaacaacatggttccatgattttcctgcggcacacaattgaatgggcctgcagaacacattaattttgcacttgtagaaatgacagtcttgcaattaccattcattgtgcttgatgctaatttaatgcagtcatttccttgccaaagtaatgtctgaatgcaatcaagtaagcactaatgcctgcgagattccactacataagtaccagtttaaagaaaatcaccatccctttatttttggagagttaggttaaacacagtagctcacgcaaaacctctggagattaataggcaatagtcatgaatagaaaggcaggggcatatcctctccaggttaggccacattgcagataaagtgaaatgacgcctgtgtgttgcctctgacattatttcaacatgtttacacaaaagacatctaaatatttccttattatctgtttagcagaatgagttttcatttgattcaattagtgactttaaccaaaaaatttaaatagaagactgcaaaacatatttggaaatcatttatgagcatccttctgagtcaagtacctccttgacttggtagaatgacagtggaactgtttcagaggaatcccacagctgtccaggaaagctttgtctgcactgaggcaagctccatcagggactggaaggatctcccagcctgatgctgtctctgctctggacctcactctccaggtagcctggtgcctgcacagcagttcctgtgaccgccccccacctcaggctggtgcttcagccaaacagctcagcctctacaaagagctttggcattggccgaagaatgagctccatgcaaggccttctctggccttcctttgggagtataggtctatgcttgcagatgtggaaaacatcgctaatattttgccaagtgaatgaagcaaggcccaacctaccacacacagccggactacgtgtttatacaaaataaaacatgcatacacgcagagatgaggcaaacaaactgtgagaatacacgccaaaatattaactgtggttattttttgcaggaggataaaaatactagtattttttcttattttattttgctttaagttctgcgatacatgtgcagaacatgcaggtttgttacataagcatacgtgtgccatggggtttgccgcacctatcaacccgtcatctaggttttaagccccatatacattaggtatttgtcctaatgctctctctccccttgccgccaaccccccaacagacccctgtgtgtgatgttcccctccctgtggccatgtgttctcactgttcagctaccaattatgagtgagaacatgtggtgtttggttttctgttcctgtgttagtttgctgagaatgatggcctgtagcttcatccatgaccctgcaaaagacatgaactcattctttttacagctgcatagtattccatgttgtatatgtgccacattttctttatccagtctatcattgatgggcatttgggatggttctaagtctttgctgtgtaaatagtgctgcaataaacatacatgtgcatgtttcttattttgtttttgcttagctacattttccagtctttgcacaatgatgtatttcctctaacatcattattttttcttctttggaaaaataatagtaggaagccaagttcttaccccagacatttgagggataactatctctggtcataaaatatctagctatttattagatattattggaccatctagttgtactttctggaatggagaagcatggtcaggtgaaaattttatgtaattatattgtccctgagaatctcaatacatttaacaatgcatttgttaaatctcaatacatttagcagaactcattttccacaagcagctgaagagatcacccttcagatgggcatcggaggaagggctgccttgttggggtcaggttgcatgaaaataaagacctcaagacactagtatcacactcagctatgtgagaggctcacactaggacaggcttgggacccaaaatagcccaggtcataaaatagcccagggggacagataagctaagtctcacccctgtatattattagcccatccaggagaatggtgggcagacagcccatactgtttgaattctgtttttccctcctctccttctccccctcctccccatcctccttatcatcctcctcttcttcccttctcttcctccttccttctccgttcaccataagcacaatctttatttctacatcaatccctgtctctgtctctgtctctccatattccatacctactttccctctctccctttcttttgctggagtgtatagttgaatatgtaagtgaaattaccgtgtcttgtcactttgttgaactaggaagacagggctggatttgagtaggttcctcatgatcatctcttctgctttgtagatgatgcactgatactcactattccgcactagtcaaaaccacacaagaaggggacttcctctaacctcttatccaaaacccttttttcttttctttctttctctttttttttttttttttttttttttttgagatggagtttctctcttgtcgcccagactggagtgcagtggcacaatcttggctcactgcaacctctgcctcctaggttcaagtgattcttctgcctcagcctcccgagtagctgggattacaggcacccatcaccacatccagctaattttttatttttagtacagacggtttcaacatgttggccaggctagtctcgaactcctgacctcaggtgatctgcctgcctcagcctcccaaagtgctgggattacaggcatgagccaccacacccagcccagagccctttttcaaagagatgcctaaagatttgaccaccagttaaagtgttagctctcccagggctacttgaatctttagtaggagtgctgactggggaatatttcatggtttggagatagcacaagggcgttgtggaaaccctacaactagaccatgcaggcagtctcctcatctgtcggcagataactgagcagcatcccatcttctcagcacgttcatcaatgaggagcagtttaactcagtggaggtaggtcccttccaatgcagaattccttggcaccccatcggctgaggctgaggggagaatcatcccagactacatggaaggtttaactgtgggtctgtcatccccaggattattggggaccgaatggatagttgcttggtcatgccaaagatagttttctaacattaaaactgctccttcttggagagtcagatcccaaaacactcaagaattctataattatcaatgtcacttttattactaaccagaaattagagacataatttgcagtacactctctgtgtgtcttctctgtgtgtttaagcaagagagaaaataacatacctatagtagaggcagcaatttctgtgtttacttttcgtggttgaatgccatagtagattgaatagtgtcccccaaaattcatgtccacctaggacttcagaatacaacgttgtttggaagtagggtccttgcagatgtgattatggtaagttgaggtcatactaggaggttggccctaaatccaatgactgtgtcttcataggaagaggagggggcacagaggtactgacagacatagaaggaaagccatgtgaagacggaggcagagatcggagttacactgccccaagccaaggaattcctgaggctaccagaggctagaagagtgaaggaaagattcttccctagagttttcgaagaagcgtagccctgagaacaccttgctttcagacttctggcttcctaggaaaataatacaagttcgaagaaaaacctaccatcttcttaattcttgctcttaacaaggatagcagctggtatttattgagaacttgtctgctaggcagtgtgctaagctttctaattgtgttagcatcgtttaatcctcaccacaacctggtgaaatgattgctattactagtgctcctattgtaccaagaaggagatggttgtagtagcctgccccaaggttcacatattagtaagaggcaagactccctttcctttcattttgtagcaactaaaagcatagcctctagtcttaaagctttttgattattgtgattgagtaaaaagaaattagaatattactggatgcagagtttatcataaaaaataggatacaagaattgaacagacactgtttttttttttttgctacatctaggtgtaaggtttattcatttattgactcttattgagcaaacattcattgaacacctaatgtgcccagaagtcttgaatgtatagttgaatctgactacactgaaatttccaaagcattttaatggtttacagatacaaaatcaggcaagtctagaatatatgataggaatacatgtgaattggatatcacccaggctgctgaaaacagttcttcattatgatcctttcaccaagccaagttaagcaagaacttatcatcaagagacacaaagatatctccaaattcactcatctgcactttttttaactataaaaatgttcatgttcatatgccaaaccaggactgcagttgaaaaatacatttctttaatcactctgaaaccattttctgagttagggagttctgttttcttctcaaacattcatttgtttattgcttagaaaaaacttgaagaataaaagtcacaggattactgagtgaccaagatttgaatagtcattcaatcattgcagtgtttccatcatttacagtcacacaaataatgtgccaccctccctgtgttccagctaagtctcctattctccctatgagtattgtgaagttagctaatattttataatctgtattattaagatggtagaagaaattgtttatagcaaattcaagtctcaacctataagatgatgatggaattagatgtcagtttgaatccatctttctcacatacctgttacgtaaccttaggaaaattgtttgtcactgagccttatcttcaggaatacatagtaactacctcttaaggataccttgaaaatcacacagaataatgtgaatgaatttccacatgaaggacctggcacacagcagtccaacagcaaatgtccttttcattcttagcagctctttgctttttggtttgtgtttttgtttttacttaattcatgttgtcctttaatccttccctaatagctttaaatgtcaaatgcctaactggcattatttcggtgatccttgagtattggattgtcatttcggtacttcaggagcagtggcagtgtcctaaaatgtcatttctacttaattttggtcacagtaaaagtattctgaagccctgaagggctgagaagtatgcagagattctggaagatgcaactggaaaccacacccaccatatcggactggttttgtcaatagcgcaagtcttggagcaatgtatccagtcctttcaagaaccaagttgggtcaccttagtaactcctgcatcccttcctgactcaaggcccatcaggagacaagaaagcgctgattagccaggcacactggctcacacctgaatcccagcactctgagaggccaaggtgggaagatcatgtgagcccaggagttcaagaccagcctgggcaacatagtgagaacttgtctctacagaaagacaaaattagccaggtgtggtggcacatacctgcagtcccagctacttgggaggctgagatgggaggattgcttgagctcaggaggtcaaggcttcaatcagccgagattgtgccactgcactttagcctgggcaacagagcaagactgaggaaagaaagacagagggagagagggagagagagggagtgagagagggagagagggagagagagggagagaggcggggtgcgggggagagagagggagggagggaaggagggaaggaaggaaggaaggagagaaagagagaaagagtgagaaagagagagaacaagagagagaagagaaagaaagggaaagaaagaaaagggaggagaaagagggagagaaagaaggaggaggagagaaggaaggaaggagagagagagaagcagagaaagagaagaaaagaaaagaaaggtcccagactcctttttgctccaagagacctcaggctcaagtccacgttatacctctaaggaagagagggttttccacttgcctcctagagaaacatttcttgttggatgtgaggtagtgggtttgccaaaagcggttggaagactgaacaaattctgttccacagctctcagtatgaaacagggaccagaataaatgcatggtctacccttttagagcaggttggagagaaaattaattaatacaaaatatataaacaaatagggagaaaaagaagagaaatgttggaagtatgcatcttagaatttcacccctatgtgaaatcagctaagctgttagtgacaatggccatttttcctcaggtctacctatccagtcttaataatcccagcttggaagacactttcacatcagtagggagagaaacttttcacaggcttctttttcattttcagttggaacaggaggtttgacagatttggaagaaggcccaaaggaacaagaatagaaccctttttttttcttttcttcttagagaattattcaagtagagaaaatatcccttctctcttaatgtatttcttaaatcttcagaccttaggatgcaatttaaaagtatcatggtaactgtgatggttaattttaagtgtcaacttgactggtgttccatagggagcaggtctatgcaagcctacctccaaaggccaagggagctgagaggccaaagaaacagtctgacaaagccagtttctcagaagaaaaaaaaaacaaattgaatagggacttaccaacagaagttgcgtctctggtatctacaagatgagatggtggattcctttacctcctcagacccagggcctatataccatagagaaagggtctacatgcttcagaagcaagttaccctagagcagaatttgcagtaaacagtagataaggtggaaaacttagtggcattctgcaactgggttattcagaagccagcatggtgcattagcatccaagaaggaggtgctttagcccctacacctagaaatctgtaaagcattactttgaggtgggtctgtgaggctgtttccagagaacattagcatgtgggtctgagtggatgaggtggggaagagctaccctcaatgtgggaaggcattatcctgtctgctaggggctgcagagaacaaaaacagagaaaaggtggtagtgtctatctatctactagagatgagatatactgttttggggcaactccaggctccctagcctttgggctccagaacttataccagattctcatgcttttgagcttgggctaagagttacaccattggcttcttttgttctgaggcctttggacttggacggagccacaccactggtaccccagggtctccaccatgtagaggacgtatcatgggacttctcagcctccacaattacatgagccaattcccctaagaaatcccctctcgtatgtctatatctatatagtctgttgattatgtccctctagagagaaccctaataccataacgcatgaaaataatctgattaaaagcttaaaaaataaagagagaaggaagagccaaaaagtcagaaaatatttatggatgaaaatccataagtggacagaagtccacaaatatgtatggaaaaagaaaataattttgacttaattcagaaaagtcaaagctgcagagatagctgccaagtttaagtggctttgttatagaattttgtggtggtaaaataacattccccctagcctgaggttctctttggggtcccagatatttgagaaaacctggccaattaactttcttagagaaagagatttaaaaattcagtgcagaaaaagcaagtcctccgtaaactgttctaaatctaatacaggacaaagtgttcggatttggctttggttgtaggataaataacttttgtttcaagtgtgtgcccttttttttttttttttttttttttttttttttttgagacggagtctcgcactgtcacccaggctggagttcagtggcacaaactcggctcactgcaagctccaactcccgggttcacgccattctcctgcctcagcctcccgagtagctgggactacaggcgcctgccaccacaccaggctaaatttttgtatttttagtagagacggggtttcaccatgttggccaggatggtctcgatctcctgacctcgtgatccgcccgcctcagcctcccaaagtgctgggattacaggcgtgagccaccgcgcctggccaagtgtgtgcccttttctaatccccaccagtgtggggacacagctgaattttttttcctgagtgttttatttgtatatgttgttgagtgtttttatttcctgttcttcagcaatgatcagaactctaaataatgtgaagttcacagaaataacactctttatcttttcccacatattagctccatgacttgagctgaaactctatacatttcttttcttttcttttgtgagccaaaaaggaactggtctgataaattgtcctgagggttttgcttttagattgctcacatgtttggctgccctgcaagcaggtccattcaccaacgtccacgctgcccttgagtactccatcacgtctatgggccatgaagacctgcctctgacatgcaatttcttcactccacaaccatttgcgcgcttatcatttccaacaggcagctctggccttagcaactgggctcattccaggcattccttggctacaggaaatttactttcttaaataatcaagcctgagactataatgctatagcctacccattttatagatcaacctggctttgaactcactcacatatttttacctctattaattccaactggttacaagagtgtttgatttagataaataggcattttatatttttctgtttaaaaccaaatcctgagaaaacaaattatgaagagccagctgctctctctgagccatccttttcttggcattttaaatgtattaccttcattttctcaagaggactgggcacaggatatagtgaaatgtttaacttgactaacaatactttctagctactcttccaagggatatgtttactaaatataaggtggcttttacagtattcaagttctataaggcaaagactctcaattaaattaaattattggcagtacaatttaacattctacattctgtgtgaacgaagtaatttcaagcagtttgatcattaataataattttattccttcctatacactgagcacaagtttagtgaaatacgggaacatgtacagagagcctgctgtgggggaagcagtggattgccagcaaggaaggacaggatgaataagactaggctgggaatgcaatggaggggatagaaccaactgcagcatgcagggaaacaagccagaaggccgagtgagagacccccatggatacccacgctgaaggttctactgggagggctgcctgattcaaagtcttgtccaaggacagcatggcagatagtggtgggttgcacctaattctgagggcgtaatttgggttaagggagaagactctttggaaaacatatatcattaaagcctaaagtctaaagacaaaagttttaaagcatctcaatttttttaaaattgtctttgaaataatacaattgatatttacaagaaatacttatttgctttttttttttttttttttttttgagacaggctttgagctttgttgccctagctggagcgcagtggtgcaatgatggctcactgcatcctcgacctcctgggctcaagtgatcctcccaccttggcccccagagtagctgggactataggcatgtgctaccataccctgctaagtttttaattttttgtagaaacagggtctcactgtgttgcccaggctggtctcaaactcctggcatcagggtatgctcccacctcagcctcccaaagagctgggattacagtcatgagccaccatgcccagcctacttatttgcttttaatattacaaaattgaattgctttagacattaatagtggacaaaatattttaggagttagattagcttaactatttttcaaattatattccaccagccaaaaatatttcatgaggctttgccttctttaatttctaatatgaaaacagtagggaattttttccatttttcaaaaagttattctaataattaatatgattttctcaaaatacacgtctccttgcagttttttcccttactcccacctccagataattttatatgaacctagtggacaccttccccttgagtatttctgccttaaagataactttaaagatacaacttcaaagatagatcaacaaattgatatgtaaaccaggcacggtggctcatgcctgttaattccagcattttgggaggctgaggcaggattgcttgagcccaagagtttgagaccagcttgggttacacagtgagaccccatctctataaaaaaaataaatatctaaaaataaattgacatgtaaataagtttatctttgctttttgttaaaagaggtcttctaaaaacttgcttttatcaactttaacattactaaattttattttagtattctgaagtttagaccttaactaatgcaaatttgcttactttagactagtacaaatgacttatgatttacctgtgccagtagccaatctcactttctgtgcttctccctagggagttgggtcaagtatagcttacagagaaataccaaattctagcccttatgtgaatcatttctcagcaatcctcaaaggcaccaaaatgtcctttcacatcttctatttctttccatcctggatttatgaccagaaacacagacaacactattctaaactaattttgtttaaagaaaggggaaatttgtactttttgagtttatcccaattaaagagggaatcttatattatatagaacagtggaacaagagtaacttgaattccaatttcaacattattaaaaaccaaagtgaacaatcctaactaggcattctgtttctttataaattgcactaattatataaaattcattattcacaaggctgtgaggatcaaatgagctgatggatgtgaaagtgctttgaaaagcattaatgttataaaatgcaaattattattaagtttattaatcattgagtcactgaaagcctctttagtgagaatcctgcaaaatgtaaaccattatctttcaagagctgctaggaaatcctagacagaacttttctatctgtgttgttagtgttgccataaccaacagcaaaacttttccctctcaattgttgacattagtgctcgcccgtctctctgtacagcactgaaatgcgttatccagaagctccgtgctcacaacaatccagcaagactttagacctcagagttatactagttcatgacaggcagtactgtattcatagtcagccaacccttgaatgcatggccctgattaaattcctgtctctgtcatggaattggcatgagtcatttggcctggaacatcattaaagcagcaaacacacttgagattaaataagaatggattctaaaacatcctcttgaggttgttattgagatcgttagcaaatcatgttggttccttgagtatcttatagagtttcaagaaataaaaagcaactgctacattgtagaaagtacatctaaaattttcctcttatcccaagtgattgacagtctctctgcatcctctgccccgttaccaaggatgataactcctgttcagatgaatgagtccagatttttctcaggtctaagccaaatgtaacccaaatatttgaacaagtccattgctagtcactttttagttttcagagatgaataaagctataagtaaaatgctttctaaagctttactattgaagtaatttgatttaaatcccttttaaataggtctattttagcctgttgacttttatatttccttaacaaatgtctcttataaaggaatcttgtaaattcagttaaaaatataaattaagtcatgtaagtcaaattaaagcagtagatcaagttataaattgaaacaagtttataatccctctcctctattaactaagttaaaatgttatcttctgtggcctcatacaacaacctcctgaatcataaaccacctgaggttatgacaaacacttaataacttcttttaaaatatcaaggactattccaaaagacttttatttctgttactataatgaatttatgattactcagactttcagcttttgcgctaacattcaaatgtcattgggttacttattccaacacttcttctattactatagatggttaaaagttcaggaggccccttttgtcacaaaatcaaagtatgtcgtggttgaaaggactatttcattcattcatattcaactgatattttattaaacatttcctgttatgccaggcactgaactaagtgtgttcacatagtttaccttatttaatcatcacaacaacattcaggcattgatatgatcacctttatttacaaaatgaagaaacagagacttctagaggttaagtttatcatccaaaatcacattgctagtaaatggcagattgagattggaatcctaggtccctgactccaagcctagtgttttttccaccatatacactagaatgatgtcctctttataacacactcactggatcagatccaagttgtgttcatggagagcccgggaccacatgaggcagccctcttcctatttgagcatttcagacaactggaaagatttccctcatcctgaaccatcatctctattaaagatggagaatgtctccatgaagaaacagtgggtgtctggctctgggttcaaattcctgtgcctgtaagaactcagaaacacctatgcaccttcaaaatccccaactctgtggagataaggaagagcacctggcctaagtttgacacaaaaggggtatttaatagctgattcattccttactcttctgtttcctttaccaaagtctcaatggcccttaaaactaatatgctgacacacggtcagtggtccaatttgctatggctattctcccaatgccccaggaggccttgaaagatattggccttgcttgttgtccaatgtagaatggtaaattaatgagatccttggataccagataacacagcttgccctgtgtgtcctctttctatcttatcaccctgatgactcagggcaggcctaagtcctaaaagttctgaagaagtttcccttctttctttgccgttctttctgaggccctctctgtgcggttgagcaaggaaacatacacacacacacacacacacacacacacacacacacacaaacagagccaggtgtgagctggacctgtcggtttctaacaataagtcttagataacaagataattctttgtgtttcttagggtgccacccacacaccgtatccatgcttttgtgttaatagcagagacttctctttctgaatatatgaggagaggaataaaacaagggatgtgaccaaataaattcttctgacatgagagaccactttagattgccttattacaaagaagctgatttgcagggtaaacacaggccatgccctgtaagttttcttattgatgaaattcatgctttgaattactgattgatggttgctgaaggatggcaatttctctgttccagtctggagactgcgctacgtaaaacgagcttctgatgatggaaattctaaaatccaaacaaaacatggaaacaattttttaaaactcgacatctatttctatgaggagctaggagggtggatgcaattggtcagctccagctgtttccttgcttttattgcacagttgttacaaagaggaattcagtgtacaactatgagcttccggccgctcaagctactgcattacactacatggccatactctgatcccaacatgagctttttttcctctagccaaaggataatgtaaaaattatgacacaaataaaatatttatcctctaggcatgagtaaaggaattcacaaatcagaacatagcttgcaagcatacaagagtatgcttgagcagtcccctctttttaataaaaatcaaccatatgaataaaaagctgccctgccccaacttcaccccctacccatcacagaccacaccaccaccccaccatccccgcatacatgcgtgcacacacatgcacacacacacacacaaagccacccactaccattgcagcagggaatcactgatttttttaaattaaacttttagagaacccatgagtttagatggaaaaaatcgtgggagagtaggaatagtttaaggaatgtgcttggagaccagccactcttcacccaaaatgatttcctttgaaattcctgacttgttccctttctgtcctgtgacctattgttctattaggccattctattctattacagcatcatttgaatcagtaggagtgggtctgggaggatggtaataccatctctttaatacctcaatgtggacggaattgaaatggccaagtccttacccagaagagctgtcctgaagaaggagcattgagtttgaagggaggagccaggtgtaatttaggagtggggaagacattggacaagctttgaggagatagttaagatgacttccatgaaaacagagagctgaagcctgttagtaacagactggaaggaagaaagatactcctttctttgctgatcttgcctaaagccagcaggtctgcactggcaaaaagagaggaaactgtctttctctcccctctggcagtttctcttctactaagatccagaatccaagctaatggcattagtgctataatttggtttcactactaaataatctttagttattgatccatgttagaattttgtactattggaaaatgtattctgagttcctaaaatcaatttatattattataatgtatgtaccgtactatcattatgtacatagtattagcatatatagcatttcattcccttgaaaccacttggtcttcatacccatcacttaaaaatactgcttcatattattccacccagtgggtttaccaaaatttatttaacctaaatatttcacaatagggaaatggcaatttcaatttctgttcttaaaattgtttccaatttttttattgtaaataatactgcagtaaatgatttttgcaagtggcatttcaatattttacattatttattgaggatggattgccagatatggagaggtagagttagaggatgtaaaatgcttaggcttttcacgtacaaagctagtaagattttctaaacacagtgccaaagtacatgcagtatacactgagaatgccttgttctctgaacactaccagcaatgtttttcttttttttatttttatgaagataataagctaaaatggtaacctatttgcctttacttcctccaaaatccctagaaaaggatttcaaaatttttttgaaggtaagagtcaatctaaacaaagaggacaggagaggacagcaacatttagaaagacggcaagcaaatggaggaataacacacttagtagacaaagggaggccaacccctaagctggttgagggagaagctcaagagcaggcaattataaaagggcagttccttttataaggaaccgactcctgcaattactgccttaactcattcatgaaggtggaaccctctgggtcaggctctggtgagggccctcttctgggtggcagaagctcaagggcatggctcctcttctctttgcccttctgccatgggatgatacaacaagagggctctcacaagacgacatcccctcgatcttgaactttccagtctccagaaccacagccaagacatttctgttcattgtaaattatctgcggtattctattatagcagcacaaaatggactgagacaggctgctatagcggactgccatagcagtctctgttgcactagaaggctcagaaatgggtagcccctggcacctcagaaagatagacttaaaaacggaaggatcagctaaaaatttctatatgaagacaatcttctcctcactcttgcagctgggtaactgccccagagccaaataaggcagaagacccaagatttagtgtctggaggggcttcttttatctcttgaagatttggaagattgtgttttccaaggacggctgccacaaaagctctcctgacacctgtgcttccagagccaagtgactgctccatcaagacgtgatatctagttttcctctccaagaatctggacagccttgggacttgcttaagccaacagaatgtggcagaaattatgctgcctgacttccaaagctaggttatagagccaaggtgacacgtgccttggggactgggccatgcacattggagtactgattgcccaggaaagcagtcaactgccctgaggccaccatgctcaaggaactgcactaggttacgtggatcggacacatgaaaaagctttgagatgacctaaggaggtagagagaggccaaatttctgattcacagaaaccattagagataatgaaataattgttgttgttttaaaccagcaagtttggggagcaatctgttaggtagcaataaggactggaacagagaagatgaataatagttttttggttttccaaaagaacttactctccaagtattatctttgtttttgctaaatcctttgtattagtctaggctcttagagcgacagaatcaagaggagatatgtacctatatctgtatctctatatatgaaaggagatttatttggggaattggcacatgcaattatggcagaagtcccacaatcggccgtctgcaacctggagaaccagggaagccagcagcatggctcagtccaagtcttaaggccacagaactagggaagccgatggtgtagctctcagtgggaggctggagccctcagacaccgggcggccactggtacaagttctgtagtacaaatactggagaacccagagttctgatgccaagggcaggagatgtcccagccctaggggaaagacagagagagagagagagagagagagagagcaaaaaaagaaaaatagaagaaaaaacatgcattcaaatcattttgtaactcctaattattaggacgataataaaagaagattccagattccagacctagagagcaaccagtacagactgaacaaggaagatgaagagctccatggggactatctttgtctttagtctctttgggctgtgctaaggattgaatgtgtcccccaaaaagcatgcactagaaatgtaatcttcaatgcagaagtgttgggaggtgaggcctaatgggagatgtttaggtcgtgaggactccaccctcatgaatggattaatgctgtaattgcaggagtcaattccttataaaagaacaagtctggtccccttttgtgcactcttgctctctctctctctctctccctctcctctttcctctgtcttctccctctctctgtgtcctcttctctttgtccttctgccatgggatgttcaacaagaaggctctcacaagatgccatcctcttgatcttgagcttcccagctagcttccagaaccatagtcatatatttctgttcattatacattatctgcagtattctgtgatagcagcgccaaatagactgggacaggttgctatagcatactgccatagactgggtggcttccaaaacaaacattgatttctcacatttctagaggctggcagtctgagatcagtgttccagcatggtcaggtgctggtgagggccctcttctggattgcaggctgctgacttactgttgtttcttcatatggcagaaggagagttcagagagctctctgggtctcttttataaggggactaaacccattcacaggggctccaccctcatgtcttaatcactttccaaggcctcacctcctcctaccatcaagttaggggttaggatttcaacatgtgagttttgatgggagacaaaaacatctggtccataacagtcaagaaaaatataaaacagtttacttctgtttccttccagtggtgagataagggatgagttagtgatgagtgtgcagaaaacaaggcaaatgaagaaacaaaagattgcactggaatgtaaatgcaagtgttttacaacatatatgatcaagaacaatgcaagcttgttacttagaaatatgaagttgatgccaaaaataagatggcttctgaggagtgggaagtggggaggtggagtggagacttccgttaatgtgtttcagggcttacagaagcacttgagtcctttcttaaaaatgtgtaaatttatggcgtacaagggtaattttgttgcatgcatggattacatagtggtgaagtcagagcttctaaggtctccatcactcaaacaaaatacattaaataaactctcgtcatccacccctacacccttctgagtctccacactctatgtccatgtggacccattgtttagctcgcacttataaatgagaatatgcagtatttgtctgtctcggtctgacttgtttaacttaaagtccttagactatgtatgtcacaacattcataaaaactgatcaacttaaataccacattaaaatgattacagaaaaacgcaagcaaaaatataataaagtaattttttcccctccctcaaagccaactgataacgaaaagaaagaaatggatgaccaaaaaaaaaaacaaaaaacaaaaaaactctccatgcagtgagccgagatcacgccattgcactccagcctgggctacaagagcaaaactccgtctcaaaaaataaaaaacctccaataaaatatggcaatgctcattgccacaaaccacaaattaggaaggatacgtgacacatgccaactactttgaaatttgcatcagaatgagagaggaggcagttaattcatgttttcttaacttcactcaaagttcagcaattcctttagctctatttcagtttcttcatcctattgctttcttatgaaatatgactttatttttttcctataaaagtagcagaaatgattgaaagttctttgcattttttggcggtgtttgaatttttaataagggccacatgtgtctttctaaaaattaacctattctctttttaaaaattaacaaataaaaacttgttctctttttaaaaattaacttatttgttctctttttaaaaaatgaagatttttttcctcaaaatgaatatacttttgaggtaagaggattttcacctagtattctaaaatcacaaaaacaagtttattatttttattttattgcaaatatttttcctacatggttattttcagatcaaataataggattttggaaataccagcctgaccatactgcacagattgagaggttaggtactaaattataggcttttagagggaggtaaagatattagagtccatctccactccactccccacagataagggccaaggccaacctagccattaggtggggtggacacaacccacgttttgaggggcccacacatatatgttaaaatttctttagaaatcagaagaatacaaatgaacttcggggtcaaagaaaatattttaatatttaacattaatacattttctcttgaggccaacattgtcatgaaatacacattttcataatttttttttgtggaagaaagggaccacaagggcaagtgtgcctggggcccatgaaagtcataatgtggccctgatgaggattctgggacctaaaaagattcctgtaattggtggtggcagagtctggaccaaagctcagggcctctaactcctcctctatggtgctttctgccatgctgttctctggcttgggtattccacacactccatggtccagcccacactccttatctgaccttacctctggccatcagtcatagttcatcttctgctccagttaggtaggcccagcctcatttcctgtaattcatcacaaacactctccatcccagctccatggagcctcccattgttcctagtccactgctgttcattcccagcactggctctcactcctcccactctccccatgtggagaatccttcccgtttccttctgcttgttcaagaggatcctcatctctggagactttgtcttaacactgcctttttttttttttaactgaaacagggtcttgctctgtcgcccaggctgcagtgcagtggcgcaatcagggccaactgcagccttgacttcctgggctcagatgatcctcctgcctcagcctctcaagcagctgggattacaggtgcatgccaccatgcctggctagtgtgtgtgtgtgtgtgtgtgtgtgtgtacatatttttttttgtagagacggggtttcaccatatggcccaggctggtctcaaagttctgggttcaagcaatccacctgctttggtccccaaagtgttgagattacaggcatgacccaacactcctggcctctttcaagtacctttaaagactcctccagccttgagtgatctaccctatgtataaaagcatttgccatttagtaacaaattatcttttcttattcatatttgtcttatatgtcttagttttctttccccaattatcttgtcaggtccttaagctcagaagcgatattagtcaaggttccccagagaaaaagaaccagtaggataagtataatatagataagagggaatttattattggaagtgacttatgcaattatggaggccaagacagtctatgatatgccatctgtgagctggaggcccaggaaagcccatggtgtaattcagtctgagtctgaaggcctgggaacagggagccagtgtgtaacctccagtccaagacgagaggcctaagaactgaaggaagtggggtgggcggagtcccagggcatgagaagaaggatgtcccagctcaagaaaaaaaagagacaacttacccttccttcacctttttgttccatctggcccctcaatggattggatggtgcccacccttattggtgagggcagatctactatactcagcctactggattgaatactaatttatggcaacaccctcacagacacaccccaaaattatgttttaccagttatctgggcacccttagcccagtcaagatgacacatgatattaaccatcacagaagccatgtctcatatactcactgagcatatatatgatcagcactcagtcaacacccaaatgattgtcagaaatctctcacaactccccctacaataatagggtcaagtgctacctcttctgggtgtcagaaataggcttggctttcctttctctttcttgtatttgtaccctctgtgatgaaagtcacgctgtctgattgcacattccttctgggcaagggctgatgtcttctcattatgtattgtcagtctccagcacagtctgtgctacaaagtaggtgtttggtaagtatttgatgaatgagcattttctagaaccaacttttaaattgaatttcttggtcctggagatgtttatttttcatgtgagttttccatctctgaaaaaaataggaaaagaaaagacaaggaaatgagaaagcaacttgaaaacaggaaaatattggtgaaagttattttcacagaagtcttagttgacctttctctgtagcattaaattccttccctgtagtattaaattcacaacctaagctatagctagctttccaaactagacaagcatcccacttaagcacaattgatctcatttcagtttgtgtctttgggcaatgaaataccgcaaagactttttctacctatgctttgatgctttttaaaaagtattttctaaatatttttaaaatgtttgaaatacacaatgataggataactccaaagctgtcatatttgtcaaataattcaagtcagaatttaatatatcctataactgagactcttttataaaattgagacaggcacctgaagaccatttttatttctgtattttcttggtgtcccaagcaaccccctttagagaaatcactaatatttcctgagcaattgaaccacaataaagaccgtggaaagaaaaaaaatgggtctgctcagacattcagagcacgcatccttacaaatgcattctactgacctgcaaaatgttagtgggaatttataaatgcctacaaaaagaatatccaagtcaacatttgacctgtcaaatctaatcagtttggttttgatcattgtaccgggttgctattcgcaaacactaattgaaagcaaaaacacaaacagcatttttaaagagtttctaggagaatatcccatttgcacacacgtcagattaattttccccagagttgagcaatttcaggatcaattgattactgatcccaaggaacaatcaaaaaagaaattccctgaaaaatttttttgactgtcaagactcagcatgggaaactatgccatgaaaatgcagtttgaatagcttgtcttttaatcccaagtgaaataaatcaatcatctattagacttttctagttccttgtgtagtcagggatagaagagttcgctgcagcaggattcggaggaactggggggatctgggtccaggaactcgtctgatcactagaatggggcagggagtgagcagaggagtttgcagcacacagtagaggaagctggtaggcacagaatagtaactggcaggcttacagctgggaccagaggggtccagcaatgataacagctcccggcactttctaagtgtattaattaactcatttattcacacaagaatccaataagggagatagttttaatagacccattttactaacatgaaaactgaggcattgataaattaagtagcttgctcaaagtgacccatctctttggcagagcaaggatttgaacatagacaattttgctctaacacctgtgcccttaaccactgacttgtaactgttccagggagaagatgagcctcttttgggcagcagggcagtggacagccactgaaaatgtgagagctggcaatattcaaagaggcacattgagatccttccaggaaagtctaactgcttgcaccagggtccaggctcaagggagggattcagggagcagcccctagaagtaagtgctttcacttgctaggcagtgcttccctgactcttaggctgcaaatttctaaaaggaaaaaaaacaatgttaaacacgagtgccagtttatatacctttatatattcagttatacattttgtaaatatattacagaattaatgtacatcataaaatacacacaaagggaaaaaaatcattcctttacatcaacaacctactataaatttacttcaaatagcattcatcagtactagcactagaaatgtgtgtccctgacgaaaaatatgtttttacataatttagatcttttattttgaaatttatcagaaatttcttgattagaacccagttttcctagaattattccctacttgttagattatttatccacatatagatgattccgtgaaaaaatgcaaagcaagacccttgatatattgtgtaatcctgaaactatatattaaaaacaaaatagtcttttagaaagcctgcagcagtaccccaaaataaaggtcacccaagaagaaaaattctccctagaataatgcctttaaatcccggaaacgaaagctcaagtgtttacccgttctttttaacattttcagagcaatacaacagagtcaatgtatgaaataaggcattggagttcagtgtaagctaccaccaatgacagaacatgtccattcagggcaaagatttatttttctgattataccaatgacccacacatacacaaagaaaaattaaattgaattaaaagaaagcatttcagcaatcttgacaggcttgagccctctgacagctcctagaattctatcagccgatcatcatcgtgttgctaaagccagctgcctcttgaaaccaaatttaatggaaagaggaggagctcaacaaagcagcttaaacatctcaccttcaaagctcattgaaaactaggcttcctatcagtcatgtgtcaaaggttcccctcatcctacaccatacagattagttcttcaagttccatttgtgtggtcatcctttgagtttccttgaagctctaaaaaggctaaaaggttatttccatctggagccactggagccttaatccatgtatcttttccctgcgcgaatctcaacatggcggaactggaaagtgagactcccaacttccatgtgaagggaacgatgtcaggcaggctgagaagcctgagggtggctggttccaaagggactgacccaagcctgtagcgagcaaggaggctgcctgctacccagagccaccaccccccatggcagcagatcacagcccctgttctttctcttttgaagcttcaggttagggatgggcaattcatagcaatttgtctttgaggtgataggtttggcaaaggggcatgatccaagaagtaagaaatgtgtgagaagtttcataaaggttgatggcgattgtgaccatgtgacctgtgcaatctttaactcatcgagtatctaatgtagattcttaactgccttgagtgcttttaagggactccttctgtgggggcttcatggggatttttcctaatggttaagctatgtaaatgtcttccacagctcctgtaaaatctcccatgctgaaataactacatccctgctctacagctatgaggattgtgaccgtatgtgtcccagcaagtggtagccaccatcataagctttggaggacactgtgttcttctagatactccctgggccatcttttcagatgtgccctttcagaagtggtcgccctttcagatatgtccttgtcttagcagttggttaaagcttcataggatatttgtattcaaggtgctagttcaaaaacatgaccttgaattcatagctgcgaagctcaactgagagaaaacatatttaggaggatggaatccacgcattgccgtagaaaactccttctcaccctggtggatacaacttttgaaaaatattgatacctgggccccatctagaaattagtctcatgtgggtgctcagagaacatagggaggtcattggggatggagtagaatgagcaaagaagagaagaaaatagggtgagagaaacaatggggtgtggaatggggagaagaggtgcagattagggagggcatggcaggccatggtaagggcttggcttttgcccagagggaggtggagttcatagagggttttgagcaaaggagtaacatgatatgacatatattataaaatgatcactctggctaaattaattccttttgccattgcatccttaaaataaacctaaaaatgcagaaaaactgaaaacaggaaatgattttccaagctgctactcaaatgtctaataacaagaagtgactagaatcctaaatcccagaatggtccacgtattatctccccagattcctgatagagatatgtagaaggcacatttcaagcaggcttatattgttttattctaagagggctgaactgggaatgtgaggtttcaagtccttctttgcttaggtgtatccagaggtaatacccagaaactcaaatttagtggtttgagatagactgtagacatcctgttgttaaaatgattccaatgcccatgtcgaaaacacgtctccaaaggctggaaaaatcaactgacattgacaaatgcttttagttttcctttcttggactctatatagctgtactgtctatacagtaaccacaagctacatgtggaggttgggcacttgaaacggggctagttcaaattgagattgtgctataagcataaaacactcagtagattttaaagacttagcatgaaacaataggtttatgtgttagtcaaggttctccaaagaaattgaaccagtaggatagagagagatacataagagggggtttcttaatggaaattggctcatgttattatagaggccaagaagtcccatcatatcccatctgcaagctggagaaccaggaaagccactggtataattcagtctgagcccaaaggcttcagaaccagggggacaactggtgtgagtcctggagtccaaaggctggagagctagaagcaccaacatctgagggcagaagaagacggatgtcccagcacaagagagggtgaattccccttcttctgcctttttattctttccaggtgctcaatggattgggtgatgcccactgacaattatgatcctctctattcagtcgactgactgagatgctaatctcctccaggaatgccctcatagacacactcagaaatcatgttttatcagccatgtgggcatctctcaggccagccacattgacacacgaaattaaccatcacaatgtaaaatgtctcaataatttttacatagattacatgttgataaaatattagatatactaaattaaatacaacatattattaaaattcatttcacttttttactttttaaatgtggctacaaaagaattaaaattacaaatgtgggtcccattacacttcttttctttctttctctctctttttttttttttaaagacctctgtctcccaggctagagtgcagtggcacaatcatggctcactggagcttcgaactcctgggctcaagcaatcctcccttcctagcctcctgagtagcagggattacaggcatgcaccaccaggcctggctttcacattatatttctactggacaggactgatgtagagcttttcaaagactcctcttacataggaatcatagccctctatgataaccttcaaaatacacctacgatgctaccattctccgcagtaatttttttaaagaaaaatgctaaattgcttttttagatctttcttgtaggcaagatataaatagaaggctttgaaaggcaatacaacatagtagttaatagtaagaacttggtagatgtgtgactgcaggcaggttgtttaccttctctgaatctccattccctcgcctgtagaatttgaataatatgtaccccatggtgttgtgagactaaataacatagtccttaatgctccataaatggtagagcctttgtaattggtgctgaaatttaaagacaatgtggagttatcttggattcaggtgatgagattcaacataagaagcaatgcctcaagtccttgcaccaacagaggtgcagaaattcatcatctccctaatgaatcttgagttttctttatacttctgtcatttgattagaaacaaactctcagcatgtcagatttatattcaaatctcagaataaaaataattacagaagcaaaatgtcatttggaaagggtgtgtttggtggtcagaattgtggttgccacgtgccttcgctaaatatcatgactaaaagggaaagacatgcagatctttgctaggaaggcaagagaaagaagaggtgaataaaaggcttgaagctcttgctactctaatcaaattgttttatttgtgagagttcgctttagcttgctctttatgtttgaacctaagtcttttcacctgtgacctcatcaccatttttctaatattgctcagctcattagccttgaaatttataatttagtttttacaccattttatcctatttcttcccattgccaagcacaaacatttactttgtaaaaaaacgtgactgaatttattaaaccagtttgtcttcaaaagtttcccttttttatagacatgggaagactcaaatagttggtttccctaattctcaggagacaaaccagtgaagctgaagccagttttgtatgcaactaaactttgtgccccgtcctttgggtctccaattagaataaaatcagggatgggcaggcagcgtgcattttaaatcaccatccatggtcactattatttccaaactcaaaggcaccattagaacagggaaacatttgcaggcatttcattacaccttgaactattaaaaaaaataagacattagaaagaagtgattactttaaaactttcacacactatggaacaaaagaaatggcaatacacagggagatattatagtaaacaaattgacgcacacggttgttgttagtgaaggacagtattacaagcagatgaggcaaatgaatgagttgggaagagagtcaatctcacttcctgaagcaggggcccttgagaagcctgtgccttttaggctgtttctttgtaggattggcctgggtgctgaaaatagcatagagccttttgcagaatcctttatttcaaggagttgcggtatttcatatgtggcacggcccctcccttcaatggcctctctcctgccactggaaggtgtttttacagttccccttgtgacaaaggacaggtcagagagcaaacctgtgagcaaatcaggcttggcacgcacatcactaagcaacagatgctttctggaaaaccatttgggagtgtttcagatagtagtatgtgtgtgtatatacaaacatatacataatttctggggaaaaaatacatacatacatgtgtacatccatactttctgaaaatcacacacacgcattttccagaaactcatttgaggttgattttatgtgtacggagacagagaaagccatccatccatatagaaagccttttgcaagtatttttaatttatttcatagaagcctgaatttatttcacacaacaatgaataaatccattcttttgccacagacgtggtgcaaaaagaggggtgtgcttgaagcatctacaaaggggaaaaagctgctgatacagggaaaaaatattaaagtaaaattttagttgtcagctttgtaattgaagctgtctcctcacttgaaaatattgtttccactgaagtagaagacaaagggggatctggcaaatgcccccacgatgttcatttccccagataaattacacacatcgtgtgtgcatgaagatgaccagaggctctcactgtgctggggatacagtccaatcattcattcaaggctctgtgtagtcatacaacaaacgcgtggcctaaatccattctttttcttctttttcctttctcttctcattttttcttttttcctccttcttctgccaaaagacagataaagtataataactttgatgacaacctcattttcaggatctctcgataaatcataatccttcagttgtattttccaaaacctgcagttagccaattacttcttggtttccttgaggtgaatctttgctttttaattatattttatcttcttcaaagaaaccactattgaaaaattatagctaatggtagaaatacatcactaagatgtcttggattttcttttggggaggagaggtgggggaataaaatgaaaaaaatatgtatatggccaaattggtctgtgataccattaattcatgttcattaattcaaacagtgtacattgcatacctactatgtgctaggagttgggttgtactccagaaataaaaagtcaaataaaacgtgtttccctcaaggaaactatgttctccagcatctgcacatgtaaactaccaattccagtttagtatgacaaactctttggaagtattatattttgaatgtatttcatcgagaaatgaatgtgggccaggcaaggtggctcacatctgtaatcccagcacttagggaggctgaggtgggtggatcacctgaggtcaggagttccagaccagcctggccaacaaggtgaaattctgtctctactaaaaatacaaaaattagctggaggtgttggcctgagcctgtaatcccagcttctcaggaggctgaagcacaagaatcgcttgaacccggtaggcagaggttgcagtgagccaaggtcgtgtactccagcctgggtggcccagcgagagtacatctcaaaaaaaagaaaaagaaagaaaagaaaaggaaaaaagaatttctaagtctggttttcatagaaacaagtgcaaaacaagccagaggggtcattgccaaactagaaagaagcccagggccagaatatgcagggttagtggagaagcccagtgctcctgggcctgaccacctcttggactcggtataccatcataaacagcattcagtaaacatcttttttgaagaggcatagtaaagaactacctgctaagagtccagaaaccctgtgaggcctcagataactttagtaggaaataaccaagctcttgagttgcttgaagtagaatcccattagcttctaatgcttcctgtatttgcgccccattcaaggaagcaactctagagaatttctttgaatcctgttacttccatttgatgagtgagactcagctgtgatagtctatctgctttaagactgccgatacgatgtggcatgttctctaaagaaggcagaaggcttgaggacggtttgtgttgattgaagaacatttcagtgatgagttggaatatttagacaaatttcaaggcttaattaatatatgaaataaagtagttgcagagataacgaggaaaaccaaagttataatctatagttcatttaccttccttggtcagggcaaatattacaaaagatatgtactgcttttacaataatcagcaaatgggaatgactttgaatttcagaacacatatgggaatgtcatcaacttcgactttgaaatgtggctttttaaaattaaaatataaatcattctattgttaacaaaagtttatcaaaagtaatagggcttttgtagatttttggtttttcttttctattaagatctttactggtagagaaaaataaaattttattaattcaaagattccattgtgtttttatgtttgtgagtaataatcagtggttcctggtatctcatttcgtttttaattcccaaagcaggagctaataagcaaatcgctttgtgggtttctgtgaaaacagctagagtttgcacaatcgtcgcctagacagagggaggagtgtgggctctgaagttcagcagatttgcatttgactcttgactctgtgattagctgggtgtccttgagtaaactactcctgtaagcctcagttacctcatctgtaaaatagggatgatgacatctgctcaaagcgttgctgttgagtaattaggttaaatgagataaaaagtgcccattggcacctattggaactcagtaggagctcatgtcttcatggtgtgtaaatatgtacctggctcccatccacaagagtcctcgctgaatcaacaaactcacaagtgcctcttttcactagactgagactaaaaccgcgaattaaaatggtgtttgtcctcaagaaccactagggtcaagaattctacatggctcaggcagatcagctgagcacgtgagaaaataaggaatatgcagtctaagtacagagctcagatgaagcaacttgctgcctatcaacagaaagggtggaaacaccctggtgtgtgcaacaggcacaaatcatgtaattcagtaagtctacaaatatgtagttaaagaaacaatataatttctaaaagcagtctcctcgcagcaaactgtgaagttagcagcacagaagcaaactgaggcagagtcactggattggagacaagctgatttgtgaaagctgcttgagtaattgaccaacctctgcacaactatgttgcagtttactaaaccagtataaaggagaaaaaaagcagtagaaattaagagcattcgttaagctgtaagtcctttcattcttttggatatattattctaaatgcatcttataacattttcattaataaactgctgttttaattaatgatgaggtctcagtcaactgaatgacatttctttcaagaagcccacttcatacgcacacaaaagaaccctgaaatttttcactaaaggaaaggccaatgtgatccaactagttgaagaatatactattgcaattaaaaaatcatttaattccattcggctcaactcaatgaacatttattgaatatctgctggaggccaggggctagctgggattagacacagttcttcctttcagaaactcacagtctagagagaagcctggtgcatgaataaggcattcacctttaacctccttatccctgttctgttccttcccttctcttcctggtaaggcacgcttatttgcaaaagactttctacatgaaaaaaatatatatatgcatataggcatatacacacacatgtataaatattcatatataccctcaaagtagtttcccaaaattacttgtgtgtatacaaatattcatgttcatatatatatttttttatagaaatgggactatggtgttgtattaatgttggtttcctgactccaacttgctctcacatggttcaggaattacatataatatatattataatatatttaatatactagatatgtaacattaaaaattattttaattatatataatataatgttaaatataaatatatttaaatttttaatatttatatttaaattttgactaccatttgtattatatctaaatataacatatttaatatgagagagaaaacaaatatagtgaaatgttaaaagttagggaatccagatatggatgatataggagttattcatactatttttacaacttttcaaaattatttcaaggtatattggtcttgtaaaaaattttaaaataagggattcaagaccttcctggcctcaatcctgcctttcttcagcagcacctgcagccgtacatcaccccacatttaataccaagttatgtccaacatcctcccgctgtcgttcctgacgctgactgcacattagactaatctgagaaaatgctgaaatatgccaataggcaggcctctccccagacaatcagatcaggactcctgggagtttgctccagccatggttttttccaaaaacatagcctaggttgggaagcctggaggcctgtttcccaaacaccatgctgctgcattcctcatgccttggtgcctgctgtttccagtacttggagggtccttgtccacctcttcagtactgtagattcctattattttgtcaggatccaactcagatgtcgccttccttagtgaaaccatccaggcatcccacgccccacccacaggtagatcccatccttcccgcctcctgctatttatttctacacactctccttctacaggtttcccacactgttgtaatgctgtgtttgctctgtctcccaacccaccgcaaactccgtttgggaaaagtatatatcatgtttgcttttgtcatcagcatgagcctcacatatagtaggagtctaagaaatgtttactaaattaaatgcaaacaaggttatacttgttggaataaagttataacaaggagctatgggacacttgaggatgtgcactcttacagtgcaggcggcacttgcggaaggagatggagctcacgcagaatcgaagagtgaataaatagctaagtagtcgggcaggagagggaaatgggaacagcccgcctcttaggctggctggagccacgtggagtacgcgaaggagaatggccgctgaggccaagaagggagccagtccagacgatgaaggggaccaagagcgttagtcactctggaagcagagtgagcacctcgcactgcgctggcacacagatgcctctcagtcaagcattttagagaaataatgagtgaattcttttttgctctttttctttacatttggcaggggagtcatgggaccggattgaaactaactttcttcccagaagaatgtatttgcacatactttcccgaaaatgtcagaagatttacaggttttctgaaatgtattcagtgacacttcccccaaaatgatatgccacattctaagaagagggatatattttaggtttaagaaggacatggttagactaggatgtaaggcgggtcactgaaagtctgtgaaggacagattataggaggtaagatgcccattggaggacaccctttaagaagtcatcacagcgtggtggctcacgcttgtaatcccagcactttgggaggccgaggcgggcggatcacgaggtcaggagatcgagaccacggtgaaaccccgtctctactaaaaatacaaaaaaaaattagccgggtgtggtggcgggggcctgtagtcccagctactcagagaggctgaggcaggagaatggcgtgaacccgggaggcggagcttgcagtgagccaagattacgccactgcgctccagcctgggcgacagagcgagactccgtgtcaaaaaaaaaaaaaaaagaggtcatcacaggtgccaaagtgaaacccaagtgcctgaaccagaggcatgacagagctgtgcccaagagagaacagatgcaaaaggttacgaggcaatgcaaacagagagcttagggtgtctctaggctttctgcctttgagtgaccatgcagatgcagtgtcattggtcaaactagaaaattcggggagaggatcagatttgtgggaaaggatgaattccattgtgtgaagcttgagtttgggtttcccatgaaagaacaaggcggagtttccctacagaaagttgcaggttgggagtgatggagatgaggctctcctgatgagtgagtatagagtgtgatggaagaggagcactggagggaaaacctcagtgccccaacattttcaggatacacggaggaaaaagagccaatgccttacagagaagctgaaagaggggaaaggaaaaccaaagagagtttccaaaggctccaagagttgagtaaatcaaataagggcagaagtggtctgttcactttggtaactacgaagttcatgaacacctcagtgacagcaacttcacttcagtgaatggagttcaggccaaaatcaatgattaggaagtgaaaatgaggagatgagaaggtttctagaatttccccagttagattgggaaaatctaactggacctctgaacagcattctaacctattggtcagctcctctttcttgaaaaaccctttttccttggcctcattcagacctcgtgttcaaggggtccccggggtgccctaattacttcctctctgttcttcctttgcaagctcatttccctgtcccagtttgaaaagggtgacttctcagggccctcctgtcttctctcttcacacacttctcccagggaattctatccatgcttgcattgtaaataccatcataaaaatgattttaaaatgaatatttcagcccagacttttttggctctttgacttctatgcttccctgacacaaaggcacctcaaacttgacctgttcaaagctgaactttgttgttgttgaaacagcatctcactctgttgccccagctggagtgcaatggtgccatgatgggtccttgcagccccgacctcctgcactcaaatgatcctcccgcctcagtagctgggactacaggcttgtgccaccacaccggctatttttttcttttcttccttttttttttttttttttagcgacagggtccccctatgttgtccaggccagtcttaaactccagggctcaagcgaccctcctgccttggccttccaaagtgctgggattaccgtgtgagccacagcacccagccaaagctgaactcttgatacctgccatatccccaaccccaccaagattgcctgcctctgtgttcccataatcagaaattgtcaccaccatctatccaaaaatccgagtctgtcttaacactctttccttcacctttttaattcctaaacatcatcagattctgtccactctactactccaaaccatcattatatttattctgtcccattgcatagcctattcaatggtctacctatattccctcttttctctttccaatgcattcaccaaaatgcagccagaatgagctttcaaaactgaaatcagattatgtcacctttgcttaaaacctttcaggagttacccgttgctttctgtgtaaaaaccaaaatcctcagaataccacgacctttctatctagcctcacttcctactatggtctcccctgagggtttgtcatcttggcctccactacgttcatcctcgacattctcttcttcctcagagcctttgcacatgctcttttctcttcctagaatactttccctacccccgttaccagcaaaatctcactggccttcaattattaacttaaatgtaatttacgacctgctaaatctctgtcagctcatagttcacagatggcagttattacatatttgaaagaatggattaaaaagactgagtgctagccagaggaaaatagaggttcagggtaggggggcctttaagatgagaatgatttaaagcccacagcaatgaaatgatttgcctggccaaggtcaaaaagcgagttggtggcaaagccagggctgcaatccacgacttttgattcttggcctccccatgtcccacactaatcctttattatatgtcttagatgaagttagctgtagtgaagccctcatctcatttgctgtccccaaaacattctaacctgttgaccaccatgcacaacaggaatacgtattaacacagtttcaggagcatgacccaggaaattctataatagatgcaaactatcttcctgtttaagaccctagtagagttgttcagtggtgctgctcttaaattccaatccaagaaggccacccggctcccacacagtcaagccatagctgattgatgtgtttacagtaatatacttcacacttgtgtcttgtgggccacacgtgccactcaggataaacttagagatttttctttggcattttttctccattgtacagattcagacacttaaagcttattacatagaaactgacctagaagtgaccgggcctttggagagaatggcaggaaattggttacaatagatatggacccacctggggaaacagaactagcagaggtgaacgttaacccatcccaggtccaatgttgttagtccaaaaagattacagtaagttgaagaaaacatcaaacaaacagaataaaaaattcagcaaggaaattcagagtggtacacttggggagaaaaagcagattttgccaatgtaagaccaggagaaaaactggttgtgtttcagcattgcagtatcttgggagaataacaaaacaagtttaagcagagttgtgccatgcagattgcctggaaggaaccaggcctgcctgatgcagaatcatgatgcatgcagaggatgatgtccaaggtccccgggagcagaactccataaaattcacttaactcttttactaggtgactaattaaaaagcagttaatgagagtgatcattctgggcaatggaattcagccatgaaagtggttaatgacctgaggctgcagctcagttctatgcctcctctagcatggttctggctcccaggagagcctcctagactttagcagaagctgcacagagcttcaagaatccaggatatctgggaagaggtaggagagcgcattgggcgacagaaaggagtaagcaaatattaaagggtttatttacagcagaaggtaaaaagaaagaagctcaccacaatgggagctcaataaatgtggtttgcttgagcgactaccttgctgactgaaggagtggatagagcacgtgcatgaggcagcttgcacagtctgggagacctcgcttctcagctccttatttaatgacatcatgttggtagcttgaagtcggacaaggtggcagtattgacatcatgggaaataggcaaaaactataaatcagaatttttccctccccctcaagccagttgcttaacatctaccaacttaccattgggtcacttcgttgaaatccctgtgggagcagagttccctggggttcttaccttaagaataaacctgaaggcgttttggttttgctttcctattttaattactaatatacagtggcactcttcagtaatcttttattacacaaccagagtggctcagcatttgtgaagtctcctggcaaactcaccatcatttaaaacattgtttctgtggggaagttttccaagttgcaagttactgagtctaaaataaatttttggaaaagagcccatttgcaagttgggagctttcaattctgagtcctgataggaaagttagaaaacaaaaagaatcatgccaattttaaaaatataggttgcaaaatataggttgcaaaatcctaagtgaaaaggcaaaaggaatagaattatttaacttggagaagagaaagatgaagagcaattgaataataggagtgagtgccagctgttgtttgcttttggtttctgttttttgtgggtttttttttttctcccactgtaagcctcggggatttggttaaacaaggagataaatatctttatgttattattctggaatgaataattggtggattttatgtcaaacatctgcaaacttcttttcctcaatcagggataatttacatataacctgtgatgaggaccaagaaatagttaagacaaggttatttgtctacttgaaggttaactgtcaactttgtgaccctgagtccacagatggcataatgtatttcaaaactttgagaaacatgatataattaagcaaatcctttttatatcatagaatatctaaatacagaatttattatttttctatcaaaaatgattataaaacttagactattagcattatctatagtagtattatattgtctatatctgttagtattgtctattactagtatctatattactagtacaaaaccttaaaccaagcattctaaatcaatactttttgataattttacgagggaaatgatgctattttgggcttgttaatttagagttattttcagttattcattcagaagagatgagagaattgctttcttttagaatatcttttagatattgcagtaccctgatttggcattttcttaaagagatgtgaaacaatgaaatggcagctgtaaatctgccacttggagccttagagggcttacatcactcccaggctttgctttaacagttggtttatgatgtggtttcagaataacacttttgaacatggtatatcccttcctgcaaaactgacataaatccataaagcttttaatgatgtctctaaaatacagccaaagtagtctctgaggcatatttttggattgtttatctgaaatctctagattgctgaatctcccttcatgatctgccttggaatggctgtctccagggcagctgataaacgcatcatgtctcacccaggcggggaccactcagcttcgtgccccatcaggtacactaccctgcctcagctttcaccccaagcatctcacacccttgtgcgcataagtatcacctggggacctgcgaaaaatgctgcttctccagaacccctgagctaaattctgggactaggcctggggaccagcattttaacaggctcccaggaaagtggtcacagaaatgatgtgagagtctcagctctacatgctctctgactccagttctggcttcgggatggagtaactggagagaggctgacaggtggaagctgaggttcttgccggtgacacgctgcacctgtcactcaggtgctggggtctctgctgcccagacccttccctccctaggccaggttctgtgctcctcagtcttgaatttcaagcgcctggtatgcgtgtcttctcttgcacatcatcctgcctgccccactgtgattcatttgaatgccccagcctccatctctagcctgcctcccaccctccctccaagtcccaggtccacctcttctcacccccgccagagcctgttctcaggtaatgaccccccacattctctagcagaacctctctctgtggcaaactgaactgctcagtgtgttttctccaggcggcccgccctgcctgcccttcctgactcctcctccctcccctgtcctctgttagacacatttacagaagcctgtcctaggagtgtccatctgccccatcagactctgaactactgagggcaggggtcacctgtgccttgctcacgggatccccaacacccagctgaaatgtggtgggagcctcgggggtctcaagtgaatgactgattcttaaaaagaagcacgtgaagtttgtccaggcggcatgatgcctcagacttcagaccctctcactgccaatacactgtgccttcagctagaaagctagtcttcatctccgccacctacctgtacttggctacccacctctggccctccaggtcccagcttagatgtcttttcccacagcaagtcttccaccacccctgtgttccagggggccctgtgtctacctgatcctgcacttacccctctgcattctaataatctgtttacctgaatcctcctccaggtccggagctccttcagagcaagagttgtcagcacccagcatcgtgcccagggtgcagtcagtgctcaatagatgtttgctgaaagctaactcagcacatttaggtagtgagatggggttctcatcacatagctgctaaataaaccgccataacattcactgtattgtactcacactgttgatgcgtctcctcccacaaccactgctagatggaaatcttctcatgggaagtgattgtattttgttcatcttcacacttcagtaagtcaggcagcaatgagcatggattaagtagctgttcaatcctatgttttccaagaaggatagttttggcatgtggagcaggagaattctttttttatttttatgtatttatttatttttgagatggagtctctctctgcggccaggctggaatgcagtggcggatctcggctcagtacaacctccgcctcccaggttcaagtgattctcctgcctcagcctcccgagtagctaggactacaggcacctaccaccacgcctggctaatttttgtatttttagtagagacggggtttcaccgtgttggccagaatggtctcagtctcctggcctcgtgatccgccagcctcgacctaccaaagtgctgggattacaggcgagagccaccgcgccccgcccaggagaattcttaattgcataagacagccccacacattgcaggacatgctgctgtccttgcccgtgcccactaaatttcattggtatcccaatcattttgacaactaccccacctacacacacagttacaaaagttttgggggtaagaggaccaggaggaaaattgcactgcacatagttgaaaagctatagttaagtcttttccttacaacttggtgagaagcaatggactccgtaacagtgccatggtggattatatgtgtcaacataattaacagaaagaggatctctgaaatataagatatttatctggaaataaagcattgcaatgggaatatgcatgccatagttaactacatgcatattcagggaggtgaagacaaaagtttttaaaggaaaaaaggaggaggattacataattgttttaaaataattatccttggctacaaagatcaataacaagggtgacaccagtccaagtttggacaggcaaattcagggcagttgttcttgtagaaccgtttttttgtgtaaggttgcaatggtgtttgggcaatgttgtgctttttgcagagtctctgtgatagttcttttgatcaggcatttattcatggccttccccagctccatttctcagggctttcttttttttttttttttaacattagtgacttcattttgattctgacaactttcacacatgtgtgtggtgatgtgaggtgggggccaggacatgtcaccctcaatatacaacggtaacctgtctttgtaataatagttcactaatctttcctgagcacttatatattccgggcactaagctgtgtattatatagtttacttaatcctcacaaccacctatgaggtcccattttttagggacgaaattgaggctgagaaagtttcaagacattgacccaagttaacacggctgctacagacaagggcaagatacacccccaggcgtcggacttcgctgctctgtgccgacctctttaacaagaacaaacatcaaaattcccagttggaagactcctattaaaaactgtcctctcccattaattataacgtagagcagttttgcacaatatattctgcatagtgttaatttagtgggatgtcaagtgttgtgagattaacggttgcatgggcgatggagtgtgggaaatgctttcagcaaggcccttgtagaaggccgtgaaacagaaaccgtgaagaccacaggatccctaaggtggcacagcccttcacagtgagtcggagtgatttagaacattgctgagcaaacagcagggagaccggcaacaggagcttgctggccatgaagtgcctaatatccagtaagcactgctcaggctctaggaaaaggctgatgcaggaagggtttctttcttctaatttctcaataataataaaaatagatactatttatggagtactaattactctccacttcatagatgaaataccaaggcctagaaaaatgtgttaagtaacttctcctaaggtcacacagctatttagtggcagagccaaatttgaacccagttctctctaacttcaagacatgtgattgtaaaccctatacacaaagtctctaaggacgtagggcttataaaggctttcctgtatgaatatccaagcaaattcagtctcaaagaggatgcccctatgggttccctgtaccagggatttatttttggcatatctcttcaacctgacaattcgttccttggtctgagtacatgaaatttttttcagggtatgtgaatttttttcttggtatgtgaaatttttttctggtataatgtaagtttcttaaattttactatttttttaattttatagatttctatatgatatggtttggctctgtccccaccctaatttcaaattgtagttcccataatcccctcatgttgtggaagggacctggttggaagtaatttaatcacaggaggaggtctttcttgtgctgttcttatgataatgaataagtctcacaagagctgatggttttataaatgggagttcccctgcacatgtgctctctcttgcctgccgccatgtaagacatgactttgctcctcctttgccttccaccattattgtgaggcctccccagccatatggagctgtgagtccactaaacttctttctctttataaatcacccagtctctggtatgtctttattagcagcgtgggaacagactaatacatcataccctgttacatgctttttttttttttgataagagtatttgtgttgatgcaatagcatctttctccatagaacttactcagatgcccttcctggagccagtgcctgcactccatgaactgctggagaggtcattgtagggtatcggcatcagacctctcctcatttttcaattctctctctcctttataacagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggtaaggacaaggatacccagcctctgccatttaacatttgggcagacagaatgttctagcaagagtctatagattgttcttggtttgttatttattccccataggcttttttaagcaagtcacataacttctttgaaccccatttctctccatgaatatcaggaaaacaacttgccagctgggtgtgttagagcaaggtgttagagtaataatgttggtgaggcatgttgcgttctttacaagaatgctgttgcatgaataagagatatgtttgcatgtgtaatgattattttttctccctactaaataaacacatttggctggacactgtggctcacgcctgtaatcccagcactttgggaggccaaggtgggcggatcacttgagctcaagaatttgagaccagcctggccaatatggcgaaaccccatctctacaaaaaatacaaaaattagctgggtgtgatggcacatgcctgtagtcccagctactcaggaggccaagatgggaggatcacttgagcccaagatgtcaaggcttatagtgagccatgatcgtgccactgcactccaggctgggcaacagagtgagaccctgtctcaaaagaaaaaaaagactaataagaaagactaataaaacataaatacattcactaaatgtgctaaacagagatgggctttgaatgagtaaaattaattttacataaattaattttatcctgatttatgatagtataccagtaggttgttacagaacatctgaactttcaataggagtagaaaatcagaaatgtcttcattcccaatcctctcagaactttaaattcacaaagtgtatccctgtcataaaggttgcttaaagcaggagtttattttaattttttttgaaacagggtcttgctttgttgcccaggcttgagtacagtagcaggatcacagctcacttcagccctaacctctcaggctcaagcgatcctcccacctcagcctcccaagtagccgggatcacaggcacataccaccactcccagctaatttttttaattatttgtagagttgggggtctcacgatgttgccaggcctggtcttgaactcctggactcaagcgatcctcctgccttggccaaagtgctgggatgacaggcatgagccaccatgcccggcccaggggtgtatttttacttgtaatatcctgggccatcttggtcgtcaaacacacattaagccagagaggatctgagtgcacctaaaattggcatcctgaggagaatatgcaaatgggcttgtgacccttcagcagtgacctctgagagacatctaagaagccctggagtgtacaaacttgctgaacttgagaagtccacttcctctctgaaaatgaactcatataccttagaattctaagatcactcttttttttttttttttttttttttggagatggagtctcgctccatcaccaggctggagtgcagtggcgcaatctcggctcactgcaacctccgcccctcgagttcaagcaattctcctgccttaacctcctgagtagctgtgattacaggcctgcaccaccacgcctggctaatttttgtatttttagtagagacagggtttcacatgttggccaagacaatctcaatctcttgacctcgtgatccacctgccttggcctcccaaagtgctgggattactggtgtgaaccactgcgtcagccctaagatcacttttttaatgaataaaaatattttaagagcatgcaggaacaaatctctctaactcacttcccattggagccgaaaatatggagactctctctcccactgcccattgtttcctgcccttcagtgattattccactgttatggcatcttaaagagcaagaattttggctgggcactgtggctcatgcctgtaatcccagcactatggaaggctgaggcaggaggattgcttgagaccagtagttcaagattagcctaggcgacatagcaagacaccatttctaccaaaaataatttaaaaattaactgggcatgaaggtgcacacttgtggtctcagctgctcaaaaggctgaggcaggatgattgcttgaggccagtagttcaagactagcctgggcaacatagcaagactccatctctaccaaaaataattttaaaattaactgggcatggtgaggcacacctgtggtcctagctactagaaggctgaggggggaggatcgctggagcccagaagttgctggagcccagaagtgcaaggctgcagtgagctatgatcacgccactgtactccagcctgtataacagagcaagaccctgtctctaaaataaaataatttaaaaaaaaagaaaaaaggagatcaagatttttcccatgggagctagaactgttattactaacttaattcagcttgagttttaaaaaaacagtaaattaaactccctctctaggaaatgcactgttgcttaaaaagatggaggaaaaagtatgttccctagtattttccccttctgaaattattcctaaagaaataagccaaaagtcaaagattcatcatgaagatgttcatcataatgtttcgttttgttttttgagacggagtctcgctctgtcgcccaggccggagtgcagtggcatgatctcggctcactgcaagctctgccttccaggttcacaccattctcctgcctcagcctcccgagtagctgggactacaggcgcctgccacaacgcccggctaattttttgtaattttagtagagatggggtttcaccgtgttagccaggatgatctcaatctcctgacctcgtgatccgcccgcctcggccttccaaagtgctgggattacaggcgtgagccatcgtgcctggccaacatcataatgttaactatgaaaataaaaattgaaaagaatctgaaagttcaacttttagtaaaatagtaaaagagggagttgccattttatggaatattatgtatctattaaaatatttatgaatcgtgattaatgatatggggaaattttatgtatgttaaaccaaaaaaacatgaacaagatccagccttgaatgtgaaatattagctccataaaaaatatagggatagaaaaaaaaaagcaataatgtgaacacaaaagtgtttggttggattgtggatgatttttttttctcctgagcagtacttttgtatgcatgtcaaatgctttaatcagaaagatgaaaacagtaagtaaaatcagaaagtgaggatgaaagagagagaagtatggagcccctggtcttcaggagttcatcagtttatttctcctggatcagggtcaataggtttttttgacccactgatgttcactacccacatggaccagcctcccactgggcagataagaaccttgggtttcttctcaggtccctccccaggaggagggctctcacccagagactgtcaagaagttggtgaacacattcccacacatacttttattgtctgctcctcgagtcactgccacactagatttggtcctcaactgtattcgctacctcacatgcccactgctacacacccaccgctgctgtgccttcatcacctgccactgctgtgccctcatgcctgtgtgaggactttcattgtcttcaagggcgttgatcaatggattctgtattaatggccaccatttaatgaagctcactttgtgcccaaagccatcctgaatggtgccatgcattaattcccatgagctgcacaactctatgaagtagatactattattatttcctttctactgatggcaacacatgagtgcatggaggttgagtgccttgcacactcagaggatgttgggccaggctggggtttctcagcctgggtgtccgattccagacccaaagctccccaccggctgtactctccagggcaggcatctctggaactctcagtgttcttggaaggcaaagctgggtgggttctgtctcactgttacaagactatcctcaaactgctggtgaaaattcagctttttcagacttcaaatacaacatgtttttattatttgaagtttaaagttagaaaaaaaaggaaatcattaggaaaaaacatcagtaaggtctacgccaaagtatcaggaaaaagctactagaaagtctccactaaacaccctggcatcactcacatttcacatatcgaaagctctgctcactgtcctccagaaccagctgcccccagcaccaccactgcccatcagacacttgtgttcccaaggtcagtgtcactcaccagtgctccgttcttccctgcttttgtgggtcacccaggcaaacaagtcctgtgaattgaactcatggtgtccttttcctccccaccactactctctgaggcaaatatcttttaattcccagtagtgtttacgtcatggtgtccatagaaaattattatatttgaatggtaccagggtaaatggatgaggtcatgttttggaggccacctgcccagtgactccagctgccatccccttcttcatgtctgccacggtgtgaggggagccttgctcctggtaccccatcacccatctgtaggacagccgtgggcttcagcttgttggctgggaaattctctcccaatccatctctctgcttccagattctccccctcaccctttttcaccacagccagcaccgcctgcctttatagggtgtcttattttctgttgcttgtaacagaatacgtgaaactgggtaatttataaagaaaaggaatttatttcttatagttatggaggctaagaagtctgaggccaaagggccaaacctggtgagggccttattactggtgggaactctctgcagttctgagacagtgcagggcatgacatggcgaggttaagctgccagctcaggcctctcttcctcttcttatagacagtcccactcccatgagaacctgttaatccattaacccattaatccatgaatctatgaatggatcattccatgaatcgatgaatggatcattccatgaatcgatgaatggatcattccatgaatctatgaatggatcattccattcatgaggacagagtcctcatgatccaatcacctcttaaagggctcacctctcaatatacccatattagggattaagtttcaacctgagttttggaggggatattcacaccatagcatagggatattgcttaaaagggatcttgtataatgtctttattaaacactcagtggtgccccactccagcaaaaccaggagagactcctcagtgccacaaacttttaagtttgagacccaccaagctcatgggtgagatggtggcctgtagagctggaccgtctgggtttgaggtcggctttgccttttgtcagttgtcttgggcaatcagttggcagctccatgcctctgtttgctcatccataaaatagtgtctccctcacaggagtgttgtgaaactcaaatgacaatatgcatgtgtcaacagttattatttcccaggtccacggattcaatctacattctaacgcatattcagcaacccctactcttcgttttgagaaactcattacccctcaagcactctgtggtcatatgtgcacctgactttatgcctgcaatactcccttacctagaaatgccccaacttcctctctagccagacacctgcctttcattctaggctgagatcaagtcccacctccttttgatgacttctccttgctttaaactcctattccacttactttcaatgtcatttgtttggcatttaatgtactgtattgttatctgtctctgtgataaatatgccctgtcttcccagagagatgaaaagctcccagcactacatctcctgcctacgatcagtaccctgtaagtgtgtgctgatgataatgatgatgaccaggagagaataaatctgttaagcatgttatttgctgcatccaataaaagagaagtcccttataactgctttaattcacttgggagatgaacatgagacacagaagtgaagcacctcagcatttgaataatgttttattttaatggacaaatactagcattcttcctaccatcatttagcggtcctcttctgctgttatctgaaaggaataaatacatcatttaaattggattattcaagaatatcaccattactgtttatagatagtcactatatataaatttaaagttccaactcatctttctttctcaaagccaataatttctgctgccattaagtgaagcagttataggaatttaaaatcatatttacaaagtccaagaaggacagaaaagaaaaaaaagagaaaacaatgctgattttaatagagctgaggaacataaaggggccagtgacaaagtgacagcagagaggaaaatgtccagcgttttgcataattgccggttcctccgacctctaggcctctgtgtgtttgtatcctcagagccacacacatattgcctgacccatgccaggggatgggcatggctgtatgtgttataagtggactctacacttgtaaccaggcagaaagcctattttcagacctttaaaaaaaaaaagctgtgctttgcacaggaactaaatatatgtgttctgaagaaatgaataagagatgaatcaaggcagctgtatatttaagaaaactggctgggatgatatgatgtcagagcaccagaaataaggcagagagtaaaaacctaagacaatcaacgtgttttttctgcgtgttgccaaacaactgcctgatcatctccgtcattcccaaacaatggactattttaatgctattgggtaaaggaaaaaccgagtaaacactgaggggtggagagagaagcagctcaagaagtaggagcagcatattcaaaggccctgaggtaggaggagatcgtattttctagggaataagagaagttcgtggtagtttgaatgtaaaaagtgacagtgagtggtatgacttgaaaataaagtagcaggaggaatgcacatcagacagggcattgcaaccgctatttggaaagtacatctttattctgtaaagaattggaaggctttgaaggattttaaatgacccaataaaataatcagttacacattttgaaaacatggggaagaagacggtacagaagcagggagactgtattcatctgttctcacgctgctatgaagaaatacctgagactgggcaatttataaacgaaagattttcattgactcgcagttccgcatggctggggaggcctcaggaaacttacagtaatggtggaaggggaagcaagcacgtccttcttcacatggcggcaggagggagaagtgcagagcaaaggagggaaaggccccttataaaaccatccgatctcatcacaactcagtcactatcatgagaacagcacagaggtaaccaccctcatgattcagttacctcccactgggtccctcccatggcacatggggattatgggaactacaatttaagatgacatttggatagggacacagccaaaccatatcagagaccattcagtcatttattcaacaaatatttattccactcctactgtgcatcaggcactattctagacattgggaatagtcataaagaatagaaacaaaaattcttgctctcatggagcttatctttgaataggagaagacagacaataaacaaattggtacaatctatagtatgttgtgtgctaagaactgttatggggaaaatatgaggcagaaaagggagggcctggccaaggggaaggagagggtaaattccacttttaatgaggaagtcacagaaatgatcactgagaagaggacatgagagcaaagacctgaaggagtgagggcatagccatgcagagacctggggaatgagcatcctgaacagaagaaccggtgactgcaaaggcccttgggtaggaacaggaagccaatgtggatggtgaggagtgagcaaggaggagagtaacaggaggttaggtcagcaataatgaggagatcatatggggcctggtgagccattgcaagaagtttgatttttactctgagacggggagttactgggattttgagcagaggatcactctgaccaccgtgtggtgaggacactgtgtatctcagggtcagaggcccagtgggatcagggaaggttggagaaaggacaaaagctagtataatcccagcaaaagacactggtggcttggtccagggggtagagatggagatggcgacaagtggtaagattcagggcatattttgaagatcaagccaagaagacttggtgtcagatgacacatgtcatataggagaaagaggacagtcaaggcttttggcaagaataactggaaggatgaattggcaattcactgaaatgtggaaaactgcaatggaatacttttggggagagaagatggatgttctgttgcatatgttatgtttggggttgccagtaagatatctgagggaaaatatcaagtagacagtttgtgaaagagtctcctcaatgccactgtgtctcctcaaatgaatgtgctgaaaagttatttaactcactcttagtaagaaactactcctagaatttattcattaattttcaaatgataatttcacacttcttgactggaatatcattttgaagattgctgataagtacaggtgtttctgtagcttattaataaaaatatgctattattaaaaaaaaagagtctggagttcaagagagaagtctgactagggtatgaatgtggtgtctgatgggcatacaccttattcaaaggtcctacataggataggattgttggagtaggtaggtagacacacgagcagggcagaagagggtgccccctcccaccaaccaccaagaatgtcagacaaccatcaggtgatggtcaggcagttgctaaactgtctctctctaaaatgataattggctgcagctggcaccaaggaacgaccgtctcccaatagatagaaaacatctggagctggtgatcagcagcttcccaatcagatctcaggagttgggcaagcgggcccaagcatgcacactaagaggcaaaatgatggagtttaacgggtatatgaccttcctctaggaacactcaactggaaaggggaaaaaaaatgcctcaaatgagcatgcgcactacttcagtaaacacctgtgcatgcagcccctcccacgtgctcgcaggccactgcgcatgcagacagcccgccccaagggaagaatcaggggagaagaaaccaaaccccagaactatgccaatgtataaaaccccaaatcaagggccaaacagggcacttggatctctcaagtcgcccgcttggccctcttccaagtgcacttcctttctaaaactttttaataaactttcactcctgctctactaaaacttgccgcagtctctccctctgccttaaacctacttctgcccctcaagccgcattctttcctctgaggaggcaaggatcaagtttgctgcagaccctttgggattttccttcagtaacaggatcaccatggaaacaggcctgaatacaaaagagaatatgcttcagggctggtctttggggactgcaagagtaaggtgccccaaaacgaggggaaaaacaggtagagaaggaaaaccgaaagagtgtgtgctggaagccaagtgttcccgggaggtgaatgaattctgtgccgagtgaagatgaggcctgagagggacaattgcctctacttccccaagggtcacgggcccagcaagagaccgtggagcagggaagacagaagtgagacagagggctcatgctaaaatagggacgggtttggaggcagcaagtgtacccatctcttttcatggggttcggagcaaagaaaagcaaaggataagaggcctcacttgagagtgaaatgaggtcaagagcagtaatttttaaagaggaggctgactaagacccaccatcttctgcaatccaggcagaagatggtgcaggtaaagcacaggtgaggatgaaccaggagctctgtgtggagctgcctcagccagggagcaggctccctctggaattcacacaaggacactgtgggtgccaacagaaagcctgtggttaccgaagtggaaaagagtgagggaatttagatagatttaggagacgaaaatccaatccacggtgcttagttgaaatgccaggggcaaaggagtctaggatgacattctaaggtaaaactcagaaatagtgaaggtttgttgaatttcgtttagaaaacaaatataggaaatgtaattagctcttgattattctaacaaatgttcctttgaaatccaggaacatggcaagtgtaatgttaggatgcctaaataaggaagagcacagcgtgtgtgtgtgtgtgtgtgtgtgtgtgtgtgtgtgtgtgtgtgtgtgtgtgaaagtctggaaggagctactcccaagatgtttagaaaaattatctttgggtggtgggatttcaggtgactttcttttattttttttctgtttactttctatgttttaattagcatgttttattttgtaacttaaaatcagaatatcagttttgttcccctaaaaaggaaatgaaaggtgacaaataatccattaggtgatttgcagttggtcaaattcttgctagattgctggctccatttttaagctctgagatatcaacatgaaaattccaatttgagtaacaaatgagataaaatattgatgtctttaaaactcataactaagatataatatttatgcttgcagattaactaaaagcaggatctacattgtcatattagttattttcaatattgttttttattgttgggacgaagcaaggaggaaaaaaagaatatactgttgaggcaaagtgaactatcattgagggcaaaaagggactcaggggaccagggaaagccatctttcctgttgatttgcatttgattagtctgtaagctaaaataaaatttattacttggtctcaatgaggccacccaaaatctcatctttaagaactatgtttggccaggagcgtcggctcacgcctgtaatcccagcactttgggaggctgaggctggcagatgacgaggtccggagatcgagatcatcctggctaatacggtgaaaccccgtctctactaaaaataccaaaaaaaaaattagcccagcgtggtagcgtgcgcctgtagtcccagctactggggatgctgagacaggagaatggcgtgaacccgggaggcggagcttacagtgagccgagatcgcgccactgcactccagcctgggcgacagagcgagactctgtttcaaaaaaaaaaaaaaaactatgtttatttttaatattgtatgctcatgattcttttatatgcccaatgtcacactttgctgacggggtgagaacatccctgcactctgcatttatttttttatttcacatagtgtttcgtgggacctgcagatgtctcctccctgcagtcctatattgtatatgctctcattctttgtgtccaggcataatcccaacttggatcatttaaactatttgcatcttcaactttgagacgacagtcactgaagttcactgtgggcagattgtaaatatgtgcgagcctggtgctgtcagccgatatgggtcagtaggcctctgagctcgtgaatccaaattcaaatattgaatgttatctgtggacatcaagggagggagtaaagtttaacagaaattggatgggcatggtggctcacgcctgtaatcccagcactttgggaggctgaggcgaacggatagcctgaggtcagaatttcgagaccagcctggccagcatggtgaaacccccatcactactgaaaatacaaaaattagccaggcgtggtggcaggtgcctgtaatgccagctactcaggaagctgaggcaggagaatcgcttgaacctgggaggcagaggttgcagtgagccaagatcgcaccattgcactccagcctgggcaagagcaagactccgtcaaaaaaaagaaagaaaagaaaagaaaggaagaaagaaagaatctaagagcaggaattgaggggatgtgacattaaaatgaaatttagggcaaacaaattactgagctttcttttttcttctataggaagcttacagattcgatacaacctgggtggcacccgagagccatacaatattgacgtagaccacaggaacatggccaatggacagccccacagtgtcaacatcacccgccacgagaagaccatctttctcaaggtatacatacatgtacatataaattacatataatatcgcattatagtccctgtccctataatgcttggccattggttttgttttgaggggatagaagtagaagagatgctttttacactttctcctacaagtgcataactagtgaagtagaaatatatataattctgacaaggaaagacaatgatgaagttgaagacatcttttagggggaaatagaataaatgtttattccgtatagtctttctggttttcccagttctagatccacatatctatcaatttactgcttttatccattgcaccatctttcttcgccaagctctcagacatctgaaacttaccgtgtttcccagcaaaggttattttggtttctccgacctacttctttcactgctccaacacaatacaaagagctgtatttttctctctctctctgcagagcctttgtcttaaaaatcctcaaaacagtctttccccagaatctcagactctgactgtgggctttcggcacacaaagggatggttttattatgacactcaaattttacttcaggttcattgacgaccccggccctcaccactgatttttacagtgaagaaaccagcttgggaaacaccatgaataaaacataatgtgaggaggtctccctgggagctaggccaagacatcaaggatgggaactgtcactgcattctctagaaggagttcaaaatagatgcctgtcaggagaaagaacagcaggaggatgctgttttgtcagtaaagtggagtgtcatttggcaggggttcagcagcctctcagacctcattctgattcggctggatgctgtgggaagttcaggttgcaaagaaaaggcacaagccctatctcttttgagcactggtggatgtcagattcataacttgatatggagtttgcgcgtggcctttagcagtaaatgctagagggcattttaaggagaggcctttcctaggaaactgacatgcactgtttcagcttactgcgccatcaatcaaaggtggcataataaggttctctcatcatggtcgacagagtcccagagcccagcacagtacctggcacacattaggggtgacaaattctttatggagtaaaccaagcccatctttaaccaagttttagtcagaaaagccagcaagtccaggagacagatcgttttacatcatttcatcaacattgtctccctcggcttttgattagagactttttccattttaagccacccaatttgtcacctcttttaaagaaagtgacttatcttgccattttaccattgcgaaataatactaaaacttaaaaagacctaaacaatggcttttcagacagtataacagcagagacccaccacagccatagaatcgtatacagtttaccctcactctctgccacagtgaattagagaaagacttgaggaaggggagaggagtggatgatttttaagacttggggctttggaggcacagaaagccagagatatagacagtggagcagccagagacctgcagagaatccaggggatgaatgggtttgggggagggtctggttctattgcccaagactattttggttgcaaatgatagaaaagcaattcagaagtaatttgttggggaaaattcctagggtaggtcatagaattatagaatttgaaaaagataaaaccaaactttgggaagagaatctagggagcctggagaattaaaactgtggactagaataccactaggtttctctctcccttccttccttccctccctctttttcattctcatctctgcctctctctgaagactggattaattacctcttactgcatgctccatctttcacatatcctaggccatagtcacaggagtactgggctcatgtcttcccaattttgttaccggaagaaggggtcctagtttcttgacactcattttaaaatcccagggaatctctgataggcctggtttgagtcacgtgctcaccttgttgggtggaagggggaacaaagacccatagtccctaatcacatctcttgattagagtggggaacttgggaaactccctcaaaagaacagaatgcagttccagaaaaaggaaggagataggacgacaggagtgaaaattttggatgcacgattctgaggtaggagaggagaaaaacctgggaagtgcttcctcgattccgccctaggttctgcacctggaagtgttgggagatccagctctccctccttctctgtcatgtaatgtaactgactgcagtaagatttctgaatgtcccaacccacgtgagggcaactaggaaagatgtcacggcctggggagctccaatctctcagcccagcctgtcccatctaccctgggacctgcccaccactgagggcaaaaagaaagtaaagatagaggtggtggaggaagacaagatgtagttcctccttatggaaaagcagatcccagggcttctcactcccatgccccactttctttcatgcagggaggccttgcagacgtggaagtaattcggaaagtgctttgcaacaccaaataacactgcaattttttcttaaaacaatctaaaaatccatcttgagaacttctacagcctcaactgtgtgtggaaagagatataataaaatgttcacagtgatcatctgtgtgtgaagggattatcaatggtttgatttcctctagagttttctatttccccattttctattataagcacatgctgcatttttataatcaaacagaaatatgaaacagccatatattctcaacctattctggtagtccccagttataataacatatgataacaaaggcatttcaataatttcaaattaatatttatttatttatagtcaaagaacaaaaataaggctaatgcaaagatgaatggtagatcacagtgctgtggaatgatgtctttggaattaaggtgaatgttgatgcatttatacatgctcaaacatataatttagatgatcctcatcagtgtttatggtgtctttaaaagcaggtttactttcgtagctgggtttggctaaagctaacattaaattaatctgcattccctcagcacacaccctgtgaaacagcactgagcacttgagggaaactgaccttggatgaaacatttgctgccaaaagacaaagtacccagtctccacatagataacagggaactgactgtagtagttatcagacaccagcgtgaaccagaacccatggcatacctccagtggcatcatttgtgaaaactcacagtcgcatcagggagaatagcttaaggcttaatgccagtcaaaatataaacaaacaaggtgcagccagagagcacctgaaaaagtctggcatgcagtgaaaaattatgtcaattagcatgaatccaaaagcgaaacattctaatcaacaattccaaagccttgtgcaactaaccctttcttcttcctttccttccttccgtcttgccatccatgtttcttttccttcctattttttcctttctctcttcccaaccacattgcacaagggatctaagggggtttacagggagaatattaaatgaaatagagagttaatggaagtcacaaaaagtaagtccccaagatcgagaaaatagaacatgattatcaggtcacaaggtcttaccacttggataaatttgactgtgaacttctcggcagccagaagtatgcaacccataaggatgaactaagccagttcctcttgagaattgaaccttttgttattatatcatttttattttatttaattccatggattgtatttactgacatagaaaatgcccatagcatactccacttatacaacatcacatacacgataacagctcacatgtattggtgcttactgtgtccaaggcaacgtgctaagcactttagacacattttctcatttagtcatcacaaaaactttatgaagtatgtgccatcattattcccatctgatgtgttttggaatgtgtccctgtccaaatctcatgtcaaattataatccccaatgttgaaggaggagcttggtgggaggtgattggaccatgggggtggatttccccctagatgttcttgtgatagtgagtgagttctcatgaggtctggttgtttaaaagtgtgtagcacctcctgctttgccctcttcctccttctcaggccatgtaagacatgcctgctacccctttgtcttctactatgattgtaagtttcctgaggtctccccagccatgcttcctgtacagcctgtagaactgtgagtcaattaaacctcttttctttataaattacccagtctcaggtagttctttatagcagtgcaagaatggactaatataccatcttagagatgtggaaattaaagttcataaagtaagatgcaacctgcccaaagttagaaagcggtaaatggccacagcatagtcgaacccaggtccgtcatacttcaaagtgtacacaggctcttaaccttgcttaatagacagatgtctggaaggatgttcacaaaattttagaagcagatacctctggctggtaagaaattaagtgatgttactgttattaccataagatagttcaaaatatgcaaaaacacagagaataataaaccatatgctatgtacccaccattgaaacattacaaatttcgacattttgccctatttcttcagatttttttaaacacagcaacaattaagagtctgttgtcctcctggttacatagtgggccccaataaaagtcagagtcaatgccctcagcagcatttctgcaaatgtatttgttacaaggctgttagatgctgaagctccttgggaaagtaaagcttcccattttgaattcagcccaaacaagtctgtagagagtgaggtagagcaggatgatggacagatgaagaggccaaaggctgagatgatgcagctttctgaaattttgaactgatcctaggataaaactagctggaaaatgataatgaataaactacatgttctttgaataattatccatgacaatcacacatttttgggtttagatgtgagttagacaatagagagttcagggatatattctctggcacagatactcggaatccatattctctacaaatcaaatgaacagatggtaaggatgtatcattttggctttcatctaactagagggccatcttatctttgccaagaagaagctaacagattttctgcaagcaaaataaggcctttcttagaaaataattctaggtcctcaggaacaaatgatgattagatccccaagttcttacaccaaaaagaggatgactttgattattttcactgggaattttcaaaacaaatgttcaaaaatatcactgaattctgttctttaaaataatataagcacggtaatttcttacctgctactaatctgaatttcaaccaaattgtataaaaacaattgcatcaattgttaattgaactaggtcctgtatataaatcttaagaactgtcagagaagtgtcaaaaacattagcaacatgtagtgtgctaggtgctagaagtagaagaaaggatacaaatattaggatgatgccagttgctatacaaattagccctcaaatgtccatgttttaacccaataaaagtctgtcttacatcagatatattttcagaaaaggaaagttctctggtctccagcagtgatgaaattgtgctgggcaggcactctgaggacctgccactgccaccaacttccctgcttccccaaccctggattaggccaaattattgtccattattcttgaagccctcctgggctccatcctctgggaggctcttccttgtgtgtgttcagccatggcctcccctgaattatgtgccggataatgtgctccttacagctgtgcagcaattatttttttttttttttttttgagacggagtcttgctctgtcaccaggctggagtgcagcggcacgatcttggctcattgcaacttccacctcccgggttcaagtgaatctcctgtgtcagtctcccaagtagctgggagtacaggcgtgtgccaccacgcccagctaattttttgtaattttagtagagacagggtttcactgtgttagccaggatggtctcgatctcctgacctcgtgatccaccctccttggcctcccaaagtgctggaattacaggtgtgagccaccgcgcctggctacagctgtgcagctttaaggcccatttcctgcaggttcaaattacactaagggttttttacactcataagccttttgtggactagatctgtgctttcttttccaatacaattccctcaaaacccaaggtggcttctgatcaatttgcttctggtaagtttcatgtgctggtaaatgcaccctaagctcttccctagacatcaatcttagacttactcaatcatttgcctccaggcgcccatgcctctctctctcaaggtaatggcagctactttggggccagtggacacaaaaggcttgggtgggaagtaaagacccttaatttaaatgttacccgtgaggctaagtcagtttgctaaacagaaatcttactgccccattgttggtcaaagcggtttgcagtgttatttcttactctctagtgtaaggctctaaatatctagacttttttctattcttttcattgattattgggaactggtcaattctttcctgaactcatctgctccatgacatgaggagcaaaaagcaactgacacacacgaccattctgtctcttttgaagaactttccttaaagctacttaggcatttagtctgccttccaggttatgtgaggtgacagttttacaaaatattttattgcatactatattagtctgtcttgcactgctataaagaaatacctgagactgagtaattcataaagaaaaaaaaggtttagttggctcacagttctgcaggctgtacaagacgcatagcagcttctgcttctggggagacctcaggaagcttagatggcagacagcaaagggaaagtaggcttgtcttacatggcaggagcaggactgagagagagtgaaggtgctacgcactttcaaacaaccagatctcatgagaactcacatattatcaggagaacagcaccaagagggtggtgctaaaccgttcatagagctctgcttccatgatcccatcaactcccaccatgacctcattttggacactgggaattacaactcaacatgagatttgagcagggacacatatccaaaccatatcacataccattcttcctctgtctttcaagtccctaatattcattcctgcaccacctgccaccttaccacaaagccaatgctacatgtgttaggtttctgttatagcagcaccctgccttaagataccaatgtatgtattcgttagggttgtattcgctgctataacaaaaaatcagaggcttaatacaaataactttctttcccacataatagtaaaatgatttctagttggaaatcgtaagcaatatataaataggctgataaaaaaggtgtttgtactaatgtccaaaaataatagagtaaaagacattgtggttctatgctataactataaggctttgaaggaaggataagatgttaacctgtgaatggggggcaagagaggacatggaagaatatttattatggaagagggagaaggagagggaagatgtgtgttccaaaagagaacatgatgttaaacaaagatgctagcagagtgactatttcatagatttcatcctgtctctatctcatgaatagaaaagaccactggagaagactcagtaaaaagtcttacctggagaaattctcactctgaaatatgtaacatcaaatggtctgaagtcatttatgaatattgaatgctgtaaagtcagtagtctgaggcacatgcagagtggtgtcaaaaattgttggaagaattttatcagcagcaaaatgagagtaattcaattatggactcctagggcagcaccaaatgttaattgacgtgaaacattggtggccgggggagccctagttcaccactttctatatgtggaaaagtgtacaattgtaaggactttcacataacctcctcaagcccagagaaaaatctctgtagacttgagagggccttaatgatcatgttaggtagtgctcaaagccctttcttacatatcgaaatgcttgcccacattgccattctcagccttatgaactggaaatagctggtgctattagtcccattatatacatgagaaaacagagattaagaagtcccaggccaggcgcggtggctcacgcctgtaatcccagcacttcgggaggccgaggcgggtggatcatgatgtcaagagatcgagaccatcctgaccaacatggtgaaaccccatctctactaaaaatacaaaaattagctggacatgggggtgcacgcctgtagtcccagctactcagggggctgagacaggagaatcgcttgaacccgggaggcagaggttgcagtgagctgagatcgtgccactgcactccagcctggtgacagagcgaaactccatctcaaaaaaaaagaagtcccaatgatgaataaggtcccagtgctcacaagagacatgatcttctctagaacccagctaaccagaccccgtttccccacttagtttgctctttgttgtctttgcaagtgggcaagagaagcaagctcactcctgttcatttgccttataaacttttgaaattttttaaaaatgtttacgcaaaattaagtcttttgaggatttgtgttttctttggagtcactaaaagcaatgactttatagcgtttcgtagggggtcataaaaccctaatttttataatcaaagagaactacaaggtccaacgttaaggctagtgtttttacagcacacagtatcatacacccataaaaattccatctcattctttaagtaaatatgaacataacctcttgtctgtccattttaggatccttcttttctgtagaaacatggagcccagactgaaattagatactgaagctcaaataaattatttaaaaatgtgtgcctttattacccttgaactttctgccaataaagaacaatactaacaagcatatggatgtaaacactcctaaaaattttactatcagaagttgttcatgcctttattaaggaaaataacacagtttggaagcactaaattttttagggatgtcagaacaaataaagaaagttgacctagctagcctagggcactgctcttgaaattacatttactgtaactccttccctttggctaatttagtttttatctactctggatgataaactcacagcctgggttgtgcaatacaagcatgcttgacagaaggcaggcaattgcaagaataatgatgagccatttgaacactctggcttcttcccttccagaagaacttttacctattatagcactggctctctattgggattcttagcaagtgtattagcacttaactttccactttaatgaacgactgacatgtataattctatggagagcataggccaatattttattagtttctgatagtattacaatggtttgagtctattgaactgatatagaagatctatgggaagagaagagagagggctacatatattgggaagttgcccattaatttggtctgtatatgagtcagaattcattttttcttctatatttctatgtatccagagaagcctgttcatgattgagagacacatcaaaaacctcatgacctcattagcttttgtaatgtcgcctctggttttgggttgagctatggctcctcggcccctgagaaagtatttgagcacgttttcattatttggttcagaaagtagcagtatttgacaaaatgtttctgaaaagaggaaacaagatgcccaactaccagagcctcagattcctctccctcccagtaccttcaaaccagcttgaagttttaaactcaggccacctccacactgagaggtctggccagcccgtatgcaaggacatggttcctaggagtgtggtggaggcgtgtggtgaagatcctgctgaagaagacagaaggttctcaagatgtccaggactcttctgttatcaatgtacttctcttctacttaaagccacatggggtccctaagaatttaacatgatgatatctaattgacattctctcttacccctgcctaccactaaacccaccacatggtgagaaagttccaaacagcaatcgtttctgaagcctgatttggataaaaccagatggtcaccaaaaccattccattaggccatttactgatgtggaatgcaattaaaattgattccactttaatcaaaataactttgaggagaacaaatatgtgctgagtatctacaatataaaagaaatttggatagataatgatgagttggtggaacagtaggtgactcatacagggatgaataaaatgtatcttttacaactcaaggagtttatattctgggaggggagaaaagatgtgtccagtcactaggcattttgtcagataatagaaacctgttccacctacttctcctctagaagacagtttgacaagtctccttatcaacatgtaaataataaaaagggtatccagcaaaagagaatattagcagtttggggtggtgataaggacacagcacgtaacgagatttccccttgaggacaatgtcagtgtaaacagagaccccacggattacaaactgttgaattcagaggttattattaagacataaatttaaaagggtctttattgataggctaccttactatattagggctctctagcaggacagaactaataggatagatgcatatataaaggggagtgtattaaggaatattgactcacacgatcacaagctgagatcccacagtagaccgtctacaagctgaggaccaaggaagccagtcagattcctaaaacctcaaaagtagggaagccaacagtacagccttcagtctgtggtcgaaggtccaagagtaccaaagctgacgaatttggagtccaatgtttgagggcaggaagcatcccagcatgggagaaagatgaaggccagaagatgcagccagtccagtccttccacgttcccctacctgcttttatcctagctgcactggcagctgattagatggtgcccacccagattgagggtgggtctgcctttcccagtctactgactcaaatggtaatctcctctggcaacaccctcacagacacacccaggaacaatactttgcatccttcaattcaaccaagttgacagtcagtattaaccatcacacttacttaatagctctgtgttctctagcaagttaatgaaatctctgttgacttaatttctaaaattggagtaagtccatcttttctaatgcagtttgtgtatgttaaatggaaatacaaaaaaaaatctagcatagtctatgacccaataaaacggtagttttcttccttcattcccaattcccttctctttcttaaaagcaaaaaataaaatagcagatgtcaggatcagtaccaacaggctctttgggactatggtttctttccattgatttgtagttcaacccattaagcatattctcagcacctagtatattcccagcatgcagcatggctgttgcctccatgagcccagtccagtagaagaaagaccatcagtcatacagatatgaaccaagtgcccattgaagtataagcttgtgctgtgggagcacagaaaagtaggggaatgaataatcctgaggaggaaagagtggatcagagcagtctcacaaaggcatttgagctgttccttcaaggtttccatggtggaggggggaggatcacattagcttatttattttttactacagagattcaacatttgcccttcataaaaattatacagaaaatatgttaagaaaataagttctaagccatcaagcccatctgatctgaaacagaaaaagactcataatgaatatgtcaacacttccacatttttcatttgttttctaaagcaatttcatctgcaaatgaattatgcactccagggctagacagtacctccattcctacactccagaaaaatgtgtttacttcgttttacatttcatgcagctcagtgggaaggcagttgcaatgcaatttctgatccagtttagggtttgagatgtcagtcctctctttctttctccagaatacggctaaagcttgtaagaccaaggttgggagttcacttttttttcctccaagtgcattaaatacataaatcacctctcaagaaagaacataaggttcctggatttctattttgtctggcatgaaaactaaagtccaatctgcaaagcatcatactgttatatccatctgcagtgcactaaaatcactctcaaagattgtaactcttggagcaaatttttagcacaatgggcagagcgggttgtttcttgcccaggtaactgaagcaggttcttatctcacctaaattcatcttctgtctgaaaagtaagtgtatctcaacatgcggtttgaggttctgaagggttccacgctgcccttccactcaggcagggagaagtcagtcctgggattgagtctgaagattttgatggacatggtcctggagcgagttcggagctagtgttaaaatgccctctagtggtcattagctgtaaccagtgagcgtagggaagggaaaatcttgtgaaactggcttgggtgtggttttctataaacaccgaccaaaaccagagtcctaggttatagcgcgggttacttgcatctgtcgcggataccgcgatggcggtaggacttggtattacttatagaaatggaagcttgccgttgcattcaaagggtacaatccagggatttttcttacgctttcacatctcactgctctgtccctgagccctgggcacacacgagagtttcaagaagtgttgactgagtgactgaatacgtgaaggaatccagtttatgaatcatggattctgtgcacattcaatgagcttggctatttgaaagtgcacaaattcttcctgctttctgaagtattaaatatatttgatttgcatcctttccccagtggtcgcttggtgagctaataattgcctttcctcttatatctttgagctgaggaaatataatcaaaatgttaaggagaggggcaacaaaccccccctttgtgggtagaagagaaggtctgggctggcagctcaagagaaaagatgaagaaaggacatccaaaaagaagtggaagtcagagaatgaataaaacacatgagcgaatggctgccatcctatccgagcatccttcctgatattgtcacccagggccaccagcagaggttacatggtgagaacagacagtagaaatcagcccactccaccgatctgactcctggtctcctggggaaatggcattaggatctaggttaccaacatcatagcttctgccagggcttgtgtgcttaaccccaacagtggaacaccacaaatgcacaggggcagtagcctccaacatcctgaccatctctgagaacctgtcctgctagcagaggggacagaggctgtacaaatcagaaagttgacgtattagtccattttcacgctgctgataaagacgtacctgagactgcgtaatttacaaaagaaaagggtttaatggaaaagtcacggttccacatggctggggaagtctcacaatcatggtggaaggcaaggaggagcaagtcacatcttacgtggatggaggcaggcaagagagagagcgcttgtggaggggaatgcctctttttaaacccgtcagatctcgtgagacttattcactatcacaagaacagcatgagaaagactggcccccatgattcgattacttcccaccaggtctctcccacaacacttgggaattcaaaatgagatttgggtagagacacagccaaaccatatcaatggataaaaggaaatgtaatgtcaactaaagacaaaaaaaaaagaaaaaagaaaaaaaaaacttttgaagaattaaagttggttttatttagaagtcttattggggactgtagactgaggcctacaacccacaagcagtcttttacagaggttttatgagactgcgccagcacagtattttagcccactgtgtatatataggtgctaggggtttagcatgtgcaaagttatatgaaacttgtttagacattatattaaagtagaactacgttaaggtttgggtgtaagggtatatctggttctagattatagaagtgtcatcactaatctccccagatgttattttatgcgtaggagaaggtaaggactaggttcatttgtcttttaaggaatatagtgacttaggtaggagagatgggggccaggtgttctgttttattttgtcgttttggagagctgtatgtcatcacagagttggggctttgtgaaattatgttggcacagagacaagcaaacttagctgcttatgtatgtgattttgtctcacaagttctctctttaggtcacaaattaactctggccatatttataaaaacaatattgattgtgttatgtagctgagaaggctgttttttaggaaggttggtaatctttagttgtagttgtaaggaatgagtattgagcccagtgtgtatatttatttattcattggaaaatatgttttggattatatttatgttttaattactaggatttgttagggtttttgatgttgcctttttgggggttttgtgtgtgtgtgttttgggtttttttttttttcaatacagggtttcactctgtcccccaggctggagtgtagtggcatgatctcagctcactgcagcctccgcctcctgggctcaagcgatcctcctgcctcagcctcccgagtagctgggaccacaggcatgagccaccacacccggctaatttttgtattttttgtagagatggggtttcaccatgttgcctaggctggtctcaaactcctgagctcaggcaatctgcccacctcagcttcccaaagtgcaggggttacaggcatgagccaccatgccaggctgttgcctttttttttaatctaatataacattttaataggacattataaggatattatagattacatatagtagtctatatttaatagtaatatgatttatagattttgaaaaaataaaaccaataaaatcagaatatgcatttgtatttttttactaattgtaccttttgtatttatatttactagtattttttatgaaaagcaattttggactggagttgattgagaatacttttagagaagaatttggaataacaactgggttgtcttgtgcatttcctgtgggcatgatgccagccttgctcttctatggcaaaggatacaggttggcacatggaggagcttggcctctgcaagcccacagacctctgggctagctactcagcaactatgtgtcctctagacacagtaacttaatctctgtgcctcagtttcctcaactgtaacatggggcgaataagagtatgtgccgacagagttgtgtgcaattaaaaaaataatatgtgtaaagtacttatggtgggatcccacctgcagttcgcctccaggaaatgttagatgctgatgtggaggaggatgaaggggaggaccagatgtttttcctgctgctggcatattctgcgcgctgctcttccttctcccaaatcctttcagcagcattttctttcttcccgagattgccaagggaacccaggcagaatgccaggaactaaacctctctggaagattgacggaagaagagctgggatttgagcaagatagagcgggctcagggtcaccatgaggttcaaggtctgcagactcccccaagctttctctcgagtagatttgaacacacaatccaagtccaaatccaaatttaataggcttctgtactgagaattcagctcagccaattgtgttagagccttaatgcacatgggtacacacacacacacactcagtgcacacaatgagcactcgtacagggccgggtcacaaaagaagcgaatgtccatcatctcccttcacttcccctggtcttttctagtctccattcctcaccatttctactgaattctcccatccctctccaccttctacttctggaacgagctccaaacatagcattaaaaagcttcagtgtttccagggaacagagcattgctgctttccataaactggcagaactggtcgttaaatggaactttcaggcattcccccacattctgaagtcactctctatgtaatgatcttcctgatacacctttctgctctttcacctggaaaagaatttgaaggatgtggttatcagtcctctgatgatgccaatgtttcgactccatcctgaatattgttattgctgccaaaacctactggtaaagtaatatcaatagagccaccgtactaaaaaggatgtgtctgctacgttgttttctttaatatcaaggactttaactatattacagttaaaatcaatagaaatgtaaccttttcaaccacataaaatgagttcatttttattattattctttttctgctgttacagtgctgtgattgcaaaagcaaccgggtcaacttaagctttattgaaagaccattaaagaaacaaactcaaactcatttaaatactgaagctggtgcattaaaaagatcaataaagtaaaagcaactggggttgctttacttaaacaccccacatacgagaatcattccacaatcacaatttgagcaaacctataaaactaggagaccagccaataaagaagaaaacgctgtttcattactaggtttagacccataaagcccttaactttagtctgattagacatactgcatttaaattttctctcagtattttaaaacatcatccagcaaagacttattgatcaatgaatgtcatttacttaggaaagccattagctccctgagttaggggaatgactcagtggtagaaagtgcagtttcatttatttaaaaataaacacaagattaggctacagtgaagggaagttctagactcacagggagtcaggaaattttctttctatccttgctgagcgtggtatcttgaacatagttatttgtattcaattgaatgtttactaccaattctgtggccatggattagacacaaacctctttgtgtgtgcctcagtttccccagaggtagaacgcattaatatccttttctccctctttctctggataagaaaacaaaaatgattgacacaaacctcttcaagttcttccttaaaaactataatacaaactataaaccttagtggtaatatgtacttagaataattttagaatcagattggtccttattggccatgagtccaacccttgaccagtctctgcttatattactagttatggaaaacatgctatttttcttcttaaaataccatttattgtgtttttctaattatacatttaaatatatttattatagaaagtacagaagagaacacagaggaaaatcaggtttgcttgtgagtcccatttaaaatcagccctcgacccttctccaccaaacccgtcttgcttactccagggcattgctgagcagttctctgtcttcgttctctactgactcattcccatcagcaaataagcatgcagatatttctcttactttaaaacaaaaatttctcctgagaccactttccccacatctttgtttttctttgcaataaaacgcccggcaatagttatctatgcttgctgtttcgggtcagcttctcccattctctctctctctctctctctctctctctctatttatttatttatttatttatttatttatttatttatttttttggagatagagtcccactctgtcgcccaggctggagtgtagttgtgcaatctcagctcactgctacctccacctcccaggttcaagcgattctcctgcctcagcctccccagtagctggaattacaggtgtgtgccaccacgcctggctaatttttgtatttttagtagagatgaagtttcatcatgctggccaggctggtctcggacccctgacctcaagcaatctgcccacctcagcctcccaaagtgctgggattacaggtgtgaaccaccatgctcagcctctttcttcagtcaactttactgaaatgtaaattgcatgcaatgaaatttacacactttaaatgtacagactgatgagttttgacagacgtgcacacccatgtagccaccaccacactcaaaatttggaatatttctaatatcccagaaggttcccctgggcccctttcccacccaccattgcccccaagcatttactgatcaaatttctatttctataaagtcacagattagttttacctgttctataatttttttttttttgagacagagtcccgccctgtcatctaggctggagtgcaatggcacagtctcagttcactgcaacctccacctcccagattcaaatgattctcctgcctcagcctcccaagtagctgggactacaggcacatggcactacacccggctaatttttgtatttttagtagagatgaggtttcactatgttgaccaggctggtcttgaactcctgacctcatgatctgcctgcctcggccttccaaagtgctgggattacaggcgtgagctaccacgcccggcctacttgttctataattttaaacaaatgtccagctcctttcattctgcataatgattctgaggttccttcttcttgtcgtgtgtatctgtggttgtttttttaattgctgggtggtaatacacttatgaatatacccccatgcatttattcattcacctcttgatggatatgtggatcattttggggatattatgactacacctgttaggaacatttgcatacacatgtatagagcagacttttttttatttctttcaagtaaatatctaggaatgaaatcaatgagtttatggtaagtgtatctttaactgttttttgatgtaatattccctctaggaagacagcagaattccagtgactccacgtagtcactagcacttgatattgtcagtctttttaattatagccattcaactggtgtgtggtagtatctcattttgggtttaattttcatttccctgatgactgatgatgtttagcgacttttcaagtgcttattgaccactggtaaatcttctttcgtgaagtgtctgttcaagcctttggcccctttttaaaattggattgtttgccttattattatgttataaggattctttacgtattctggatacaactcctttgccagatgcatgtactgtgaatattttatcctcattttttcttattcccaatcccagctgggctgctgtccaccactgcttaaagctactcttatggatactatcaatgaccttctcaccaccaaacccactggctacttcacagttctcctgctgctccacttaaaggcagcatctgaaaccagggagcccttggcttttagggaacactgctcctgtcctccttctccctcatgggccccttttgctctgtctccttcactgtttctctccttcctgacctccttcagtgggcgtgcttccagtgctttaccatttgtattcactcctgtgatgatctcatccaatgtcgtgctcttaaattttatctctgtgcctcaaactccaaattattatctcaacccaaacctcgccatgaactgccgactcacacaccaaactgactcccagatatctaactgattcttgatgtctgataaacactccgaacacaatatctccaaatctgacctcctgatctgccccttcccacaacctgccctgcttatagcctttccaatttcagctgatggcaactccatccttccagctggtcaggattaaaaccttggaatatcactagaacatcactcactggttctcacagctcacatccggtttttcagaacctcatgctggttctaccctgaaaacatccaaattctgaccagcctcccaccttgcacatctgctgctcgggctccagactccatcctgttctgcagaggcctcctgacgggtctccaagcttcctcccttgcccttgcaggagcgtctctgacatcactaccccatctgtttaaagtacgagttctctgctcaacacccactgacagtcctcgtttctctgaggacaagccaaagtctttccagtgacctgcaggactccacaggaactagccccgtgaccctccccttttcatgctacttgagcctcactggcttcatgccgggaattctcccgccttggctgctctctctgcctgagtgttctttccctgggtttctgcagggctaacccctcgaatccctcaagtcttcattgaatctccttttctcagtgaggctaccctgaccgccttatttagggttgcagtctgacttttacaccaggcctcttattgggctctaatttgagggaaaagacttcgaatttatcccctcctaccatattacatcatttactttttctctgtgtctctctatactaggaaggaagcgatatgagggttaggatttggggctttttgttcactgatgtatcctaagtacctagaacagtcagttcaaggcaccttatgggcacttgacaaacgtttcttgaatgaataaacggacctgtgatgtgactacagattccttcccacacgatgcactcggaggcccctttcttcccacccagccagtgccaggcattctgcagcaacactgctccatcatcctcttttctctgcccctgcagattgacatcttcagctccctggccaccagattatggttgggttcagctagcagaacactgcaggaaaacacagggggaggcacgagagatcggggtctgtcctgtcctcacctctatcctgcttcttcccaaagtgctgggattacaggagtgaaccaccgtacccggcctcattttacttattatagccacaggttcaaatctattcatatttttgttttgctttgttttttctgctctgtttagagtcggagtctcactctgtcatgcagactggagtgcagtcacacaatcacagctcactgcaatcttgaactcctaggctcaagcaatcctcctgcctcagcctcccaaagtgctgagatgacaggtgtgcaccaccatgctcagcccatatttattttttaacccttgttctattattacctcactctctgcaaagacttctagaaccaactacttggagttaggccaaactttacagctccaagggcacagtcctccacaagactggtctcacgtcaaaccccagctgcaagcccaggggtctccaggtgaccctcatttacaagcagctggctacaaattcagaggttcccactactccctcaggtcaataatttgctagaatgatttgcagaactcgggaaagcactatacttatgatcaagttttactataaaggatacaatccagaccggccaaagggagagatgcaggtggcaagatttgtcccaaatgcaaagcttctttgtcctaaggacacactaccctccctgcacatcagtgtgtgacaatgcccagagtattacaaaccagggacatttactgagcttcggtgtccaaagttttttttagaggtttcattacacaggcttggttgattgaatcattggccacaaaggtgaactcaatctccagtccctctgccttatctggggtttgggctcaatgctcccaactctaattgcatgtttgatgaaaagaagggagaaggaaaacataaaaaccctcctccttacatgaatgcccttctctcctcagttctcatcactgctcttctagctagctttctcttggcccaaagtacacaaatggtggctccagcaggttccctattcctggacattttcaattctaagcagcagcctcaggcattggtgatcctattggatgatccagtcacatgttcttcctaaatgccaagggtatgattatgctacattgcttggaggagtgtgcagccttgcctcattctgcagaagttcccagccatgctgtagccccagttccatatacgtaccacagccaccaacacaggagcctgtagggcacagtcagaatccatcttctttacctcttgggttcagataaccaagcaaagttctcctccaggccattttcatgttctctctgtcttcaatacacattctcctatacatgcctcatagtcctgattaggttagcaggccctgtggttgagcagacttccaatttgggaattgaatgtcagtttcttcctacatttaggcccagaatcaccctactcttgcccaatgtctttgaactgtttcttcatccagatcttttcatcccttaatacattctttctctcaagaagaatatcagtttctcaaggagagagatcctggggtctctccagacacaccgacatgtgcttgagtcccaacgtagctacacatgaactaattcgtcagccccttagggtcttgatcaggtcaccttgagccacaattttcaccaacctttcctctctgatggaaatctgaagtcctccctgggatttccaagggttctttctgcttccaggtgctttcttctgtgggtgatctctctgatccagagaatatccacccagaatgaagctcagcacttcctttggttcacaaacacacaaccgcccaaagcattcactgagcagtagcctctattgactatttcagggtcggggagaggggtacacagcacattaacaaatcactgcaagtcatagagtagatattcatgccctcaatagttcctttacccatccttctatagaggcttctcatagcccttcacgccaggcagtgccagtctttctgctttcaccccaggcagtgccaggattttgatttctcctgattcatgctccctggctccccacctgcttcctcactcatctccaggtctcccccactattatatacaataacaagctgactcttcccaaaacagggtccaagcttgctggcccagagtagtcaggtgctcaacagatgcaaaaacttggatttgaccccctttaaaggagttgtggttacaaataacaacaacaatgagaatttgggggtgatcctatgccagaataacagagatagatagatacatagatagatagatagatagatagatagatagatagatagacagatgatagatagatagatagatattgattgatagatgaaaaactgtaaccccagttttgtatagatcaatccaaactttgcatcctagcattcaaagcccttcacaacgtatcttccatttaccttctattgtcttctaccattcttttccaaaacacatcctaaggaccagcatggctggtgtcgtctaccattttttttccaaaacacatcctaaagatcaatgaggctagtgacctcaacacccttagagaaatttggtttattattcctccttcaaaacgcctccactctgccaatctactgtaccatgatgacacttattctccatattacatattttagaattaggggtaacattttacatttaattttagtagattgtcttagaatattattccttcattgtttcatgtcatgttttccaaacaagaatctaaagcgccttgagcccagctgggaacatctgcacgtcatcagctggactccagtcccagtgctcaaggtggctggaccacaaaaccacatggaagcccttgcataatgttaggaggtgtcagcaagatgatttgagtcttacgccgaggcctctctcttcccacagggggtctgcaccacccccagcagccaagttaccctgtgacagtcattcatctgtgctctgggtggcccatgggatgagtgtactactgggcaggtgtaacttcaggggcacacacagcagacatccccagctgacatgacaacctactggcttctcaagatttgactaatcatatatagtcatcccacaatatcctcggggtatcggtttcaggacccccaagtacatcaaacctcatgcatactcaaatcttgtggtcagctctgaggaacctgcatctagcaagggccgactttgcatatacgcaggtcctgcatcccaagaatactgtatttttgatccgcatttggttgaaaaaaaaatccacttgtaagcagtgcagttcaagcccatgttgtttaagggtgaactacatttctgtgaggggatcatcttcaaataaagtccttgtttctgtaccagttacagcaaaggccctgctttgagaatttaacagtcagagtagccacccacttcaaaactgaccagtcccatccgtggcaagcagacgatgtgacatcaacggctcttaccgcaccaggctaatacagttatcctggtcgtagtttcattttactgaaggccttattaaagcgcccccacacaactcagccaggaattcaccaggaaccaaatttaaacaaatcaaaccccgaaaacgtgctcaacaattcaagattacagaagggaataaagacgaaaataagaaaagcctcaatcatatttgtcatatctccatcgtttctcataataattctcaaagttctttattcctttcatttatttaattaaaaacttaggccatgcacgttggctcatacctataatcccagcactttgggaggccgaggtgggcaaatcacgaggtcaggagatcgagaccatcctggctaacacggtgaaaccccgtctcaactaaaaatacaaaaaattagccaggcttggtggcgggcacctgtagtcccagctactcaggaggctgaggcaggagaatcgcttgaacccaggaggcggaagttgcagtgagtcaagatcgtgccactgcacttcagcctgggcaacagagcaagactccatctcaaaaaaaaaaaaaaaaaaaacttaaccataacattatacaatttaagcagcatcatatttgttaatatctattttcaaaagcgactcttcctaattttattgttttcttcctcccttttccacgcatttgtttgtttttcttcctcctagaaagtcatgttctaagttatcaaaatgtgtttttcctcgagctcttcagggaaaaaatgccatataaaattaattcatgattattttatgtaaattattatctaaagtactcactatgtgtaacggttaaagttgattgttactaaagtgattctaaatatgaaagtgtataaaaccatgaactattctcacactacatctcaaagaaatttgaaatttctagtaaatttcaaatttactagaagactagttcagatattgtttttaatgatttacaatcatcttctgaattttcatttgcaagtcaaagtcacaaaactaaaagtgctacatgttttctgaccagattctctgaaataattatatagtgcttgagccattgtgctataaatatctttgaaatcaatgctattaaagaaatgctatatcagctgtgaaatgagaatttctcctcctgtccgttgacatttacaaaaattatacgaacttattgatagaaaatccgtttgcttggtttctttttaaacatcttatgctttaaataatattcagtgtttttccagtaggtggagtattagtctagataaagtaaatcactgtgtgaaagctaattttttcttcctactattttgagaaatttttgatataaaacataaatcacctaatagtttcactaattcttttaattgcatcaatatggtatgatttcaattactctagaccttaagaggcagatatattttactgattacattaccataataacaatggcataatgacaatagcagtaagtacttattatacctctcattttaaaattgcttatcaagccattagagaaacctcctgacatctctgaaacagaaattacacaacaaagaaagatctgtctcttaaatcctttctctctcgagccttaagcatttctgggaaactgcgttccttgtgagttgaatattggttcaaggctgatgctaccacttccagtccaggaatctgagacgatcactacctctccctgggattctgcttccccttctaagtttgtgaaaagatggtgataaactacatctctgaggcccctccctacctgaaaatccccaaatgaacctgaaattgacaatcttatggctgaatgtcgggagccaagtctgccgagatgttttagtacatacggcaaagatggcacttgttatacggtctggatctcaaaatggaaagtgagagaatgatgcctttccagggcaggtggacgcttcctcccaccctccatccatcaccaaaaccggtcgaagttgaatagtgccctgaaaagacaccttcaagtggtaccctagagttgtatcttcacagatgattctgctcaaagcccccagagacatgggaaaatactattccttagggccatggtagcagaacatcttcaaagaaacctcacagaactggttcaacctcctcactttacaaatgaggaaactgaagtccaagaaggcttcctaacttgataaacatccatttaacacgtggcagagccagggcccatctcctggccccattctcatccccccaggccacctctcctctcttacactggaagtctagaagctggtttgcaaggggtccctgaatgaccttccatagaggacagtgccttaccgagaagaggaaacacatactgaaaccagccacttttctctttttgccttctcacagtcaggtgattcgggtttggagagagccccagctcccatgcgcaggggattttctgtcctagaaaggcttaggcacagtggattcacctggatctcttctagttttgcagccagtttttctttcttgctcttggaccggagagcccccagacccaggcgtaggcttaggtaaagggggctcaggagacaaatctgtctgctttggccctaggctaggccacctctggccttgccaacaattaattaatacattagttaattaattaattaagtcaaagtcctccaacgtggttgagcccagctggggactggtaataaagtgagtggtttagagaataattcccagaagaagcacaaattgattattgtatttggtgaaaggacagcagaagagcattctgggcaaaagatacagctggtctaaagccctgagcacacctgggagtgcacagtgcctccccaggtgtgagagtcaggtcacagcacaggggcaaggtctaggcgagggcactgcattctcgcctctccattctacgaagatgccccctacccctctgatctccccagggccatttaatctctcccaaagaggcaaaggctccctgacttatccatctgcagttacctgcaggattcggttaactttcccttcgtaaaggcatccgccgtgaaacacaccaggcacctccaggaccggcatgcatcgctaacccagtgacaaaagcatggctgttgctcgtttattccagagttctgttaggggagagtgtttcttggcctctttcttcttcttgagtatctctataagtcggcaggatttatgagtagctcaaccaaaaacaaattaaggtagacaacgtgacctctaaatgggtcagcctcccaaatggtgtcctctcatctgcacccatggctgttcttgggattggagggatggccgcagggcttggcaatgtaggttgggagggggctggcctgctgaccctcaccctgatgggcttgtggctctcagcaatgtggtcccaaaaacaagttgcactgaaatcaagactctcagagcagagcaggggcaagtgtctcttgcatgaaaattcggagtcccagattcacgatcagccagtctccccatcgatgtggtctgggaggatggagccaagctcactcactcaaactcgatgtcaataaaatgctatgagggcttcagtccactgagtcattcacagagattcctccctctacaaacagaagttctaatggaagtaaaagctaggaatccacaccttaaacacacacacacacacacacacacagacagatttacatacagatacatacacgaacatggctcagccagtgctgacccatttaacacatgttaaatgagcaccttgcatatcacaggcccttttcatgtggatcgtaaattaactggaaggtttattagataacactacagagaaagaaatagccgaaagtccagaggtgaggtgttagccacggagctctgacaaccaggtggatttccactgcacctgctgagcccactgatcagtgtttaacaagcgtgtgttatgccacgctcctggggcaggagtggtaactgaggcagcgtccttgaacccacagggttacggtctcaccaagggaggatcaggaacagagctgcaaccctggactagcaggagagtcacacctaatcctacttctttatctcccacacatctacatttgctccatgtcctctccattatcaggaacaaagtgattctagggttaggaaggggcagaaaacatttagatgaacgtatccttgatactggggtcaaggcctgcttgttcgtattttcaattgcaaatggccctaggcttgtgtatacccttcatagaatggagattccgatggggagaaagagatggtctccactcttcaaaccctctcttctttgaagtctgtgggaatttctagtttagaaggacgggtagacacagataaggggtgcgagttgagctgataattgtttctcctacctgaagtctatctgcatcagcctcttcttatcttcagccttgggcttcaacttggagtaaataaaacattcatcagatgatatgctctaggctgggcgtggtggcctacaatcccagcatgttgggaggttgaggtgggaggatcacttgagcccaggaatttgagacaagcctggacaacatagtgagaccccatctctcctaaaaataattttaaaaattagccaggcagccaggcacggtggctcacacctgtaatcccagcactttgggaggctgaggcaggcagatcacgaggtcaggagttcaagaccagcctggccaacatggtgaaaccccatctctactaaaaatacaaaaattagctgggcatggtggcatgtgcctgtaatcccagctacttgggagactgcagcagaactgcttgaaccagaacttgggaggcagaggttgcagtgagccaagatcacaccactgcacttcagcttgggcaacaaaagcaaaactccgtcttaaaaaaaaaaaaaaaaaaaaaaaaaaaaaagccaggcatggtggtatgcacctgtggtcccagctactcggtaggctaaggtggaaggatcacttgagcctgagaagtggagtctgcagtgagctgtgactgcgccactgcactctagcctggatgacagaataagaccctgcctcaaaaaaaaaaaaaagaaactccttagtcatacacctaaagccaatctctccataatcactttattgggaataaaatgatattttgaagaaaaaagatgatatattctaaattcaatatcgctgagctaattccaagtattccctaaaattaacgattaggaaaaacagcaagaaatcctaggcctttgtctaggccatggaaaaagcgggatctgccttgaaattgtgtccttcatctcaggagatggggcccggcccctccaccggtccaggagaacccacgccatttaggtatttcttctttagcttctccactgcatccccaaagcgtaaacggctgatgaaatcccttcaaactctgccaacgcaaactgtggcttaaaaatggaaatgaatggatattgcaaaataatacctgaatagacgttaaagctttaagctccacgtgtaagacacaaggtcctgcctaaatcagtatgcttctaatggcttcatggcaaatgttgaacaagttagtgttcactcaaggttgtcctggggtacatggagtcacagtctttaattttaatgagcctctattacacaatctcttatcgcctcttaactgccagtgaaatgaccaccagctaaatgtacagcaaaatacatttctacaaaagagctcacttggaccccaaagaaattaccttgaaattattacacttaaccgtggcaaatgcaccagggttcatttgaaaagaggtggccacctggcaatacgagtgaaatcatataatatgtcatttccttaggcttttcatgttaagcttttctcgctatatctgatttaaagtattttctcttttaaatgtaaatatttaaaatgtagctgatcctctccctctcctaattgaggtgactgggctagttcaagagactgtggcctgcagctcaccgttttgtctctggagtcagagtgccagccttggtacttactctgtgactggacactttataatatcaaagatacgagatcatacctatctaatatctattcaataagacaatacatattaaaagatcagcacaaagccttgtacacagcagttgctcaatatgtgcttcctcctttttcctactattgaatcccaccagccaagaccagaactatatctgcagttggacaaagttgggtttatcccttgttgcagtgagggcttagcagtttgagtcaaacgggagctggaaaccacagtcggttaaaatggggtgataaatagaagcattaactatggcaaacagcaactccaagatgtaaggaaatccgtgcagtttcctagtggccccctagggctgagggagcccatccagggacaacctcggtgggtgtctgaccgtaatggaggcaaagctgcccctgtctcctctgacagtctccagctgggcctgagagttaagttgacgtaggagagactaacagaggaaacgcaagccaatgtttacaggcatgtgagggccttcacaggacaccaagatccaaaagcagccaggcctaagtgcttatgcaacagggtgaacaaaaagtagtaattttgaaaaagtaactaactatatggagatactaaagacaagggttattttaacaagagctttttaactgtcaaaacactttttgtttgtaccgatttccctcggcctcaactccccgcctctggagagaagaatgttcttttcttcctggtagagagaagccatcttccatatgaaagtttcatctcctgctttcaggaagaaaaggggaggtcagagtgtcctttgtgcatctgttgtttttctttttttctttgagatggagtctcactctcacccaggctggagtgcagtggcaccatctcggctcactgcaacctctgcctcccgggttcaagcgagtctcctgcttcagcctctcaagtagctgggaccacaggcgtgcaccaccatgcccggctaatttttgtcttttagtagagatggggtttcaccatgttggccaggctggtctcgaactcctgaccacaggtgatccgcccactttgccccccaaagtgctgggattataggcgtgagccaccacgcccaacgcatctgttgtttttcaagtgcctttagctcaaaattgtccccatctcaagccagcatatctggaggtggcgtgttctgaagcccttcaggaccttgctggagaaggtgtgtctgcctggcagagagcagagacccctgcttagccaagctggagctggtccggaattgctgggggagcgacaggctggctgccctctggagtgcaggtgggggagcaggcaatagcaatggcggtgggggtgagagtgaggggctaccagggcggttcagacacacgtccagaggtctgtgggcaggttgccatggctgagacgctagggtcacagagggttctcttaaaaggcctgcgactcagacaggcttcacctcatgtcctcgcactctgggcagagcctctgctatccccctcctcgagcctgtgctggaaattgcagtaagccccttcctcttgcagtgtccctccagagcacgctactgagaaagcttgacattgtgctcaccttaaaagcaaaatctttaaggaattccattgtttatcatagagcttatattgaagggtgcattgggagccaggaagcaacgagttgattgataattgacgcaaagggacccatataccttagagaatgacggggtggctctaagagtcaggaagggcttattttaggaatcaggcttatggtggggagggttcaaggaagcaggtgtctctaatcaactgggtgctctcagaaaagcagggctaattcagttattgggcctcttaatgcatttcatctgggaggcaggaagaatggagaacactaacgttgttattgaagaaattgccgggagaaagagatgttttggttttgggttgtacaaggtctgttattttttaatttcttgtattagtttcccagtgttgctgtaacaaattgccacaaacttaaggacttaaaacaacatgcatttactatctcacagttccagaggccagaagtgcaaagtcagcgcaaacggctgaagtcaatcagaaaggctggtgccttccgcaggctctgagaggagaatctgtttccttgcctttctcagcttctaagagtctcctgcgttccttgggcccttcctcacgtcactctaacttctgcttccgttgtcacatcttctctccactgcgaccctcttgcctccctcctataaagaccctggtggggacctgagacccacccagggaatccaggagaattcccctattatcttaatcacatctgtaaagcccctcttgccaaggaaggtgacgcgctctcaggtcctgagaattaggatgttatctttgggaggcatgattccgcccaccatatctccatattcagacaaaattgcagaatggtctcgtgtcacatggtcaggtcctggagagccctgatccgatgctgctgttctgaattatgttcggcagggggacagcaccacctggtggtaacactcggcaaagcatccgccgtcagctgcagagctgcttttcctttggggtcctcttgctttaacccaccttccccacaatcccactcatcccttccggccacagcccgccttcttagacacaaggcaggcaggagtatgcgagagagaagacgtaaggacgccttgctcgtggtaagatcagagactgatcggagaacgctttcctccttccctcctttgagaatttcctcaggcactgcagcttcacctttgtgaatgttgaaggctttctggatatcctcgtcacttctcatattttcctaactgagcaggtaatttggattagaactgtacagcatgacccatttaggttcctgttcactgttttgaaattaatgacttcatcaatgagttaaggctaggagtgttcattatgttttttagaaaagtcaaaaccgagcaggatcaccgagaagcaagatgacacaatcaacaatcaaaaacctctgagtagaggctattactgtgtttcaaaacaaaatatataaaagtggccgggtgcggtggctcacgcctgtaatcccagcactttgggaggccgaggtgggcggaacacaaggtcaagagttcgagaccatcctggccaacatagtgaaaccccgtctctactaaaaatacaaaaattagccgggcgtggtggcgggcgcctggagtcccagctactagggaggctgaggcaggagaatggcgtgaacccgggaggcggagcttgcagtgaaccgagatggtgcctctgcactccagcctgggcgacagagcgagactcagtcccaaaaaaaaaaaaaagaaagaaagaaaagtttatataaataaatgtaaaatttagcatttttggttaaagccatcaaccacgcagacataggaagggaatacacttatagagatcaactaggaattttattttactgtagctcagcaaaaataatataaaatggctgccaaaaagccaaggccgtctagtctggatctgcagaaacaattcaggaaaaggaaggtacctccactgtgtgggtcatgccaaacctgaggacggatttcccttcggtgctcgcgactttaaaagttgcattaacaactgttaatgtcaattatcaagatcccaccatgtattgtattgggctgtattgggcctgaggacacagaaatgtaaaaacctaaacatggaaatttaatctttaaaactgtgtactatgtatccatagaacgaaatactagtcatccatgacaaatgatttttgttgtatatttattgagacagaagacattcataatatatcgtcaagttaaaaaatatacaaaacataatatgtgttagttgggttccatccctttttacttaaaaagttgaaagaatatacattaaaagttaacattgactatcagctggcagtttttttctgcaaatctatatcattttttctataacgaacgtatattacttgtatccatttttaaagctaagaaaatagaattttgttgtatttttatcgacacagagcgacattcataatatatcatcaagttaaaaaatatacaaaacaatgtgttacttgggttccatcccttttttatttaaaaagttgaaagaaaatacattagaaattaacatttattattagcaggcaactttttttccggcaaatctgtgtttttctataatgaacatatattatttgtatccatttttaaaattctttaagaaaatagaactttgttacaaatttagttttttgttttgttttttttgttctgagatggaatcttgctgtcaccaggctggagtgcagtggcgcgatctcggctcactggaacctccacctcccaggttcaagccattcccatgctacaatctcctgagtagctgggactataggggagtgccaccacacccagctactttttgtatttttagtagagacagggtttcatcatgttggccaggatggtctcgatctcttgatctcatgatccacccacctcggcctcccaaagtgttgggattacaggcgtaagccactgccctgatcacaaatttagtttttaaattgtaagaagtatgaggtggagattatcacctcctaaggcattgccaggtaggctattggttaacaatggcattttgcatttaaccatttaacaaaagagagtaagtaaacagaagtgcggtggcagttacccatgggtgtcattagatggcagcaaagcagctagctaatatttaagagcagaaactgaagagcttttgctccaaagaaacatatatatgagattttaaatatttaagattatctgaacggaataagtgtttttgtttgtttgtttgcttccagacagggtctcactctgtcacctaggctggagcacagtggcatgaccacagctcactgcaggcttgacctcctggcctcaagctatcctcccacctcagcctctcgagtagctgtgactaccggtgcacaccaccacacccagctactttttaaaatttttatagagataatggtctcactatattgcccaggctggtcttgtactcctggactcgagagatccacaagcttcagcctcccaaaatgctgggattacaggcatgagccaccacacctggtttgttttgttaatgatgcatttgacgttatagaaaacttttcaaaatgatagccaagcatgcaaatgtttactttaatagtttttgggggtggggtgcttttggatttttgtggcaatactactcatgcacaaaaacctactgtaccagttctgtgggtcaaaaatctaaaatgttcttgagatgtgaggaccctttgactcttaaccgtgactgtgcaatgatctctaagtttctaggaagcagtttcaagattctgctgcagacagtcattaataatgaatgactattcatcgtagtatgatgtggtgatgccatttgatcacttgcctgccctctttcttcactgccactctctccttcctcccaagagcacagctagcttccagcatctttgctcatctgaaggacagttttttgcctaatcaggcccagtttgagcaaggactctggatcgtatctgcttctgagtctgtgctgctgccttcaacaagttgctgcttgttctgtctccttcctctacacaattgacgtggcccccatgggaatgcccatgtcggaaagcaatgctgtgctttcttataacccgcacctctcgtcatgctgaccttagcacgtattaaactcacttcagaaaaatgaatgcttacaaaagaatgttttccaccggggtggggggcccaaaaaaggcccagaaagctctaagagctcacagttggagaaacacatctagactgtataggtggtaaaaagacagctgagaagataaggcaggaaaagccacacagggacacaaagggcaaggccagtgattctgacaccaccattggcactttgtccacgggcaacaggatcagaaacgtgcgtcgcttccgtggttactgtctgtgcaccgttcccaacagcttcatttctctccctctgctgccaactcgcccaaccacccctgcctgtggcaggagaaatcattctcattgggataaccgagaaaactacaactgtttaccccacttgaccctcagcatttgagtgtgtgtgtgtgtatgtgtgtgtgtgtgatcatgtcacaaaataaaatgtttccgcaaaacttcattgctgtagatgtggcatattccctatcagaggctgacactggagattggatcaagcagatgttactccattaaaaagaacatggatcttaatcctgtaggtaaatcatccacagaaaatgtacatcacctggagagccgttcataaaggatcttcacttaccatcctcagattttttcaaagaaccccagcaaaggaagacatgggtttccattttctcggggtggtgttttagagtcagtgctgatgaaataagatatcagaaaaccagggttcaaagagtgatgtcatccccacagggaagatttggttccacacagggtagagacgtgcttctaaaagtgtctcttgttttcctcctgcagctcgatcattatccttctgtgagttaccatctgccaagttcatccgacaccctcttcaattctcccaagtcgctctttctgggaaaagttataggtaagaatgtggttcgttaggtataaatgcgtgctacaaatacatttgggtaatgtgagtttggattttaaaactatcaggtaaatttctcttactggggccagtcacgaatatcttctctgtacaggaaagttacgtggttgttctcggtgttgcacaagcaaagcgtcaacaaattatctttgggggaaattgctcatgtaactcattctaaagctaattcgcctttgaaatacattgtgattaggctgggcatggtgggtcacgcctgtaatcccagcactttgggaggctaaggctggtggatcacttgaggtcaggagttcgagaccagcctggccaacatggcaaaaccccgtctctactaaaaatacaaaaattagccatgcatggtggcaggtgcctgtaatcccagctactcgggaggctgaggcaggagaattgcttgaaccccggaggtggaggttgcagtgagccaagatcgtgccaccacactccagcctgggtggcagagcgagactctgtctcaaaaaaaaaaaaaaaaaacaaccaaacaaacaaaaaacacattgtgattggtaatgggggcttctaagtcagcgatggtaatggaacaaacgttgtttggtgcgtggcataaactacaacccaagcgaaggcaaatctgctccaggcttctctatgtagaatttggtctattacagacctctacctactagcaatatgtaatttaacgtttcctttgtcaaagcatatcaacatgattctatcttcctctcactcgtaagaaagcaccttgatattatttgcagataagaaggccaataaggaatttgacagtgtgacagaacacccttccccatgtgcgactgtgaattccagagtctccttgtccctctcttcaccagaggagattagcactgtgcaaagctaaaaaatgtaccatgagccacagatatgtgaagattacaccctaaatttttaaaatatcgatatgattggtgaagtattttaaaatatttaatgtgaagccaatgaattttgttcatatgaggctgtgtactgtgaactgcaatgaaaacagtaagatggtggtgatgtacaggtgggagggaggtcactcggcggccagtgtgtagaagtgatcagaatagcattaatggtaaaaatgctcacttaaaaacatgcggcaggggtcacaaaatgaggagtgagtaggagactgaacctataataaaaataatagactgggcgtggcggctcatgtctgtaatcccagcactttgggaggctgaggcaggcagatcacgaggtcaggagatcaagaccatcctggctaacacggtgaaaccccgtctctacaaaaaaatttaaaaaaattagacgggcgtggtggtgggcgtctgtagtcccagctacttgggaggctgaggcaggagaatggcgtgaacccgggaggcggagcttacagtgagccgagatcacgccactgcaccccagcctgggcgacagagggagactctgtcttaataataataataataataataatgtgcacttatgtaagatttactgtaggccaggctccagtttaagcacttgacagatattagcccattcaatcttcgtcacaattgtatgaggtagttaagattatgatctccactttttagatgagaaaactgaaccatgaagagattaaataaccgggccacctggctaatcagtggcagaaccaaaatttgaactcaggcaatcagacaccaagggagctctttactgtgctgtaatccctgtggcagttaatctagaatgcaaagagaaagacagagaggaaagattgggcaggtgataaatgctgaggctgtccaggtaagggataaagcctatatcttgtgccaggaagtggtcaagaacaaaaaggattcctgggtttagaaccaggaacacaccagtccggctggagagggaggcatccagaagagagggggaaagcaggtgtgtgcatgaagcccaagaccacacacctggtgaacaagacagtggggagtggcaagtgataaatcaaagggtggaactggaaaacaaaagagggctaacatgtattgatcactgagccttagatattgtacgatatgaaagataattaaatagcttctgcttaatcctttgcatcctgaaaacagcactcaggcacagtctcaaatctagctttggattacctcaccctgatgtccttatctgaattttctccaacactttctatagttgatgtatttttacagatcttatcaccacttttatgttctgtgaacaagaagagactttgtgacatcacatgttacacgtgtaaatataagaaacaaacgtcacaacaatccaatgaaatgagatccctgattatgaacctcattttgcagatgagaaaactgaagcagaagaaggtcaatttgacaaaagttactcaactaatactggcaaagcagagtttggaagcgaggtctctctgaagacagtccagactcttaagtgggtcaaacaatcttgtcattcatggtgaagctccagaagagggatgtatttgaaagttgagcgatgccatcagttagcaacaaaaagtggctgtttagtggagtagggccttggcattcatgagtcatggatctgagactttggtgagtacccgctttctaccagaggtactcccacggttcagttgagaatactttaaaatgttaagtgctccttcagaaccatatgattccatcaaaacaaacgctacactatgatatggtgatgttcctaaagatactacactatgatattcgtaaagtaacatcaactataaacatacccgaaaataatagactttttattactttgtggaacctgcaaagtcaaattttgatgggaatgttggatgatttctaggttctgtcactatgagtaatattctctggttcctctgttttccaggtcatgtaactagttcacatttcagcacaattccaatatactgtatggcatggaccttcaaggtcgtgaacaaataacatcataaaggccacattttctacaactaagaatgtaccttgacatcaatctgtgcaaagctaaaagtgtaccatgagcctcagatacatgaaggttacaccctgtattttttgtacacccaagaaaaatgttgctgcatacacaaactaggtaactgtgcatgtggcagtgagttacagaaagtacacataaatacctgtaaggaggtccacaattccaagatggaaatggtgttatgcaggtgagagtagttagggctccagcaatgggtccttggtgcactgacttctagtggagattatctctcatccctacaagcctgtgacctccctgcagaccaagaaagcatctcatagttccaccatatactaacaaggagcaagtgctcaataaatatttgttgaattaataaagagtaaaaggggaaggaaacagaaagatatcattgtagacgtatactgcagggtgaaagggtatggatgatcatcctaacagaatcagtaagattcgcacagaggtgagagctgcaatcctcacatatctcacagcctaaaagtaggcatctgacgatcatgaagtagaaagaatgtggacttcggaatcaggcagagcttgttagactggaatccagttctacctctgttagcattgaaatcttgaccatgttgctttcttagttgaacctctcagagcctaggttctctcctttgcaaaatggggaacacaaatgcctacttgcaggttgttaactccctgagggcagaaggcagagactttttttgaaactaatctatttacagcaggctgatcagtgcctagtatacagaaagggctcaaaaaatacttgtggagtaaatgaactactcttttaatattaagctaataacgtcttaagacatacacaacacaatgcctaatacataaataattaccatttttgatgctagctacatgccggttattatgctatatgctgtaagtacaatactgtctgcgtttctcacaacaccacagaccattgttaccctcgttgtatagaataaggagctaaggctcaaaactattaagttttcttcttaaagtggggtttcccaacagcagaactattgacattttggatcagaaaattctttattatggggctgtcttgttcattgcagaatgtttagcattctccctggcctttacccactagatataagtagcaccccaagttgtgacaaccaaaaatgtcttctaacattgctaaatgttccccaggagggaaaaattaccaccccagttgaaaaccacaggcttcaagctactcagcgagtcagcggtgacgctgagatttgaaaagcgtgatttgtgacctaagacctatgctttgcttcctgatgacacctgcaccttccagaatggtgaggaagcaaggacgaggttcttgctactctgaagctaaaattctgttaataaaattgaaggagtctcagtgaagaccccaagaagacatgtaagtgcttgagaagctaatcactggccaccccttcaagccaatactcctttgatatttgatcatttcacaggggcaggaatatgcttaaatgtctctttgaaaacaacatatacttcagtgagagacaacccatttgcattccccagttgtgtaaaaatccatctgtacagacatacagtattgaacttgcaactgatatgtactccggccaggttttgaaaccccctggagtttcatgctccaaagttgttgctttacttttataggatcagtttctgctactcagaaactgattctataaaagaaagagaagaagatggctctaaatacctaaaatgacttcacactgagctctttgatgagcactcctcaaaaagggacacagaaaaaggatgaaagaaaggctacctaatcaaggacaagtgtgatctttataaaggggatggaggatatatattcaagaaatagtagtgtgatcactgccaaccaacagcaaacttttagaacggattcttacataattctgaatgcttctagaaggaattcagaatcactagcaatcagcaaaggttcacaaaggagaaatctcactagacatagttatgtccatctttcatccctcatatccatccatcttttaccagccgagtgatgtcatagactttatctttcagcaacaaatttaatggtctctcaagaaatcttcaaggaagagaaatataacttgaagccgaaagtggggtgttctgtttgctcatgtccttttcaacatctctattaatgccttggagaaagacacaagtagcatgtttattaagtttgcaaatgtcacgaagctgagagggatggtttaatatgatggattataaaaagcatttcaaaaccatcttgacaggctagaaagatgggataaaaataataagatgaaatgtaatagaaataaacttaattgcagcacttagataaaaaaaatatatacaatcacctaaatagaagatgggagacccccagcatcatgaaaaaacttaggaaattggtttgatggaaagtctggtacaagcaatgttacatggtgatggattcttaaatgaatgtgattctgagccacactagtatgagaatcatgtccagagcgagggtattagtcatctgaggagaaaaccagataaacacaagacccgtaaaggaaatgtcagaagacctgggaatgtctgatcagaaaaaaatatgatttgagagacgagagaatcaattttcagtctttggtaactgccacatgcagggtggattagacttagttgaggcttactcagcaagactgacatggaccaaaagcagaagatatgaagaggaaaatctcagctccatataagaaagaacttcctaacaattagagcttttcaaaagtgagtggtctctactttgaggtaatgaactctctattattgagaatattcaacaaaggctaaacggaaatgtgccctgtatattaaggagttgtctggattgagtaaaaccagattagatatagcctaaataaactttgaaactttaagatttgtggtgggagtaattttcttaattaaaaaggtgaaaatgcaatattatagtagagcagggtctcctgttccattggcaactagggggataacatttagggttccttgatataaaacactgttatgatgcatgatgatagatatgaatttagaagaatatcaatgtacagcgatcaccacatcactgtgagttgtgtaattacatacacgacctgtttccaaggtggcaatatgcattttaattttatttctgagccctctttaattaatcgtttttcaaattaactatttctgccatcgctgtaaatcagagtaatataaaaccgtaatgaagtagatctattctgaaataaaaagacggtagcttctctgtgtaaacttgagaagctgtgcttagaaagaagctgaatactaatgcagtgtcgttgttgcttggctgatcattgctgttgtcagtggcgatgtctggggtggtaaaaataaagcgaacttctatccatttgaactaactagagtttgtaagtcatattggtctcagatcctcatatttcccaaactaccattatccaaagcaattccaatagaagtggctagtagcccctatattatttctattataatctaaattgtgaatatcatgatcctacacgactttttattgattaaaaagtcttattctaaggctttctaaaactttctggagctttggcaaagcctcttcacacagaaggaactgacatacttagatcttcatttgttggtgaaatcatatactgtgataaccatgctgctcacagaatatttctggccagagttatgaatggaaaagatttgtgtgatttccaggctagaacatttaagtgctcatgcaagaccctctagagtccttttatccctttggcatggtgactgacaagcctaagacagtgattttttccgtaagcctgggtccctctgtgactacagtgaacagaaaactcttgacttgtgatgaacatatagcatgagataaaaaaaactccttgctttgttaagccaccgagactatagggctgtttgttactgtggcagagccttggcctgtcctgactgaggcataaggactgacttaagggcagactttgctctcgcacccttgggtttgatctctgatatagtttggatatttgtccccaccaaaatctcatgttgaaatgtaatccccagtgttggaggtggggcctggtgggaggtgtttggatcatggtggtggaagcctcatgaatggcttgggccatctccttggtgataagtgagctctcactctgagttcacacaaaacctggatgtttaagtatgtagcacctccccccaacactcttcctctggatcctgcttttgccatgtaccctgcctgctccaccttcaccttctgccataatcataagcttcctgaggcctccccagaagcagatgccagtgctgtgcctcctataaagcctgcagaactgtgagccaattaaacctctttccttataaattacccagtctcagatgtttctttatagcagtgcaagaacagcctaatacaatctcttactctaccatttgccgattgtatgactttgtcgggttacttaacattgtgtgtatctgttttgtcatgtgtaaaataggaatagtaatggtctctgtgtcacgggattcagcaaaataatacatgtttagcggttagcacagtctctgctgcatagtatgtgtgtaatacatattagttttttactttgcataatcagcaaatgtatactcatcatatgtcagatgccaggcattgtataagtccctggaacatcattagggtccaagacaggcacagtttctgcctttggaaactttatatattcaaatccagttctcagaggtttctcttgggagaacccaaagcaagataggggatcatacaatgtatcaatatgcactgggtcacatctttagagcttcagtttctggaaaagaaggtaatggaaagtcaattagaagtaaaaagacaagagggtgggataaatgaaaagaagtatagaattctttgggagcaagtagggagggcacttgagccagtccaggagtgagggaaggcatactagaggaagtaacacagaagctgggaccctaatgaagagttagaatgatctgggtaaagcaatgggctgaagtagaggccataagggcgggggaggtcagttctccattctgcacagcagtccacccaaaactgtgtggctcaaaacagtagtttattatttctggcaattctgtggattggcagggtggttgttctgcttcatgactccaggcagggtgtaagaatgactggatagcccgaaatagcctcattcatgtggctggcagcaagtgctggctgcccaggagctctttggggccacgagccaggggctgagttctcccccaagggttccaaatcatggctgcttgggctacctcatggcatggtggctgggctccaagaaggagctttccaaacagcaaatgtagaagctgaaggtctctaagagccaccattcttgccatatgctattgaccaaaatctgggttccagcccatgttccaagagagaggaagcagaccctacctcttggtggcatcgtagccaggtcacattgcaaagaaacatgccatgggagttacggttgtgacatctttggaaacacagtgtgctatgagagaaatttgaggaaccacaagttgcattcagaatggtggaaagtcggatgtgaagatgcaagtgataaaaatgctgcagcataagcagggttcagatcaaaggcggctttaccagcagggccacatgtcctgctttgcctgggacagacccaagctactcctgccaggacaagagtacattattagcagtgcccacttttactctaaaaataggactacgcagttgtatgatcacctatcttatttgggtgttcccaggagaaaccctgcagaattcgatttgaatataagaagtttacctgggagacaatcccataaaacaagcaggaaagtagagacatgaaacagggaaagggatggagcattatcaagccactcaccactgtgggcacctggaacataatcccaccaggacactctggaagacagtgcgagacatgcctccgagtgtcccaaccaaggcaggaggaagccagggcatctcgccacctcctcccatcctgcagtgatgagggctgcttcctgcggtactaactccccagcacttccagcttgtcccgtgtttacacccaacacactgctgaggccagaggaaagtgcagatgacagcgaatcgcagtcagtggttcctggagcaggactgaggtgaatgccgggcactgacagcatctgccatattacggatctatttataagccatgttaaggttttaatgttatcttaggggttaaaggaagtcaaggaaggatgttttttaatccatagaataacgtgatcagattgacactttagccagataataccatctgcagagtgcaaaatgcataacaggaagtgagaagctgcagggagaccaaattggaggttgccatggttatcacagaattgcacattgtaatgcacaaagcagctcacatatgtggagaaaatgcaatgtctttatctgtgtctgatgatgtcgtattccttctgggtagcaaaggcaaataagctaaacatccaggctggtttaaagctgattctgacttaatcatttcaaaattccttcctggttgtgctctgtccctcatgaataaaaatgttcagtttctcgaagagcctttcccgtcctctgcttctttctataaggtggggaccaggtgtacagaatataaaaggagacaggcagcaacatgtctagctttagcattctaatgataccgtgggcagggagagacctggatgcatgctggtccttgagtttgcatggccaggcatctgctggcctccagcccagtgtcctgtgtccctgagtgctcttctggccttggagcttaaatctgtggttgatgaacttagagtccctttctttgactcaggcagtgttcccagggagcacctgccatcctgccctttgcttacttgctgtgccctcaatctcccacttgagagacccctaagccctaagtctctttcgcatcctccgtctccccatggcaggttgtcgtcagctatcaagcagtgagggctttcatctaaggcttcatgctgcacgagaatgagatgatgcacgtgaggaccagagaccctgtcggcttactcttcttccctctctacatgaggcttggctgccccatgttagtacaggaccgccccccaccaccaccgaccccctacacagcaacctctccccagagccccagactgggaagcaaggcaagagccctaaacccttggtcccatccgtcatcctttagaaacccacttctgctctctgggccaaagcttagctctcgtctctcctgctgtatctcctccttttctcatagtcttctagggcattaagaaagaaaaaagaaaaaaagaaaaaaagctttgcttttacttcctacaaaaaaaaaaagcaccatctaacaaatagctccaaaactcaattgcttaaaacaacaattctatttttatcactaatctgcgggtcagctaagggccgaagtttctcttgtacacctctcgtcttcctcctgggaccagggagttagcatgggcatgtttttctctggcagagacacgagagaacaagccactcacacaagcactttccaggcctttggtcttgtcacatccactaacatctgattatctaaactaagtcatgtggccaaatccatagtcgaggagaagagaaacttgctttcccttcagtgaagaaaacagcaaagtcacatggcaaaggccacggatacagggaagggtaaagaattaggggccgccaatgccatcttccatacttaggaggtggatgcaggagaactctgtgacctcctcgatgtactaaaaagcctgagtaggcccggctcggtggctcacgcctgtaatcccagcactttggaaagccgaggcaggcagatcacgaggtcaggagattgtgaccatcctggctaacatggcgaaaccctgtcgctactaaaaaatacaaaaaaaaattagccgggcgtggtggtggtcacctgtagtcccagctactcgggaggctgaggcaggagaatggcgtgaacccaggaggtggagcttgcagtaagccgagatcgcgccactgcactccagcctgggcaacagagtgagactacatctcaaaaaaaaaaaaaaaaaaagcctgagcaaaggaacttggggaaatcattttattcactcaaaagtatgttcagtgctcacatgtaccaggtgctaggcacagaacaatggataaaacagaaatctcttatctttatgaaccatgtactctcatgagcatagacagaatgagaaaagagttgtgtaatataaatgttagcaataagtgctatgaagaaaagtaaaagaggcttagcaggaaagcatgttacaatggccaggaaagtcgtctttgagaaggcaatatttaagcagtggccttaacaaagtgagaaagctggctgtgtggacatctgctggaaaagccttccaggaagagagaatggcagtccaaaggctgtgaggtagggacacgcctggcttgttcaaggacaggaagaaaaccaacatggctggaatacagccatcaagggacagagtggcaggagacagatgaagtcagagggttagccagcagccaattgcacagatggagaccatcatggagagtctgcattttattctaaatgagatgagaaacagtagaaggttttgagcacataagtaacacaatccaatttacatattagaaaggtcattccagctgtgggatgctgtattaactgcagaaggggtgggctgatataggggcaggatggacactaagagaccatttcaaatacagttgtggagtccatgtgagagttagaggcacgtgcaccaacgcaacagcagtgatggtgatggagaaatctttggactaggaacacactgaagtcagagcccatagtatttggtgatcaaccggatgtggtgggtgagagaaagagaagtcaaagagcgtttcccaaggtattggcctgaatagctggcccagtggtggggctgcctactacaatgaggtaccctgggagagaagtagtttaggaactgtggaataaaaattaagacttccattctagccacattcaaggctattccatggatgcatagcactgaggtgcatatcagaaaccgaacaccacctgtaacacggccttttcctgtctttatctcccatctcctcctcaggcagatagatgtcttggcttgactaggacattgatcgttactgggaaaggcaaaaaagaaaaaagcctattgataaatgtcagaatatatctccattataaagtcattcaggtgttgcatatgaacgcaatgatgaagaagaacaaattactgatacacaaaacagcttggatgaatctctagagaatcgtgccaatggaaaaaaagccagtcccaaaaggttacatacccaatgatcccatttatgcaacatttttgaaatgacaaaattttacaattgaggacagattagtgagtgccaagggttagtgactaggacaggagggaaggggaaggaagagaggtgtggttagaaaaggaaaacaaggaggccgggcatggtggctgactcctgcaatctcagcactttgggaggctgaggcaggaagatcacttgaggtcaggagttcgagaccagcctggccaacatggtgaaatctgtctctactaaaaatataaaaattagccaggcatggtggcccatgcctgtagtcccagctactcgggaggctgaggcaggagaattgcttgagcccgggagacagagaagttgcagtgagccaagatcatgctactgtactgcatctaggtgacagagctagactccatctcaaaaatttaaaaataaaaaagagagattcttctgcagtgggaattattcattatcctgactatggtggtggatgcacagacctacacagatgataaaattgtgcagaatcacatttgcacacatacaagagtacaaaatctgaaataagatcattggatcatatcaatgttaatatcctgatggtgacactgtactcctgatttgcaaaatgtctccaatggggaaactgggcaaaatacacaggggatctctctgtacaatttcttacaactacatgtgattctacaatggactcaattaaagtttcaattagaaaaagcaataaaaagccgggcacggtggctcatgcttgtaatcccagcactttggaaggctgaggcaggtggatcgcctcaggtcaggagtttcagaccagcctagtcaacacggcaaaaccccgtctctactaaaaatacaaaaattagccaggcaagatggcgggagcctgtaatctcagctacttgggaggctgaggcaggagaatcgcttgaacctaggagacggaagttgcagtgagcagagatcacaccactggactccagcctgggcaacagagggagactccatctcaaaaaaaaaagaaaaaagaaaaggaaaagcaataaaagtaaaagaagaccaagtccaccttcttctgtggagccatttattcatgggatatttagtcagtgtctcctaggggctagtgccatccaccctgggggagcgtgagggacaggagagggacctgcagcgattaagccaccggttctacccattccctctttactttcctgcgctagccagtagagattaggaaatatgtgggaattattatttatttacagcttagaattttgtagttcttttagagtcattattgaagagaatgattaatataatacatttctttaaaaaggagctagagaaaatggggtagattaaactgcctgcaacttctctcaaggaaagtccccgatggcagcttatcgccttgtgatttatctctacctcctaagagtagaatgcagcaaaattgataaatgaacaaatggcaaatagttaattgaaatttctggtcagttgcctttgcgttttactataaggacagaagcagcaggaaagcactgatgagaaagctcattgaagtgataggtgagaaataatatttaaactgaagagaagaaattatgtcctgtttttcatatcctaaagaacatatagcgtagtcttaatgtccagaatcttctcaaggctgaaggaaatctattttaaaagaattcactcagggagttctagttcaaggctggcttctcattcttttttaattgcattgactttcattcttagacatttattgggctttattattattattgccttatagaatcataggaggccctaagaaataatttgttgaaactttgtcacattacagctgaggaaaatgaggcccagaaaggttaaatgaagccaaggtcacatagctggtacttcacaacgtttcctttttttttttttttttttgagacggagtctcactctgtcaccaggttggagtgcaatggcgtgatctcagctcactgcaacctccacctcccgggttcaagcaattctcctgtgagtagctgagactacaggctcacaccaccacacccggctaatttttgtatttttagtagagacagggttttaccacatgagccaggatggtctcgatctcctgacctcatgatccacccacctcggcctcctaaagttctgggattacagtcataagccaccacacccagccttcaacgatattttcaatataatatactgtcaatatcagaataatctttgcttatcacccaaatgtgtctttaacaaggacaataaataattaatacatcataacctgcaaacatactctcaatatctagataaaacagctgcaaaggcaaatcttgtcataagtgtaggctggaagaggatattttgaacattgagggtcaggctcaatacaggctctgtgtcagaacacctgcaattccagttgcctcacctgctcgaggagctttaacaggtttcttacaaatctcagcttcagttttcttaaccgtgaaatgagaatgatagtagtgccaatatcataagctttgttaggaagatgaaagatgctatcatgaatgtaaagggcttatcacacagcctggcacacagtgagtgtccagtacgtcttaggcagtatcattacatctaatctttgacttttagctaatacaaataaagaatggctgactccaatcctgggtcactcataaaaagaacactcaaacaatgaaaaactgaaaaaaacttttgattgaaaaccaattggtatcatcatctttccatggtttccaaaattaaattatttttaattaacaaaagcaacccccaccaaaaaaaatcatttattgttaaaatgtgatgagagatcagaagttctgttttaatcacatttttagtatttggttaaagaagattgtcaaaacacttatttctgtcccaaatcttcaactcacctgtctttgacacacaacatacttttgcatacccaattgttttgaaataaacaaacatttgaaagccaaaattctaggctgggctcggtagctcacacctgtaatcccagcactttgggaggccaaggcaggtggatcacctgaggtcaggagttcgagaccagcctggccaacatggtgaaatcccatctctactttaaaaaactacaaaaattagccaggtatggtggcaggcacctgtaagctcagctacttgggaggctgaggcaggagaattgcttaaacccaggaggtggagttgcagtgagccaccaagatcatgccattgcactccagcctgggcaacaaaagcaactctgtctcaaaaaaaaaaaaaaaaaaagaaagaaagaaagaaagaaagaaagaaagaaagaaagaaagaaagaaaggaaggaaggaaggaaagaaagaaagaattcttattattataacattccaaagtattccagaaggcatggaaaatttttgaatttcttatttatatacagttgatcattattattatacatttcatatttacaaattcacctactctctaaaatttatttagaacctcaaaagtagtattcttggtgcttttgtggttatttgcagacatgtgctgtgcagcaaacaatttgtcatcaatgtgtacattctcatttgaagtcaaacaaggtgatgcccttgccttctagtttcagctcttataccataaacaagtatcatttttgtagtctattcagtgccattttttttgcattcttgtgtttttattggtgattttactgtataaaatggcccctaagtggagtgctgaaatgctatctattgctcctaagcacaagacgctgcgatctgtcctgtggagaaaatacatctgttagatgagctgtctttaggcatgactgattgtgctggcagccatgagctcaatgttaataaatcaacaacatttatttcaaaactgaatattaaataagatacacacataaagcaaggtaatgtattggttggttgataaaatgttatgaccagatgcttgcaggaacctaaccctgtatttactttaggaacaatgttttagtattcactaattgagtgttagcagcaactgtatgaaacatagctactgcaaatagtgacaattgactgaattatttttaacctgcatcacatgaatatgatgatacattatgtttttatattattttgcagtttaaacagctcttccacagctattatcacacatgatgttcatggagcgttacagtttggctgtgtccccacccaaatctcatcttgaattgtagctcccataattcccacttgttgtgggagggacccgatgggagataattgaatcatgggggggtttcccccatactgttctcatggtagtgaagaagtctcatgagatctgatggttttataaggggtttccctttcagttggctctcattctctcttgcctgctgccatgtaagatgtgcctttcaccttctgccatgattatgaggcctccccagccatgtggaactgtgagtccattaaacctctttttctctgtaaattacccagtctcaggtacgtctttatcagcaaagtgaaaacagactaatacatggaggtaagaggagagtggttactgctcagcacactagattaacaagtccaactaaggctacccaggtagagcctggtcttctccttctggtttgtgaaatctcatggtgcttcctatagcataaagactggctgtcactcaacaccactgcatcttaaggtccgtggaaggggaacataacatgtttcgaagaaaaaggtctgggctacaaagaccctttatgtaatcttgctaacgacctggaatttaaactttggagagcttgaaggttaacaaattggaataaaaagaaatcaagtcactccttgtttgaatgctctgaagaacaaaacagaaaaacacaatgaaatggtaacagaagaagcagatttggcccaataagtctatgctttgaatgttcctccggcactaacatggccacatttgggaagactggcatccccacagacttttctgtagcactttgaaggaagaatagagcagttgtagaaaaacaaatgtttgcatgaaagaattattcacctcttaaaaatctatagggtgtgaataatcctgctataaaaagcattaaatgtttataacagatatttaatgggactgttatgttttttggcagcaagcatggctagattttgaatgtcacagctctgtgctctggtgataagacagactctgtggtctaagtaagaattattttcctgcttttaaatgtagctgttaaaaaacaataaagtgtatttatctaaggaagataatcttctaaaagaagtgtttaataatttttaattcacaatttatactacttctccaaggtaaattcattttccaactgttactccatctttattgactgggaggaattagcattcaaaatacaaactcagaggttaaagcaaagccatacacagaagtgagccttattccattgtcttttatcacgggtgccagatttatttaacagactgtctttcagtctcacttacagtaactagacaggtactatggaggacagtgtatgttgaatgccttccaagtgtgaaacacctgcctggcactacattatcactaattctaaccttgcaagtaagtgcctacttaaatctgcacttgacatgtgaggaaagaggctctgaagttttaaagtgacatgtgccaagtcatatagctagtaagtggtagaaccatgattccagggtgggtctttctgtgcttgttggtttatttactgtctgtgtttgttttatgaaagagaaaagaccctgagagataggcatagtacaggtgacccttgaacaacaggagaattaggggtgctgaccccctatgcagtcaaaattttgcatacaacttttggcttttcagaaacttactgccaatagcttactgttgaccagaagccttactgataacatgaacagttgataaagacatattttgtatatgtattatatactgtattcttataataaattaagctagagaaaagaaaacattattaggaaaatcataggaaagataaaatacatttattattccttaaatggaagtggaacatcataaaggtcttcatcctcatcttcttcacattgagtaggctgaggaggaggaagaggggttagtcttactgtctcagggttggcagaggcaggagaaaatctacatataagtagactcatgcagtttaaaaccatattgttcaagggtcaactgtgtatttatttgatgcttcagaaaggggaccatgtcaattcctgataaggttctctcctctttccttttcctccatctctctgtgtcgatcctagtgctctcatcggcttttaaccagtagaggtctccaaactgtcttgtggcagcctgggctccctatacacagaaagacctggcttcaaaattctggttaatatgggaagtgcattaggaagtagaaaggaaagaaaagtcaaacaataaggaaaggattaatataaatcataaattaattttgtgggcctaattactattttttaaaacactgtaagttttagtagattttcttactctaagttatagaagtcaaaccctaaaacacgttaaaaaaaatctttttgttatttcttaactattacggttattttatcaaaattaattaatatcaaattaatgataatacaaaggaagtcacattattaattaaacaaagtgacttagccttgcaaataaaacactatcgtgtggattaatagtttgaaggtttaactttacagccttttcaattgactgtaatttagagcatttttaggttcacagaaaaatggagcaaaaagtacagagagtttccatatactccctcacccctccccacgttatacatagtttctcttcttattaacatctttctacgtcatgtttttggtgttacatacttgccacacatagtaccctaataatctcttgggccgtacattctctgggtttggacaaatgtgtaatgacacagatccaccattacagtatcatagagagtggttcccctgccctaaaagtcctctgtctccacctgttcatccctccctcccctctgctccttgcccggtccccaggcaactactgatctttttcctgcctctatagctttgccttttccagaatgtcatataattggaatcatacaatatgtacccttttcagattagcttctttcactttgtaaaatacatctaagtttccttcaggtcatggcttgatagatcatttcttttgattgataaataatatttcagccttatttttgtaaggaaaaaatcaaatcaagaaactaaagtttgaacagccactatagaaaaaaaggcaaaagtcaataaacaaaaacaattgttcagcttcgctcataattgtatacacctcccagctcttggactaggtaacatcagtggccagcaagatgccaccgattgagtgattgtttttatttcatgccatgtgacccattggccctccttttcctgacacatttataatcatcttaatcccaaagcaactgtttttaacaaatatgcatatatcctctgattttctgttgctataacagaatacccaagagtgggtaatttataaagaaaatgactttatttcattcatgcttctggaggctgggaagtccaaggtccaggggccacttctggtgaggactttcttgctgtgtcatggcatggtggagggcatcacatggtgagaaggcaagaccaggtcaactcaggtctctcttcctctttctttctttctttttttctttttttttttttgaattggagtttcactcttgttgcccaggctggagtgcaatggcatgatgttggctcactgcaacctccacctcccgggttcaattgattctcctacttcagcctccggagtagctgggattacaggcacgtgccaccacgcccagctaatttttgtatttttactagagatggggtttcaccatgttggccaggatggtctcaatctcttgacttcgtgatcggcccgccttggccccccaaagtgcggggattacaggcgtgagccaccgcgcccaacctttttttttttcttttcttttttttttttaaagacagtctcacactgtcgcccgggctggagtgcaatggcacaatcttggctcactgcaagctccgcctcccagcttcaagtgattctcctgcctcagcctcccaagtagctgggattacaggcgcccaccaccatgcccagctacttttttgtatttttagtagaggcggggtttcactatgttggccaagctggtctcaaactcctgacttcgtgatctgcccgcctcatcctcccaaagtgctgggattaaaggcatgagccaccgcgccccgcctctcttcctctttctttaaagccaccagccccatcatagggacccaccgcgatgaccttatctaattctaattacctcccaaaggccccacctccaaataccatcaacatatgaatttagagattaagtgtccaacacatgaaatttgggggacacattcaaaccatagcatcttctttaagataatgtaaaactattaaattaaataatagagtagaaatcacactaataatttgtgggtctattcagattatatattacctaataatttttacctattttttgaaaattgttccaatcattccccctgcttccttttcaaaagagtcaaacatagccagttaatttaaggtatctgcaaaacctttccaccaagacttttatggtacagagaagtgactcataagccacaattcaattaaatttagcaaatatttcttggacaacaactacatgcttgaggttggcatggggacctgtttttaaacctcctgttcattctactttgactttttaattacaacagattaaaatatcttattcagcaaaaaaaaaaaaaaaaaaaaaaaaagagagaaaaacccactttgtatattgaatttttgaatacacaagagaagtgcaactcagggtggtgggattcctacctagcaggcctgtctccctttgattaccccaatattccaaaggtgcaggttttgtgcaccaggcactctaataggaccctatcagctcagcgctctcagaaatttcagttgtctcccagcccctagaaagtcacaatagctccagggttgtgcttaacgggccatagtgggaggatttggaaaggagaaggtgaatcttttctgtgaaaagcaggtggaggaaactgaagagtggggagaagagaggtggatgctgacctgaattgtgttttcaggagcaggaagagtgtgctctctgcttaagagatgacctgaatggcaagactacatgtcactcggatggtacacagatactgtcttgatgggagttttcggaacagatttgtcctcccagggtgaaatagcagagagatttgaggcagccctcaactagagtatgaccaataaacaccaacttacttggtttttttcattcctttttccctgtgtccaagaagcaaaatgataatgtaaatgaatacacacacactcacactcacacacacacacacacacaccccatgttggggaggcgggtaaaggaacagaattgctctcagcaaacactggtggcatcaaaatagccaatcatgctgatggctgccacacagctcatggaagccttccacaggccagctctcttgctgttggctggctggacttcccagctcagtccctcacctctttacaggacaaggcacaccagaaaccaaggctgttgggggaggcagcaacagagaccagacgttccctctgcacacacatgatgtcatcaatagaaactctgctgatgatgaacccactttcacacaaaccttttaaagcctgagttattttttgcaatgacaaaaataacaaaccacatttttttaaatagcttccttaataataatggaaattcaggtgacattaatgaaaattgtagcacatgttcaaatcagaatctatgttcagtgttatatgcagaatataaagggatttcttttctcaattgatagaaaagggaagtcatatttaagtagtcacggtatcctagatttttaatatagcaacataattgaataatattttgatgtatctggttttagtatttaaggtgataaaatattaaatttaagcttaaaattaaaaatagaggaaaaagaaaaacaaattgaactgaagtgaaaatgtttcttgttttttaaaaaatcattgtacataacagttttcaccttcacttttagaaatcaaagcacaaccctctatcacatggtaaagagagtcagccatacggaaaaccaagctgattgttctattcctgtgcaaattctaaccctaaaatatttctctataatgctttaagaaagaaagtaaatctggaaaacattttttatcattttgaaagctgcctttgttttgattctcattgtgaaggtcaaggataggagaatttccagagatgggaatttatcttcactttatgctatcatttcagaatgaatagtgatcaggttctaaataatgcattccacaggtgtgagcaaccaccctatcactttctatcttcatgtggctggtgcctacaacactaaatttctgcggcagattcattaaggtagttgttcattccctgtcgtaattagacctcccatttcagccttttatgtcaaatccatcactcaccctggcactcaggctcacctctttacaaagcccttccctggtgctattctggctctaaacacaggtgataaatgtgtcagcatggggcacattcctgtccctgaggaccatcaatcgttaagtacagagagctttttccagcagccttctaagatttatacccatgaggatattatttttgtggctgcatgaaggagaattattacttgaaatgggttttgtgaaaggatggttttggtgttgctttggcaccattttaagcttcttttcacaaaattgaccggcgcaagtcagaatttatacttctatgaatgtagatcttcaccatctgatggtgctgagtcctacagagaagaggatttgagactttccagtttttagagatctctacgatgtgcaagaatctagatattcagaggccgtactgacttcaatcacatggtaaattagtatatgagagttcgcagtaataaaagaagtatgtaagtgatcagcatgtgttttagtcagggttctctagagggacagaactaatggaatatatatataatatatatatatataaaatatggaatttattattaagtaataactcacacgatcacaaggtcccacaatagaccatctgcaggctgaagagcaaggagagacagtccgagttccaaaactgaagaacttggagtccaatgttccagggcaggaagcatccagcacaagagaaagatgtaggctgggaggctaggccaagtctccctcttcacatttttctgcctgcttgtattctagccgtgctggcagctgattagatggtgcccacccagattaagggtaggtctgcctttcccagcccactgactcaaatggtaatctcctttggcaacaccctcacagatacacccaggaccaatactttgcatccttcagtccaatcaagttgacagttagtattaaccctcacagcatgggaggtaatgcgtatgttaaatagtttcatttagccatttcacaaggtatacagattccaaaacgtcatgttgtataccacaaatatatgaaatttctacttgtcaatttttgaaaaaaaatgtttaaaagaagtgtgtaaataacttcttactttagatataaaatcttaagggccaggaaaagggcaccaaaatccagcctttgacatctcagaagaagcgatgattaatttcatttcattctgttggtttccatggagtggtgctgggtggtgaggcaaacacagcagcaggaatgttaacatttcatattttagccctaggagtaaagaaaaaaaacatgtcccagatcagcactagctagaaccaggaaaccccaaaagcaaaggtttttttgttttgttttgttttgttctgttttttgtaaaagacaggttttcacaaaggaagttttccaaattctatgtataagagagttgagaaggaagatttttctctcttcttgcccaggaggacaaagggaagagtaccacattaagccattcaggtaaagtgaagcttattgaacgctgtggattaggataaaactaatagagttttcatttttaagccagttcagatattcagattaattatggacgtaatgtagaaaataccaatttctgcaagttctacatttcatgtgaaatcccaaagaggttaaagctgatgggttttaactgatgaaaacacgtgcctctgattaaaaatgtttgtagtgatgaaaacaaagcatgctagagttacagtgtgtagcatgctgaagccaccagcagagcttaggggacaaaaacaactgtttcctaagagaaaaagaggctgagtatcttaagcctggggaagggaaaagacagtagttagcaagctcaggttagccactggtattactctacctttcatgagactcttcactggggaggttggggagattcggtctcacctaaaggagagatggctcgtgaacccaaggatgctgcagggaccctggccaccacttgcagcccaaacactagaatgaggaccagagaacacaatctagctgcttcccatccatcccctccaccccaacatctggtctcagcaacttcctctgccctacactgggatgccctccttagttgatctgaaccatgcagcagatgaaacatgttggcctgacaagtagcagatggctataattgcctgagccatctacaccggcaaatttttcttctttatttgcatatgagtaaaatttttcccagtgttaaattatggtgtgagtagagattttttgagggagcacagcgcagttgtatagacatcgtgattgacaaaaaataaataaaataaaataaaataaatgaccaaaatctgctaaatgaatttgaattaaattgttctaatgctttctttttctttgtaactcttcaccaccacctcaatacatgcattcctggacattcacgcatacactcacacaaacacaagcatggtattttttgtgtgtgagacactgaaggtagcatgaaatagcaaccaaaaaatctgcagtattaaagttagatatgacttggtttgacttgcaaatcaactgcctcactagtaagatgacttctggtatatggatatgtctctcagttttacaggcttgttttcggattaatggtaatagatgtaaagaattgggcacggtaagtcaatagtcaaagctattcaacaaattgaggacaaacaaggaaatgggttaggaattggtctgtagccagtctcagaaatgttgtattaacctttgggatataatcccccaaaattaaagtatagtgattcatccaaaagtacaaagtgttactagcaagatggatgaggatttccatctaacatttttcatcttcttatccctgacacattattaaaacacctagattttggtaaaagaggagaagtcatgtcttggacaggattgaaggttgtgtcaacattccctatgctttcaagtttcagctttagaatccaaaacccccgggcacagtggctcacatctgtaatcccagcactttgggaggtcgaggcaggcacatcacttgaggtcaggagttcaagacaagcctagccaacatggtgaaacctcatttctactaaaaatatggaaattagccagtcatggtggcgcattactataatcgcagctactcgggaggctgaggcaggagaaccgcttgaacccgggaggcagaggctgcaataagccgagattgcattgcaccactgcattccagcctgggcagcagagcgaggctccatctcaaaaaaaaaaaaaaaaaaaaaaaaaaaagaatctaaaccctttggttcacagatggaaggaaaaagcaggcggtgtttcctattctatgtgtatgccatgcctcgagccctgaacaggctactcatctgtggccaatattatattataacctctccattctcagaaggcacgctggcacccatctctgcaagaaaggcatcaaattgtctgtaagtcacagaaatgttattgtattgtcctttattcattcattcagaatatactctctaagcatctatgtaattaaacattactaagcttacatataattaacctcgaaataataactaagcattgttagttttatgtacggctaacttaagaaataaactcactttctagttatcagttttggaaaacaaaagagctctataacaattttgaattaatcaaaaattggagaattctgtgcaaacctataatccttccctctttagggtgaaggagcaacgctttgtgttacttaaagacacactttgccattgtgattaactataataacttttaaaataatcaaaaaatcagtccactttcttgtctatttgtgtattgatcactaaaattattgtacctagtatgatcaactttgtatattactgtatttcattaaagcagctaacttctcttgtccagacataagagaacactagaagacaaaaaacaaaaaacttttatgaatctcttttccttacgaacactaattttataccattttaacatacttgaggtggcaaaaataaacatatatatattatatcatccaaaagtatttgcatattttattaatctattgccattctaagaattcagggtaagttaaaattgtgttaccaaccagcatttattttgcatctgtttcactcttgaaattgtctaggtttcaaagattattaactaattaacttcaccatttgtctaaggtcttaaagttagttaaggatcgagaaatcacaatttttgcaaacataatgaatcctgacacccagcacttaaaaattttacaaaacttaattcttttaaaaatccattaccttttcatttaattgactataattatatgtatgtatgtgtatacattttaaacaagttataaaatttgtgatgatccacttataaaaacaatgtaggaaatttaggaacttaaatgataagaaatttatcattggtctcgtacaaaccaaagtattattctgatattatttttatatgataaatgaaattgtaaagaccctaagtcgtgctcaaggctcttcttctatcttgaactaaggttttcttcttatcttgtaactatagtaacaagggctacaaaagaagcacagcttaatatttttccttttagacatttttgactactaatatggtacagatattcctaatgtgcactcataatgatagagtgaatattttaatcaattttttttttttttgagacggagtctcgctctgtcgcccaggcgggagtgctgtggcgcagtctcggctcactgcaagctccgcctcccgggttcaccccattctcctgcctcagcctcccgagtagctgggactaccggtgcccgccaccgcgcctggctaattttttgtatttttagtagagacagggtttcaccgtgttagccaggatggtctccatctcctgacctcgtgatccatccgcctcggcctcccaaagtgctgggattccagacatgagccaacgcgcccggcctcaattaatttttaaagcttcccaaaagaggataaaagaggaggaaaggaatagaaaaaaaagcagtgatagggacccaccttcagacacttaagacattatcgctgtaaaaagcaagggtcttccctctgcaagaagaggcactaaatgtttagattcaggaaaacccactgtgacatatatacatgcaaaagataactcttacagctggtataaacaattatttgggccttgaaattcttatcaagtaacatgtttaaaagccagactttattaatcctcaaagaacagaaatgtagaaaacagcatttacaatgagccaaaaactctctctttttagattgcaagacaggtatctcttcatgaagctttctccaatttttgttctcaggcaccactcaaatgaacaatcttgttcatgtcaaaaaggtccccaaaatagccactgcagttcaaaattatcctgtgaaattggctaggcatggtagctcacatctgtaatcctagcactgaggtgggcagattgcctgagatcaggagtttgagaccagcctgggcaacacagtgagaccccccccgcccaccatctctactaaaatacaaaaaattatccaggcatagtggcatacgcctgtagtcccagctactcgggaggctgaggcatgagaattgcttgcacccgggggtggagttcgcagtgagccaagatcacgctgctgcacttcagcctgggaaacagagcaagactctgtctcaaaaaaaaaaaaaaaaaaaaaaattatcccgtgaaattctgccagttaaagacacaagcatgtcagttaaggtgatgtgagaaagcaggtatttgtttcatagaaaatgcccagttttaggatggatcagacactatgagcactgcaatagatcctcccacacgatggtgcccgtgcagcctactttcgtcaggacttggccaaagcccattccagggtcagacaatcccttctgatttcaagaagcctaatctaaacaaagcagctctcaggaaaagaacaagaccgacgaaaaagttcttctaagggttcgaaatcatgacccaagtcaaagtttattcaaagaatgttgattgtaggagaacttctgaactcctaggcccctgagccagctcaagaactgacttacctggcttatgctcattgtctccctagagaccttttgttttagagataaagaacactcaagacactgtacaagcagacagtccataggaacatatatctgtagactggtaaacagtatcaccaaagaacaataaaaatcagatcagataaccaaaaagtcactggtaaccttattcctaggggaagaaaaaaaaagagagggagatagagaaaaggaaggaaggaaggaaggaaggaaggaaggaaggaaggaaaaacacctaaagtggaaggacctcagcagaatatggaagctcagttcagcatgaacttctcctagcacgggcagtgtggttacatcagacagctagagacacaaagggtctcaaataagcacactaaaattggtgagtggagggttcccatccaagactgtagggctcacagatgaatattgatggatcttcaaatgcagagattaattacagccactgaccactaggagcccacctgtagtagaacaaatgtgggattcttcactcattgcatcatgggagattgctcattatggagaaccatagaggcatctcagtaagaggatgctggaaagagggtgctagaaagtgctattcggttttcagtaggtgatttggggagagttaaaaaaagtaggggtttgttctagattggatactgtcaggaagcaggtaattctgtgattgaatatcttaatttttttttatcttgaagacagtagagaaaaacagctgtagttggtaaagaagtagaaatgatgtgtattaggctgagaaggggtatgttggatcattttcgtgttctggccagttttcttttttcagtgctgagacatgtctcatggagtgacctcttctttgcctttccccatgaaggtcacggaatgaccttgtctgatgttgagttctgtgaaatggatcaccccaaacagaagcacacatggcctggctgtgagttcccaaacagctccccacgctcaagagctgcttttctttctcattctcaattaaggattgaaggaggacacaaaaacacgatcaccaaaggaaaatgaaacaaatttaaagtaaataaaactcagcaaaaagaaaaactacaggaaaagaaaagtaactgtaggaaacaataatgacttagccctaaatggcatttacgtggtcttaatcatatgtgaccttaatcctataaaaaccaaattgtgatctaactccaagtccaacctgcctattttagaagggtagttggatggtgctagtggatggtggggaggagagtagaagctaactcatcatcatccgtattggtaagtgaatagataatgcctaaaaacatgtcatgaaattgcaatgtcaccacatcatttggagatacgtttttaagtcagcctaaagggttgaaaatgcttctaggctggggcaacgggagggcagagcatagaagatggtaatgattcctgaccatccttcaagaactatctttctaattttttccatcttctcctccctgctttattctagccacactggcagctgattagatggtgcccacccagattgagggtgggtctgcctctcccagcccactgactcaaatgctaatttcctttggcaacaccctcacagacacacccaggaacaatactttacatccaaccaagttccaaggattggaacaatacaatcaagttgacactgaatattaaccatcacacacagacatatatacatatatatatattttttagacagggtctcactctgtcacccaggctggagtcgagtggtacaatcatggcttactgcagcctgaagcctcaacctcctcagctcaggtgatcctcccacctcagcctcccaagtaactgggactacaggcacacaccactacaccttgctaatttttgtattttttgtaaagatggggtctcactaagttgtctatggctggtctcgaactcctgggctcaagtgatccacccactgtggtctcctaaagtaagtcatggcacctggccaactttttttttttttctttttttttgagatggagtcttgctctgtcgcctaggctggagtgcagtggcacgatctcagctcaccacaatctctgcctcccaggttcacgcctttctcccacctcagcctcctgagtagctgggactacaggcgcccacgaccacgcctggctaatgttttgtatttttagtagagacagggcttcaccgtgttagccagaatggtctcaatctcccgaccttgtgatgtgccctcctcagcctcccaaaatgctggtattacagatgtgagccaccacacccggccccaactttttaaaaatattttttaaagaatgagtagaagtagccaggtgaagaaaagaaaaggaaacagagctgggaaaaggtgtgttgcatcagaaactagaggagggcatttcgcctggaccagagaaagttctgatgagccaggaaggctgggcagagccagctcaggccaggcaggcgcgattctgcacaggacaggatgcacctccaatgaccacgtgtttctaggttgtttccaagggcacacagataacagtcaacgatttttttctgactagccactgtagtgatcgctgctgtgtgaccctccacactttgcttccctcgggcctcagctccgcctcattccactggcctaataattaactcagccttattttcccaacctaattgtttcacagaccaaaagaaatattggatgtaaggtacaatttgaaaagtgtaatgtgctctagaaatgcataaaatgatgattagtctttgcccagtaggctttttagcttaataagctcctgataatacagaaatcactgtgagcaactggcagagaaagatttttccatttctcttaactaagaaaagagatttaaagtcactttggagagctaacactaaataataataactgccaaaggaattgatttgatgctgaatataggcttgtgtaaggaggtaaaaaactgtccactaaagttaatgctcatagtaagaggcctctgtccttgaattcaccttgagagagttgaacagggataacggattttcaaggacacacatctacagagaaagggcgtatggaaatggaaaagggaaagctgctcctagtgtttttgctgaattgttctctttctctaacccagcaggagagatgctaaaggagattttgtcaaagaaaatccttgacattggattcttaaaagccttatggtttcatgataggccctttaccaaggattcttaagggacaaccttatgttagagagaaacaaagtcctgaatcatatttcctcctctctggaatatatgtagaaatacaagtgagaagataaatacatgtgtaaaaagaaaattcatactttcatactcgttatatgttatgattaaatgttgattgcatttggagagcatcagcatatgaactatattacagaaaggatagtcttttgtttcatggcttaaatcttcttttctcaataagattaaggggctagctaagattataatcataacaattttttttttttcactgagtttccaccctgtgaggaacactaggctaagcaggaaaaaaaaaaaaaaaagtcactaaaagaccctaggctatttgtacaccaatgttcatagcagcattattcacaatagcaaaaaggtggaaagaaccaagtgtccatagatggacagataaacaaaatgtggtctatacgtacaacatgggtgaaccttaacattgtgttaagggaaataagccagttacaaaaggacaaatactgtatgattccatttctatgagatacttagaggagttgaaatcatagacacagaaagtcagatggtgactgccaggggctgggaggagggacaatggggagttgttgtttaatgggtatagagtttcaattttgcaagacaaagaatttccagagatgggtggtggtgatggtgcacaacaatgtgaatacacttaatgccactgacttgtacatttaaaagtaggttaaaatgggccaggcatggtggctcacacctgtaatcccagcactttgggaggccgaggtgggtggatcacgaggtcaggagtttgagaccagcctgactaacatggtgaaaccgcgtctgtactaaaaatacaaaaattggctgggcatggtggcatgcgcctgtaatcccagctactcaggaggctgaggcaggagaatcactggaacccgggatgcggaggttgtagttagccaagatcatgccacttcacttcagcctgggtgacaaggcgagactccgtctaaaaaaaaaaaaaaatatatatatatatataggttaaaatgtccattttatgttaggtacattttactgcataaaaaaaaaaaagactatgggcaagccatttccttcctctgtgcctcagtgacattatctgtgaaataaatgtgtagaaacagatggactccaaggatgcattcaactctgcaagtctgtgtgtctaaacatcccctctgtcctcatggggtttagcagcaagttggagagatgaaatgcagtaataaaatgtaaaatacttctagttaatgttttaagtacccaattagtgattttttaaaaaggaatatgtattcccttgagaagggatagagcagaaatctggaggacagctttgtggagatagaactggaccatgcccacttcaagaagtatgtagctcggatgtggatctgtgccagtgggatggccttaacaaaggtgagcaggcttcaccacaccagggggtccgtagaacagcaagaagatgagcctgttggtggtagaaggcttctgcgtcaaagtgaagcattgaggaggacccatgggtgactttgagggactctgaatggaagagagtggatggacgagacacctggcctatccacaaactggccctatagccttgaataatcactgggacctcagttcctgctgtatgacaccaaggctagctcctttacaagacggaagcacagcctagctgatcttgctcttcctgctggaaaactccatgattctctttgccttccaggcaacagacacataagattcctgctgccaggtcactgctggatgctggactccagcagtgacaggccccgaacctgcccttgtgaaggccactttcttagtggtggtggctcatctagcaggctgaggaatgtacaaaggatgtgtaagaaaatctacctagcagtagggtatataatgagttaaagaactgagcttctactggcaatgagaccagccagggtaatgttgcaaaagtttagatgtacattaagacccagaagggctgaacttggttaggggagaggaacatgaaatgaaaagtctaatgcatgaaccctagaaccacatgaatattaaagctcacactgaagtatctgtgcctccttctcccttgccctgccctttttcagcctcccaaagctgcacccattcctcctgtgtccccaatatcccctatgccatgtgatgtggtttgactctgtgtccccacccaaatctcatctcgaactgtaatccccatgtgtcaaggggggacctggtgggagatggttggatcatgagggtggtttgccccgcgctgttctcaggatagtgagtgagttctcacaagatctgatggttttataaggggctcttctcccttagctttcgcttctctcgcctgcctacttccccttccccatgattgtaagtttcatgagacctccccagccatgtggaactgtgaatcaattaaacctctttcctttataaattactcagtctcgattattctttttttttttttttttttttttgagattgagtctctctctgtcacccaggctggagtgcagtggcaggatctcggctcactgcaacctctgcctcccaggttcaagcaattctcctgcctcagcttcctgagtagcttggattacaggcgcctactactgtgtctggctaatttttgtatttttagtagaggcagagtttcacatgttggccatagttgatcctgatctctcaggagatctgcccaccttggcctcccaaagcacttggattacaggcatgagccttgggtatttctttatagcagtgtgaaaatggactaatacaccatggtaactgggtcccatacatcctgaaaatactaatagaacaaatattcccactcctgaaatttaacttgatcctgaagacgaaggatttccttgagctcataaatggaagtggttcatcttccaggtagagaatgcaaggtagattggttttgttcacaggggtcatgcagagctaagcacatagaaggtgctcagtaagcacctgctgaacatactgaagtgacatagccaggcagagacgggtaggtggacagccaacacgccatgagagctggaagggcgcatcctctcttaggagcttgggccctggccagctgactcagcttcaagctctgctagtacataagtccctcggggcctataagcttggccgtgttgcagctgaaatttctgctgaataaggtcatacatactaagctgagaatgcaatagtgagaatggctccttctttttcgcatcccagaccccagaatagaaatatttaccatcacgtctggatgataatatcaataaattatcagacattgcacgtattaagaaaagctcattttctggaaattgtccttattgtcctaattgggaattatcttgaagccgtggatagaaaatgacctttcagattgctgggacaaagcccaagtctaaattggaaacgtgtttaatggctaagacagcccacttccagattaattatggatgcttttccatttcaagattacattaggaaggaaagttgtcactgggtggaatgtgagtctccactgcatccttttaagataaataagttgaagtttgaagaaaatttgagattacttttggttaagtgaataaaatctgtttagcgaactctttgaagttgtggattgcctgggaatctacaaatctgcaacctccctccctctagatacattcagagggtagaagagaagtcatttaaaaccttatgcttgacttcttgcttcctgccttggtttttaaccaaaactaaaaataaaaaagccaaaagagaggaaacttgataggttcaaaacaggaaattagattgtaagcaaagaaattgtccaaacatcgaaaaaaggaacacatcaaagaagggaggtgctttgtttttatactttgttatcgtcctggaaaaaaatgtctgctgcctctgataatacatattaacacttcttttttacttagcttttatttttatcaaagtaataaaatcatcttgtttaaagtgtcaaatagttctatatggcttattaggataaacaaccatccaattttcaagatttttttttcctttggcatttgtctttaattctctaaatatattcacctgctacttgaggggtcagcagacttttcctgtaaagagcaaaacaatgagtattttaggctttgagagccatagagtctctgttgcagttactcacctctgctgttgtagcacaaaagcagctgtgggcaatatgtaaatgagtgggtgtagctgggtgctgaaaaaactttatctacaaacacaggtggctgcacagtgggctgtcctttaccgtctcctaggctactccttgagtttctgtttttagtcagtcactgttaggtgactcctgactatggaagatgaggattaggctctttcacagccaacaactctcctccatggcctcctcccctccatgtttttcctttaccttcacccttccaataggatggtttactggctttggatagatccgtatgcagtgtttacatcatcatgcttttcataactgaaccatataatagagctgtgtttccagccaggcatggtggttcattcctataatcccagtgctttgggaggcacaggtgagggattgcttgaggccaggagttcaagatcaacctgggcaacatagtgtgagatcctgtctctacaaaaaaaaaaaaaaaagacattaacttggtattatggtgcacacctgtagtcccagctacttgggaggctgaagtgggaggatcacttgagcccaggaattggagactgcagcgagctatgatagcaacactgcactccagcctgggtgaaagaccaaggccctgtctcaaaaaaaaaaaaaaaaaaaaaaaaaaaaaagtttcctttcctacacactattttgttttccttaatcattatattgttttcttcatttgcttaattttttgtgaactaattatgaattgaaactcaagctctctctcaattttaaaatcttccctcaacatattgcagccaatataagaggaactcaccatttcattttcttggaaacttctaccccagagcattctggctggataggccttgggcatctgtattagtctgtcttccttctgctataaagaactacatgagactgggtaatttatgaagaaaagaggtttaattgactcgcagttctgcagggttaacaggaagtctggctaagacgcctcaggaaacttataatcacagcagaaggtgaaggggaagtaagcatgtcttacctctgcaaagcaggagaaagcgagtgagctgggatctgccacatacttttaaaccatcagatctcttgagaacccactcacactatcatgagaacagcaagggagaaatccgcccccatgatccaatcatctcccaccaggaccctcccctgacacatgggattacaattcaaggtgagatttgcgggggggacacagagccaagccgtatcaccatccttgcatctctcttctccatcatcatagataacctgggcctccggatggcatgagatccccctcctacccggcttccatgactttctctttgttgatctagtcccttttttaaaaatggagccatccttctgtagcttcctgagaaagaatgaacgggaatcacattttctgaaacattgcaagtctgaaaatgtctttattctccctcatgcttaattgaaatcagactgaatacagaattctcatttagaaattatttcccttcacaagtttgaaggaatttgtctattgtcaatagtattgctctcaagaaattcaatgccattttcattctcaattctttatttgaactcggtgtttttctctctggaagattttaggttcttattcttctttgttttctgaaatctcatgaatattatttgatgtgggtctattttgactctttctgttggaacacacatggggccttttaatctggaaagccgttcttgaactctaggaatagattttgggggacaatttcttctttcatttcctgttctctcttcccagaatttgttattcagctatcagaccccatggactgatctgttattttcttatattttctttcatttgttcaatttctttggctgttgtttcccctattctctgaacaatgttctcaaatttacatttcataaactctcattgagtttttcacttctttttttatgttctgaatttccaagagctctattttttgttctttgaatgttcctttttttaaatcatctgttctcatttcatgaaagcaatatgttatctctcagaaggtattaatgacggttttctcccaagtgtttcttttcctactcagcctctttttccttcaagtagctttctttggttggttggttggtgtgtgtgtgtgtgtgtgtatatgtgtattttcgtttgtttttcttttttcttctcctgtgtttgagacatgtcctcaaatgcctggttcccctttagctgacacccacatttaagattgaggcactacaaatatgactgaaagttctgtgcacacaaatggggcctgtcacccgtgggcttcagtggctgagttgtttcatcgggaagcccctgatgttgcatcactgagatttttgtcttgggctgattgaaagctccagagaagaattttctgccctgttgcctggagggtagacacctggctgtcactgttctcacagctaagaaggaagaggactgcgaggttcaagattcagtgtgtaaatgttgactgaagatccctgttttcagtacagagcccctgccgtcctatgcctagagtcctccaactgagagtctctgtgtccttcccagagaatacatcgttcctcttctgccagagtgaggggaggacagatgcctggggtagggatctggggatataaatgttcttcacgagcttccagtgagttcttctgtttttagcttcacataaacacacatatccagtggaaactcttgccatcaactgcacaaataatgggcggctttgcagtgccaaccgggctacttctcagcactctccacctcagtgcaagcatctgtccttggatatgctgccacttaagatggttctgctgtttttcagctctaaaaaggttgttatcatcccctgcctcatgatttgttcttacaccttcgtatatcttaacacttcattccccttttcacgggctttatgaagaagcagtggtaaatgtaggtgctcaatccaccatctttaatgggaatccttcagcacttctattttagaaaaaatgtgaagaatatacatagagactgggcatggtagcgcatgccggtaatcccagcaatttgggaggcggaggtgggcagatcacctgagttccggagtttgagatcagcctgggcaacatgacaaaacccacccatctctacaaaaaaaacacaaaaattgcccaggcatcgtggcacacacctgtagtcccagctaatggggatgctgaggcaggagaattgcttgagcctgggagatggaggttgcagtgagctgagatcacaccactgcactctaacctgtttgacagagtgagaccctgtctcaaaaaaaagaatatactaaacactcatttcacaatattcttgacttattaaagctggagtcatggcataatttccaatttgcttttcaaaagaattaattgatcagctaagaaatttacaagtaatttttttcaaatagtgaggtcccttagtattaaaatgaatttcatgttttaatactaggtttttcctcccacgcagtgaattttcttcttgctttaagaagaaatgctctggagagaatataaaattatatatagttgtgtatgaattatatgtcataggattacatataattatatgtaaatataattacaattataacattaatacatgttcactgcagaaaacttggaaaaaaacaaagagtttaagagaaacttcataatcaactgtattctcaacaactacagaaagcttaaccaatgatttgtccgtatccatggctaagaacgaatgtacctacacatctgtgccatttttaaattggcattttttaaaaagtagatccaattttagaagtttgaaatctagtttaaaagcctagattttatttttttccattttaacctatttatgtatttatttatttatttatttatttatttatttatttattatactttaagttctggggtacatgtacggaacgtgcagttttgttacataggtatacacgtgccatggtggtttgctgtacccatcaacctgtcatctacattaggtatttctcctaatgctatccctcccctagccctcccaccccccaataggccccggtgtgtgatgtccccctccctatgtccatgtgttctcattgttcagctcccacctgtgagtgagaacatgcagtgtttggttttctgttcttgggttagtttgctgagaatgatggtttccagcttcatccaagtccctgcaaaggacgtgaactcatccttttttatggctgcatagtgttccatggtgtatatgtgccacattttctttatccattctatcattgatgggcatttgggttggttccaactctttgctattgtgaatagtgccgcaataaacatacatgtgcatgtgtctttatagtagaatgacttataatcctttgggtatatagccagtaatgggattgctgggtcaaatggtatttctggttctagattcttgaggaatctccacaaagcctagattttctagaggaattcttctctatacagggaaacattgcagtaatgagtttaagtgcattgattctttaagcacatttgtttgttgaatgataagactattgtatgtagttcacatccagccccctacacaactgtcacacacaatgaccttcacagtgattcatgcctgaacaacattgtttcctttgcctttaggcttgcaattgggaactcattttatttgaaccaaagccttcagtcgagatgaaaattttcactcacgtctgtgtgaagagaccaccaaacaggctttgtgtgagcaacaaggctgtttatttcacctgggtgcaggcgggctgagtccaaaaagagagtcagcaaagggagatggggtggggccattttataagattcgggtaagtaaaggaaaattacagtcaaaggggggttattcgctggtggcaggagtgggggtcacagggtgctcagtaggggagcttttgagccaggatgagccaggagaaggaatttcacacgataatgtcatcagttaaggcatgaacaggccattttcacttcttttgtggtggaatgtcatgagttaaggcaggaaccggccatctggatgtatacgtgcaggtcacaggggatatgatggcttagccttgggctcagaggcctgacattcctgtcttcttatattagtaagaaaaataaaatgaaatagtggtaaagtgttgggacggcaaaaattttggggggtggtatggagagataatgggcgatgtttcttagggctgcttcgagcgggattaggggcggcatgggaacctagagtgggagagattaagctgaaggaagattttgtggtaaggggtgatattgtggggttgttagaagaaacatttgtagtgtagaattattggtgatggcctggatacgattttgtataaattgaaaaactatacggaataagagaaggagaaaaacaggtattaaaagactaagaattgggaggacctaggacatctaactagagagtgtccaagggggttcagcataattacttacttggttggcaagtttttgggctctatccttgagttttttatgttgtcatacaccaggccagattgatttaggtaaaaacaacactcttcatttaagaatatacagagtcctcctttttcagcagtgagtaagtcaaggcctcagcggttttggaggacaactgcagctaaagagtcaacttgggcctggaggactgataaagtttgtgatatgtctgtgatgctagcagagaagtcattagagaggctacggaaggtcgtgacagaggttgaaatgcctgctattccagtaccgagagcaatagtagaggcagaaagtcctaaaccgacaagcaagggaattagtggaataactcttttttgtcgtgtcggtgtcatgaggggaacagggagctcttcggtcctatttgcaaattgaattttgggggtaaggaagactagtgtgcatgtgcctgtccaattagcaggtagacacatgtaggtagaggatccacagacgaagagaccttgtgcgaggcaaaactggagatgcaaagtaaagagaagcagtgctgaaaggggtgtcttgtacccagactcctaggtatccagctagggtggcagccgtcagaggttgtaatggggattgatgaagtaactgcgtagagggggaggttcgatttacatggtgtgtgagaaaacgttgagtatctacgagcaacctttcactgttattttcggggctgggtataagtaaacaagaagagggctttggagatgaagagtaaaggaacatcgagaaggtgaaagattacctaagggaattccagtaggtctttgctgagagatacataaaggagcggccacaggaatagtagtttgtgttgtgagaggtctaaatatggggggagtagagttgatataaggagaaaggtttttcaagtaagtgtggaggagggtggcagcttgctgatgtgaaatgtctggggaggtcttgctggacctgtctagaaagtaaatgagttcttcaggagggtaaaagtgagggctgttaaaggaagtctggaggtgtagggagacaggaggtgttgcctagtctgcatgtaaggtggggacaactgtgtaggccctggaagaaagggaaatgcaaagccagtggttgtttgctaaggagggattagaaacggctaggagagaatgagtaaggttgatagcgtggtggagatagctggggagaggtagagggtggcagaggaatgggaatgagaataaaagtgagtataaaagtaaagaatagaacttcgtcagggtgaaagtactggagggtcccctgccagcaaagatcatctatccactctaagagggagttaagagttgccagtcctgggcgggggcaaatcctcgagcttgatgtgtagggaagggagggggcctgaataatccctgaagagtagcagaatagcagatggaagaagttacttccttgaggatagatttccacgatggaaagaaaatgagaggttctaagaggcaggctagtggcttgtactatagcatagcctgcctttgctggtgtgtggcgattaggcctggtggaactgccatcaataaaccaagtgtgttcagggtgaggaacaggaaagaaggaaatacggggaaatggggtgaatgtcaagtggatcagagagatacagtcataggggtcaggtgtggtatctggaatactgtgtgaggccggattgaagtctgggccaggaacaatggtaattgtgggagattcaacaaagagtgagtacacctgaaggagccggggagcagaaagtatatgcatcaggtgggagaaagaaaatagatcttggaagttatgagaactgtagacagtgagtttaacacagtttgtgattttttgggcctctaaaagtattaaagcagtggcagcagctgcatgcagacatgagggctaggctaaaacagtaaggtcatagttgtttggacagaaaggctacagggtgctgtcccggctcttgtgtaagaattctgaccgcactaaccatgcctaggaaggaaaggaattgttgttttgtagaagggattggggtttgggagattagccagacacgatcagcagggaaagcacgtgtgtttttatgataattatgctgagacaggtaacagatgaggaagaaatttgggcttgactgaagtaatgggagctgtctgtgaagccttgcggcagtacagcccaggtaatttgctgagcctgatgggtgtgagggtcagtccaagtgaaagcaaagagaggctgggatgaagggtgcaaaggaatagtaaagaaagcatgtttgagatccagaacagaataatgggttgtggagggaagtattgaggataggagagtatatgggtttggcaccacagggtggataggcaaaacaatttggttgataaggcgcagatcctgaactaacctgtaagccttgtctggttttaggacaggtaaaatgggggaattgtaaggggagtttataggctttaaaaggccatgctgtaacaggcaagtgataacagactttaatccttttaaagcatgctgtgggatgggatattggcattgagggggtaagggtgattaggttttaatgggatggtaaggggtgcatgatcggtcgctaaggagggagtagtggtgtcctatacttgtgggttaaggtggggagatacaagtgggggggatgtgaaggaggcgttgaactgggggaaaaggtggcaatgaggtgtggctgtagcccaggaatagtcagggaagcagataatttagttaaagtgtctcggcctaataagggaactgggcaggttggggataactaaaaaggagtgcttaaaagagtattgtctaagttggcaccagagttggggagttttaagaggtttagaagcctggccatcaatacccacaacagttacggaggcaagggaaacaggcccttgaaaagaaggtaatgtggagtgggtagcctccatattgattaagaaggggacagacttgctctccactgtgagaattaccagaagatcggcatccgtgatagtctagggggcttccgaggtgatcgggcagcgtccgtcttcagccactaagccaagaagatctgggaaggagtcagagagccttaggccagagttccaggggctctgggagtggctgccaggtgagttgaacagtccgattttcagtggggtcccgcacagatgggacatggcttaggaggaatcctgggctgcgggcattccttggcccagtggccagatttccagcacttgtagcaagctcccgggggagaaggttctggaggaatccctggcagctgcagttcaggcgtttggagttcttgtgtgctggagatatggctggggtttgtctcacagtggaggcaaggaattgcaactcagaaatacattgctacttggctgcctctactctattattgtacaccttgaaggcaaggttaattaagtcctgttgtggggtctgagcaccggaatttaatttttggagtttatttaatgtcgggagcagattgggtaataaaatgtatattgagaataagacggccttttgaccttttagggtctagggctataaagcgtctcagggttgctgccaaacaagccatgaactggactgggtttttatatttgatgaaaaagagcctaaatgctatctgatttgggataaggaaaaggagcattaaccttgactatgcctttagctccagccacctttttaagaggaaattgctgggcaggttggggagagcttgtcactgaacgaaactgtaagccggactgggtgtgaggaggggagatgataaaaggattgtagggtggaggagtggaggctgaggaagaattggaacctagctcgacctggcaaggaggggagaggtcagatgggtctgtagaaaaggaagattagaaagactcagcgacacttggggttgggactaaggggacaggtgggagggaaagaaggaagatttgggacaagttgcattgggaacagagactagggagggaccgatgtgtaaaagagtgcctggatgtcaggcacctcagaccatttgcctattttatgacaagaattatttagatcttgtaggatggaaaaattgaaagtgccattttctggctatttggaaccactgtcaagtttgtactggggtcaagcggcattgcagaagaaaataaggcatttaggttttaggtcaggtgtgagttgaagaggttttaggtttttaagaacacaggctaagggagaagaagggggaatggagggtggaagcttgcccatagtgaaggaggcaagcccagagaaaagagcaagtagagacatggagagaaggggtcggggggttcttgccccctagaaaagcggtacttgccgctgagggtgaaggagaaggagttggggggttcttgccccccagaaaagcagagaaggggtagagacatggagagaaggggttagggggttcttgccctccagaaaagcggtacttgccactaagggtgaaggaccaaggcaggcgtccccgtgtggtcagatgcctctgaaatgtgggtgaataatcaggcaggcgtccccatgtgattaaacaccaagggaagactgtcttccccagtccgtgaccggtgccggagttttgggtccacagataaaacgtgtctccttcgtctctaccagaaaaggaaaggaactgaaattaagagaagggagagattgaagtgtggcaccaagattgaaaggagaaagaggttgagggatagtgagagaggttggagaagagagtaaaaagaggccgcttactggatttaaaattggtgagatgttccttgggctggttggtctgaggaccagaggtcgtaggtggatctttctcacagaccaaagagcaggaggacaggggattgatctcctaaggaagatcccctgattcgagtcacagcaccaaatttcacttgcgtccatgtgaagagaccaccaaacaggctttgtgtgagcaacaaggctgtttatttcacctgggtgcaggcaggctgagtccaaaaagagagtcagcaaagggagataggggtgaggccgttttataagatttgggtaggtaaaggaaaattacagtcaaaggggggttgttctctggcgggcaggagtgggggtcacagggtgctcagtaggggagcttttgagccaggatgagccaggagaaggaatttcacaagataatgtcatcagttaaggcaggaacaggccattttcacttcttttgtagtggaatgtcatgagttaaggcaggaaccggccatctggatgtgtacatgcaggtcacaggaaatgatggcttagcttgggctcagaggcctgacaaaaatgttgttaattgctctggttatagacagaatagtagcaggaataaataatcagaaacatttatggattatatctttgttgatattttaaacctatcagttacctttctagcctaatgagaatgccttgataaagccacattcttggaaattttggttttcataaatgtgcttgggttttataagtcctgctttgcctaccacttgaccaaattccctacagacttttttatataaacacctatggttaagacaaaatgtgttctttcaacaatgtacagcttctgagagtaatgtctaggctggagtatattcatatatattatttatgctttcatttaacaaacacatgctgagatcctactttttgccggacttagtactgattgctctctcctgagcatccttcttaagtcaaagagaatattcattgttagggaaggaaaaaaagatagagggaaaaaaaatagatggcaagaacatggcaggaacccagtcctgaacacccaggggttttcagaataagggagaggttaacaatctacatagagcaactgggattaaaaatgggaagctggcttcatggggggaggaatagcattaggagatatacctaatgtaaatgacaagttaatgggtgcagcacaccaacatagcacatgtatacatatgtaacaaacctgcacgttgtgcacatgtaccttagaacttaaagtataataaaaatatattaaaaaaaaaagaaatgggaagctggctgccaagactgcaggaagactgtgtcagattcagagcatgaccatcagcaaggtaaatccctactgcccacagtcataattggcaccagactctaggaaggaattatatatttacgtggtgcctaatggggatgtgaggatctcagagggagaaaactaggtaggcacaaataatacccgcacaggccttatttacacctattttatgcaaagttctaatagaaatcattaactggtttcctagcccttgcaagatccaacacaaattagtagaatgttctagaaggaatagaagtaaaaatatcaatcacagtaagaacaggcagctagatgcatattggcaagagggcagataaatagaaagatgtgagaagtcaaaaatcctattgcgatctcattttgcagggaaccaaagatcccaaatagctctctctggaggcaccagtgtatatattattaaagactcagcgagaaaagacaattcactttaagacagcaaataaacaaataaacaatgtggagctgccattcccaatccatttatctggaatagttcagcctcatttggcaatctgtattttttctgaagccccacggggtcattaaaaactccataggtcccaaatgtatttgcataatgatagatgccatccccctgcctgacagtaaagaagcagcaatttaaaaagtatgatgccagccaggcacagtggctctcgcctgtaatcccagcactttgggaggccgaggtgggcagatcacctgaggtcaggagtttgagaccatcctgaccaacatggtgaaactctgtctctacaaaaaatacagaattagccaggcgtggtggcacatgccagtaatcccagctactcgggagactgaggcaggagaattacttgaacccaggaggcagagtttgcaatgggctgagatcatgccattgcacttcagcctgggcaacaagaatgaaactccatctcaaaaaaaaaaaattcatggtattattcttttgaggaagcatactagaaatcaagaatcaggccaagtgctgaggctcatgcctgtaatcctaatgctttggaaggctgagatgggagggctacttgaggccaggagttcaagatcagcctgggcaggacagcaagactccagtctccaaaaaaatatttttaattaaaaaaggaccagtcttattaaagtaaactgcagtcctgttactgatcttagtatcaaagcaatgttagagcccacgtgggattcacacctcctagagttcacagcacaagtttgctgtaacagtagataaggtcttggttgccctgagctcatttcttttttttttttagacggagtcttgctctttcgcccaggctgaagtgcagtggtgcgatctcggctcactgcaagctccgcctcccgggttcatgccattgtcctgcctcagcctcctgagtagctggaactacaggcaccacgcccggctaattttttgtatttttagtagagacggggattcaccatggtctcaatctcctgacctcgtgatccgcctaactcggcctcccaaagtgctgggattacaggcgtgagcctccgtgcccggccctgccctgagctcatttctaaatccatcttcctccaaggtggtggcaagcatgcttctttatcccggagagatggccctttcatcaaagtctcattcagacccttctccttttggaatgcttttcttgggaggttggctgggatgcctactactcttgaggatctgcctctgatagagcctagatcttagaatcaggagagtttcttgcaggcccatcagttactgtgaaagatacctgagctagttggctcacaatccacatccatcaaaccgccccctgcagagaagtcacccggctgtcgcctgcttggcttgccctgcctctcgccattctcatttcattagcaatgcgaatgttcacacccttcaatgtgcatatgatgggtgttaatgagcataacacatctgtgaagcgtgtgtgatttttttgcctaataaataggcagtaaacaagaggaagggaagagctactatctgggggcatctgagaaaacaaaaagcaagcaaggtatgagtcagattgattgttcagtgaatcccaaagggccaaaaacttcctaaactggttttggtgtttctcactaggtgtttggacagcttggaacctggatagtcccacctacccaaaagcattcaaattaggcatgcttttaacaaagcaggtggcatggcatgtaaattgtaggaacactgttaacctttgcaaatgagtttcgtggtccgaatggataattacatatttccctccattaggagctacaaactcatcaagattctacaaccaaccggctcttgagtttcaatctccatgtgacaaggggatttattatgagagggcagagagaaaagaggaacaccgctctctttctctgcaatggaatgatggtcagaaaagaacagatcaaaggaataaacctgctctcctattaactcagcttaccaattctggcctacattttcaaagttatcagtaatcaaaacattgggaaaggaattacaacctcttctcctgaaagtttaacaacttccccatgaagcactgcttttgattgcattacaagctattcctgaagaatttatgacctaagatactctttgtcaatgtaggccatttgtccatgagtggagtgactgataaatcagctattaacatagataagaaagcatatcgattgagtcaactttgtgtttaataatatgctagacagtaatgatgcctggaaaatacactctgtaattaagtacttttccctttatatttcatgaagactcttgtatattttattctggcaaaatagattgtgactaacatctcatagaaaagatcatcatattgtgatcctatatctttatcataaaagtgaatttgagggaaatttttataatttttcaatataaaaattattaagatatcaaaactctttgttttttcactactccaaggtttatttcatcatcttaaaaaccttgtgaatacaatcagtctgctaggtcaggggtcaccaacctagggccatggacacctaccgtggcctgttaggaaccaggccacacagcaggaggtgaatggcagacacgcaattgaagcttcatatgtgtttacaactgctccccatggctcgcattaccacctgagctccaccttctgtcagctcggcagcaacactagattctcataggagcacaaacccgattgtgtactgtgcatgcgagggatctaggttgcacactccttatgagaatctaatgcttgatgatctgtcagtatctcccatcacccctgagatgggaccatctagttgcaggataacaagctcagggctccccttgattctgcattatagtaagttgtatagttatttcattatatattacaatgtaataataataatagaaataaagtgcataataaatgcaatgtgcttgaatcatcccaaaaccatcccctactcccctagtccacggaaaagctgtcttctgcaagactggtccctggtgccaaaaagattgcagaccactctgctaggtagaactgcattcttgtgattatgtattttaatgagcgcatttccttttcatatggagaagggaaccacattgccttaattccccaacttctgccccaaagctttctaggccaatatggctgcattcgagttgctgatggctgtgctaccctcccagggctgatgtacagtttcctgcctgggccgtgtcaccaatcactagggtttaggaggctatagtcagatcttgcagaatatgtcagtctcattctctgtagaattttttgtttgcctgtttttttcttctctttggcactggactatgggcagtggcagttagtggtagatccagggtggagagctgagacctaacaaagaatttttttttctttttttttttttttttttttttttgagatggggtctccataggtcacccaggttggagtgcagtggctcaatctccactcatggcaccctccgcctcctgggttcaagtgattctcatgcctcagccacccaagtagctgggattacaagcatgcaccaccatacccggctaatttttgtatttttagtagagatggggtttcatcatgttggccaggctggtctcaaactcctgacctcaggtgatccgcccgcctccgccttccaaagtgctgggattacaggcgtgagccaccacacccagccaacaaagaatttttaggttcccactattccaccccacctgtgctagaccctgtggtgacaacaaaggtgaaacagacatgctgactgtcattaaaacactgacaatctaaactaagaaagatgaaaaaaattaattgaatacccagtggaaagtaagaaggaatagttttaacctccttaaaatgcttttgattgcattataaactattcctgaagacttaatgatccaagatactacttgtcaatgtaggctattcgtcaatgagtggagagactggtaaattggcagttcatgtgatacatacgctttcagagtaaagagaggtttcttctaataatgagaggagcgcctggccagagagacccaggaaacatatgcaaatactagaaatagccccaagtagcaagtgtggctatagatggtacacgtgaaggagagtagtggggttagaccgtgaagccacgaagaaccaggttaaggaatttagacttttatttggtaggcagtggagagatgttgaatttttttttcaaacagtggagtacagtgaggaaggcaggagactttgcagaaggaaatcaggaattccaaccaatgtgttgagtgtaggattctaaatccagcacaaaaaaaccttcaaagcagcagggaaagggtttggctctgattcagcctcagtggttatactgttgccatcagggagctgggcttgggggtggacagaggctggtggcagagggagggatggagggacagagctgagtttttccaaagcagaagaagacggttttgcaacctagcacaccatctgggtcagatttatcaaacaagattatttgttgacagaccatggttatttcccatttaaaggaagcaatacatatattgtatccaaaatggctccccaaaagcagcgttgagctgatgcaaaagatcagtccattctcccagcaaaagagcagtctcttgacatcccaggtaggagggattcatgtatttcacaaaatgtgtccaatgcaatcatcaggcaaataatattttaatgttttcttgacatgctgagagtaaacttgcttcgatgcactgtctccttctaggcacattactctggagtaaaagaagagaggaaagagacagaggaaagaaaaaatatgtaatcacatatgaactgcaaaagaattctagctgaggttcttagaactataaattcttctttttttttttttttctgagacggattctcgctctgtcacccaggctagagtgtggagtgcaatggcgtgatctcagctcactgcaacctccacctcccaggttcaagagattctcatgcctcagcacccgtccccctcccccaccccaactagctgggattacaggcgcacaccactgcgtctggctaattttttgtatttttagtagaaatggaggtttcaccatgtcggccaggctgctctcgaactcctaacctcaggggatccgcccaccttggcctcccaaagtgctagtattataggcgtgagccaccgcacccagccaagaactgtaaattcttaaaatttgggaggaaccatcaagaaagaaagcctaagccttgtaaccatatgccaacctacattggtctactccctctgccacgctaggcatttcacactctcgtacactctgagggaaactcgagaaacaagtgtaataagaaatattcccgctagagcatggcagccataagctaccaaatttttgttataaaatagaaatatacttctagatgtaaacatgtatatgcttatatctaacctctctaggataacttttgtaagtggattttaatataactaaaactggatgctaaagaaatagccctctcttaaagttgtacttgggcacgtctaggatcaaaaagttaatagttttgtctgtgatcaaggagttaattttttgctgcaatatgtttacatctaacattcttttgagctatccacaatctggttatatatcagtttatccaaccttatttctcctttcctacttcaaagacctccattcaagccgttctccaagctcttgcctaaataagtagttttgttttgttttgttttgttgttttttggggttttttttttttttcaaattttttcctcacttctaagtttcattcagggactacctttccccacttcccctcatcattctctttttctaaaatctatccatccttcaaagcccaggttgaaatttgtcctcttcctgaaatcgccccaaaaatgtgccaaatcattcagatctctgccatctctgagtcttataaatcaaattcttagtggcattcatttgactaagaataataaatacatcactattgttataatcaccataatacctggtgctgttgttagatgctttacctatgttacctcttatccagacaatcctgtcctatcacccccattttacgtgagaagaaaccgaggttcataaaggttaaataactagtccaagttcacatagctagcaagtgacagtcataatagtggttcagacccagaaccgactggcttaaaaatccatggtccttcttctgtgccatatggcttcccaattatggatttcttttttttttttttttttttttttttttcagattgtgatttaggtttattcttttttttttatacttaaagttttaggatttcttacattactttttaacaaacgtattttgtgcatgattctaagaggtagtacactttttttttttaattgtttgcctcattttcccaccatgcctacttttcactttgctgaacccgtatagagtgtctggttaatgttagagaaattgaattgaattcctgacatttgggcccttttcttgagttcctcttctttgtccatagatgaatcatcccattacatctaactccgttggacagcttgcttcttcctcaattgtatgtgaatagttttcaatccactttactaaaatctaatagtcaccatctgtgtctgctatataaatgtgaactcttgaaaacactaacatttgtgggtcagaaattagaggacagtaaaataaaccactggaactgtgaagagggaggaggcgtgaagaggcactcccctctctgctgtctgtgggtcaacctttccggcctgcctgtttctcaaactgagtgagacttgtctctgaagccccattttttttttttttttttttttgagacggagtttcactcttgcccaggctggagtgcagtggtacaatctcggctcactgcaacctccacctcctgggttcaagtgattctcctgcctcagcctcccgagtagctgggattataggtgcacaccaccacactccactaattttttgtatttttagtaaagacggggttttgccatgttggccaggctggtctcgaactcctgacctcaggtgatccacccacttcggccccccaaagtgctaggattacagacatgagccaccacacctggcctctgaaaccccatttaattttccaaatgaaggtgatgtgtcccaggcatcatacataggcaagaacccacaaagtggcagaggagcaggagcaaaggggcctgggcaccccctggaaagtcatcatacagctttactcaactgtcaccttctcctggccttccttgaccactgtttttaattgcaaatcccactgcatgatgccctatccctcttccctgacttattcttctccataactcacattttcaaagcattctatgcatttcaccaaattgtttgtggcccttctcctcccaccagaatgtaatttcaagagagtagggatctgaggtcgggcgcagcggctcatgcctgtaatctcaacactttaggaggccaaggcggttgggtcatttgaggtcaggagttcgagaccagcctggccaacatggcaaaaccccatctctattaaaaatacaaaaattagctgggcatggtggcgggtgcctgtaatcccagctacccaggaggctgaggcaggagaatcacttgaacctgggatgtggttgcaatgagccaagatcgtgccactgcactccagcttgggtgacagagtaagactccatctcaaaaaaaaaaaaagagtagggatttgggtctgttttgtactatgctagatacccagcacccataacagtgtcagacacataggacatgtattgaatgaatgaactgatttataagcagaatatttaagactgttgagaagccatacccattctaatcaggcagagcagaaggttaaaaatccacaacgcttacttttgagttgtgttgaaaccattgaaaatatctgtgtcaaactgattaattacctcggtttacagaatcagctttttaacatacatagcaaattctatatgctagccaatggcaagccagatctcaagcaaggccattcttgtaaaataaatggacagatttttgtcttttctattgtataagattctaaagccttgaaagcagtaatatagaatctccttaaatacaaatttaagcatcttttcacgtttatggcctcagtgcctgtttataaaagtagttttgtaagaaaaacagtgtaagaaaaacatctaagagtagatgataaagacctatccttgtgtgaccttcagatggaaaagcatagatttaatctgagattccagaacccacctagtttttaacttcatttgtttgtctaacttaagaacgtgagtcacaactaacaaagaccatctggtgctgttcttccctcctaggagaatgtctccagaagtaaataaaggagaatcttgtccatgcaagctactctcagttccaatagaaaaccatttcagcatctaattcagagagttgcacaggagatggccaaaggcactatctgccatatgtctgcgtctccagcccagccatgaccccaaaccaatagatttatttttaggtagtatcatgtaaacatagaactttttaaactagcaagttggggaaacttcatgattagtcaatctgctagcacatagcagaagctggtgggtgccttcccagcagccagctcctctttctcctacctcatagcaccccagttattttcaggcatctaccctcctccacacagccaagaacttcagggaggctatttccttccccaggcccaaggagcacagcgtggaaggggaaagagagaggttcatggacggctctaccatgatgccatgtgtctgctagtaaacttctactgactgactgagcatgccccaggtgaaataccctccagtacctccttctgtttttggacttacctgttgtctttctccaacctggagactctcaacccttactgcaaattactgccacgtggggagcttttaaaaacctgcagacacccaagtgcacccaagagagcctgtttcaatggacctatgcaaacaggtttttttttttcattaagttctctgggtgattgtaatgtacagccaacaatgagaaatgttatactaattccattactttgaccctgtctttgagatgctttgggagagcttggcgctcaggaccatctttggggatcttttccatcatccagagggaagctggatcttagagtctggcctctcggttatgggtcctgatgttttttcattgtgtatggtttccatgatctgtcctctgcaataaaacagacattgctttctatatgtaattctactcatccttttggggtctctcttcgttaccatctgcccttccatcttgccatctcactcctcactcccatgattctggaccaaactaaccagcattcctaatctagtctcttcttgaaaggatttgaaacggggaagcagctcttcaggaaagaaaataaatagagcaaatgggccgggcatggtggctcacgcctgtaatcccagcactttcggaggccaaggcgggcggatcatgaggtcaggagatcgagaccatcttggccaacacggtgaaaccccgtctctactaaaaatacaaaaattagccgggcatggtggtgggcacctgtagtcccagctactcgggaggctgaggcaggagaatggcgtgaatcagggagatggagcttgcagtgagccgagatcgtgccactgctctccagcctgagcgacagagcgagaccccgtctcaaaaaaaaaaaaaaaatagagcaaatggaatgaagaacctctgtagggctgtgttgatttaaggcagatgtgggccacagttttggtgttcacacccaggtaaacaaggcagcttccttctgctcatacacgtgctcccctctggaagagccaggtttgcaacgggctcgcagtggctttctcatcctggcagcatccagtttcttgtggacgttgctgcatcccaaccacctagcagattacacgaaggagtgaaatacctaccactgaaaagaatgaacccacagagaagggtggcctcactgctcccaggggctgctgcagtggcccgtgggcagctagactggcctgcaggggactgaccctggtggacgcctgagtctatgtgccaccatctaccctgtgataagtgtagctccgacatgatgtacctttgcctgttgatttccaaggacaattattttagcatttcaaaattcagctcaagtgctggacgacttctccctgagttttgctgtttgccagcagcctcctcttggcatgctccctttccaacatcctcactgaacttgttactattaccaccatgtacttagagaatgcaactatcaagtgctattgaacacaccttgttttgtaaaaaccctgttgtaaattgcctccttattcctctgttccatggccagtcaaatcacaccctcatgtaaatagtgacaaagacatattacccaacttcaaattccagacacctgagtcacaggtgttgttaccactaccccaaaccacaaagtgggattatgtgtctcctagaaccgtattataatagacactcactgtcttgcaaattgctcctaacttgggtagaatattttgtatttattacttttgaaaatctatgggtttctattgcctggaaactcaaggattacagcagaattagagaatctggtctctggatcacagatccccccactgccctgcaccgcccccacccctttctcatggagacctaatcatctccacactggatccactcacatggatcttctgaccttgatccagagtttacaggtaaaatgtccacctgaggacactggtttctgttttgacaaaggtagttagggccttggaaagttgtgaaggaatggcatatctcccagaaccctgacttccatcagcatcttattccaggagctctgaggaaacctctaaggcacaagtgtggaaataaagaccacccagatgagaacacgcagaggctatttattcagagcttgctgtagcaagagagtcagccatcgtcacttgtgcctggcagagactctgaggcaagcggggagtgggaaagctttcaggtggagagaggggaaggctggggtgtgccggggctggagcttgttggcccgggaaagctggaggagggctgcctgacacaggaggcatcctgtgtgattggtgaggggattatatttggctccctctggttggcctaaagttggcagcagggacaaaattagggaatctggtatcaattgatcatttggggccagcttcctggaatgtctgctgcagattgtgggtcagcgtgctgttgtcgcatatggccaagctgttgtctgtctgtagattccatctcttggtgttcaataggccttggggccatgaacttgtagggagggttttctcaagacctgggttatggaaccagcattgaggttcacagaactcacatccaccctcaaatcagggctgggtcacagacagtttattcaagtgctccaggcacctgtcccagggtcattctccctagaaagacccaaacaagctgggcgcggtggctcacacctgtaatcccagcactgtgggaggccgaggcgggtggatcacaagttcaggagtttgagaccagcctgaccaacatggtgaaatggtgaaaccccatctctactaaaaatacaaaaattagccgggcatggtggcgcacacctgtaatcccagctactcaggaggttgaggcaggagaattgcttgaatctgggaggcggagcttgcagtgagccgagattgtgccactgtactccagcctaagcgacagagcaagactctgtctggaaaaaaaaaaaaaaaaaaaaaaaaggcccaaaccatcccagggaattcagttcaagccacttctccctcactgtgttctccatgctgctgcctggggctgctggccccctccctgtctgcaacggactctgacccctggaccaggacacccagcaggctccccaggaccacagattctgtctgaccttggggattctctggtgtttctgaaaattgctgaaagcttccagtggccattgctatgttatttgctagtcggctaaaaagttaaactccatttttatatggtctagattagaagagaggaagaaacactccagaggcatcagaggctcaagaaaatgcctagaatgaagttcagaccatcaagaagtccccggtggctcaggcacattcactgtttgttcattcctctgacagtcacggacagccccctgtggacaaggcatggtggcgggctggggacagtcttctactaggaggatggggaagacctgagaacagtgcaggaacagaaggaacaaatgtgcgggctgtgggtcacagtataataggaacacaggacagaggctgaagatggccccaggatttgagttacgaggccagtgctgtgctattagcaaccaaggggacctggaaaggattggaaggggaaggtcttgaggagaggctcctggtaggttttttctgatcaatagtcccaagggtcaaaaatatcaacagtgacagtcagtgctgggatcattctccctcacagatctgaacccttgagtatgttgattttaatgacagggacgttctttatccagccttatgcctgaccaactctgattcatccttcaagtgaggagatatctcttcaccctcgaagctttccctgatgcacaccccccgggccagggcctgccccagagctccccactgccaccatcacttccccagtgcaggcccttacccccgtctggcctgttgggcttattgactgaggcccccaccctccccagccagcagcatgcctgccccacaaagctatccagcaaatacagattgagacacaaatggatgaaagacatggaaggaatgtatggatggaatggagggatggagtggacacatggaatggatggatagatggagtggatggatggagtggatgggtagaatggatggatggagtggatggatggagtggacggatggagtggacagatggaatgggtggatggagtggatggatggaatggatggatggaatggatggatggaatggatcgatggagtggacggatggatgtaatggatcaatggagtggatggatggagcagacagatggagcagatggatagagtgaacagatggaatggatggatggagtggacagatggaatggatggatagatggagtggacggatagagtggagggatggagtggacagatggatggagtggacggatggagcagacgggtggagcagagggatggagtggatggatgaagtggacggatggagtggatggatggatggagtggatggatggagtggatggatggaatggatagatggagtgcacggatggatagagtggatggatggagtggatggatggagtggacggatgaagtggacggatggaatggacacatggagtggacggacggagtggacggatggaatggatggatggatggatggagtagatggagtggatggagtggacggatggagtgggtgaagtggatggagggaatggatggatggatggatggatggagtggacggatggaatggacagatggagttgatggatggaatggatggatggatggatggagtggagtggacagatggaatggacggatagaatggatggatggaatggatggacggatggagtggctggatggaatggatggatggaatggacggatggagtggatggatggaatggacggatggaattggatggagtggatggatagagtggatggatagagtagatggatggaatgaacgcatggaatgaatggatggaatggacagatggatggagtggatggatggaatggacggatgggatggatggagtggatggatggatagatggagtggacggatggaatggacagatggagtcaatggatgggatgggtggatggatggatggagtggacagatggaatggacggatggaatggatggatggaatggatggacggatggagtggatggatggaatggatggatggagtggatggatggaacagatggatggaatggatggatggatggagtggacggatggagtggatggatggagtggatggatggagtggacgcatggaatggacggatggaatggacggatggaatggatggatggagtggagggatggagtggatggagtggacggatggagtggatggatggaatggatggatgggatggatggagtggacgtatggaatggatggatggatggatggatagatggagtggacggatggaatggacagatggagttgatggatggatggatggatggaatggatggacggatggagtggatggatggaatggacggatggagtggatggatggaatggatggatggaatggatggatggaatggacggatggagtcgatggatggagtggatggatggaatggacggatggagtggatggatggagtggatggatggaatggacggatggagtggatggatggagtggacggatggattggatggatggagtggatggatggaacggacggatggattggatggatggaatggacagatggagtggatggatagaatggcctcctctttgtctaaaacccccagtagctacgaattcccccaacaactactacacactgccctgcacatgatcacgttcggtaagttgtgtgagagggcaggagggagaaaatggagctgcctgcctgcctcacgagcacctttcaccattttgatcacatttccagatgcagcaccaccctctgctctcacttctttcctcccagaccagggaagcattggatggtggttcatgaggtgctggaggagctaaagaaattgctgtcatcgttttgtcaaatccagggcctttatgttttaaaatagatatacaaagagatcacattttacctggtaaaatcatgacaaactgagcggacaaaaaaaaaaaaaaaacctataaacatttggcacaacagagcaaaaatcataattcctataattatttttaaactgtgaaactattgtagagcattgaatagatgtatattaaagccatgtatgctttatttgcttatgacatgaaattctggtttctgtgtgttccaccttcctattttattcttaggataataggatatgatgtgatgctttactcatagttagagggagaattgactgtgaatgagcagttcagagagaaaggatcttgggcttggcaagggcaggggcctccagcgttttgagaaaaatgaattgagcctcagcttattttataaaaatcttgacccagagcgtggcccttctgaactcccaccatgtttatgcatggtaatatattaaaaattggacttagctagtagccaaatacagtgctgtgttctggatactaaaacaaactaattctccctgctaagtaagaaaaatttcacacattatcgtcagtcagacatggaaagaggttctccaggggaagagagagaagcaacatcattcatgtgatttaaaattacaccaggccatccatttatctgcctctcaggctgtttgtccttttttgaacgatgcttcagggctccacgctggaaacggggagggtggatgtagaacagcttgtcaatgtaatcattttactataaatctgcaaaaaaagaaacagagcctaaaccaagtataaaataggatcacagaacctcctatgagcaactttgtaagattatcctttctagtgtgagtactaccacaataaacatgatgacatatcctttatcactatgttgcccaaagattttttttcagatttcagtggactcctcccctgccactcttaacagccctgctcctccaaacatagctgtatggagagagatgtccatcacagggatgtttatacaaaaacatcaaaacactcattttttcaggctggaaacggtggctcacccccgtaatcccaacactttgggaggacaaggtaggtggatcacctgaggtcaggagttcgagaccagcctggccgacatggcaaaaccccgtctctactaaaaatacaaaaattagccaggcatggtggcacacgcctgtaatcccagctactcgggaggctgaggtgggagaatcacttgaacctgggaggcagaggttgcggtgagccgagattgcgcgactgtgctccatcctgggtgacagatcagattccatctcaggaaaggaaaaaaaaaacactcattttttaggtgaagttaattgactgggaggactttatggaacattttggttcttttcctactgctgaaatttgaatagaaaggcatgaggtaacctcatgccatcactacgaaaggctaccagaaatgatagaaaacctcacacagtatcagctacattggtggagtccacctgaatcccagaaattcagttcaacaatgtcactgagttcaccagactactgggaaagggattcatgtagagacagttgtaaaaatattgaccctaacagagaaagattcactgcagtcagaagagatgccacgaagtcaggtctcaactcctggagaggctctttctgtgctgtgcaaaaatgtatgtttatccgacttcccaggccttgaggtacagcaaggaatgccagtgttggatgttctacaagtgaggacactggagcctcaagaaataatctgacttgcacaactcctgtcactgattagtggctaaggacatcctgatttctgctccagaactttccccatgacatcagtcttcccatccttgaagagttttcagttattcttagcgtgacaagtgattgctagagtttgtgtaattttcatcataatgggactaatgacccacaacagcagttctagtgacttccagaagatgttgtacatccccatcctaatgaatggcagcagcatgacttacgttcttttatcagagagtctagtttgatctgagttgtgtctgacctggaattcaggcatgtctggggctaggaaggttttgggttcgaggaggctgttttcatgagggatcccagggtctcttgggaaggaattcactcaagggaggacagaggcaagagaagcacagttcactctcggggctgaaggcagcatgggttttaggtgcagcctggtgacagtcaatcgggtggcctaccatgtagtgattaagactttggaaaagcaggctataagcaaaaatctaaatttgctacacaataacttggcaagacaatggagcagtggctggcaccatggaccttggtaagaaacactagaaaagttaggaaaaggggtttttccaggtcagagagagccagtgcatgctggtggacccacagttctgtagctatgagaaatagccccatctggttgtgcaggaaccacaggctgcactagctgctttagttgtgaccgcagaaagcaccctgccccagcatggagcaccagggcctgcacacctttgccaggccccagaagcactgccactgccatgatacccaagaagagagagattagcaagtgctttgtaccagaggggagggctgcccatgcaaaggcctgcctgggggaactccagcaatcattgggggagactttgggagagtggagagaaggggcctcctgaaaagacacagccaggggaaacctactttcatgatatcaagactctaattttagagggcagtgtttgcagatcctaccaatgactctttgtccttgagtctgtgtttgaggtggaaccactcaaagacggggaagatgaggcacctggagccaggcgcctggtctttgtgtctgcacttagccaaattccctctcagctgtattgtgtctggaggaaatagaagcatgactaagctgatttgtattctgccaaccaagggaaaatataattaacacggcagcaagactcagcaaaccccatgggaaagtccaagaaggaaagagctcccgtggctcaagatgatgtcagaggcaaagagaggccaacccactctaatcccacagcaggtctcctctctaatacctcaactcataaagggaaaagacaatgaaatccaggcctgccatgcctttgaaaagaacacacagcctctaggagtgattgcagggattgagcagactgtgatgggggttttctcatgatgggagtctcctgctgttgctgagtgctgccaatcactgcccacacctccagcagggaggtgacttcctcaggctctgctactccacatcaactgattaacgcagctgtgatagcacacctagcagagacaagagactcccagacactaggcaggagtgagaccaactgctgtatcagatatacacctagcttataattacgtgtcaagagaaggaagattaggcagacatcagtaaccgcaagaactgaaatgtgatggctggtatccatcttcagcctgctccccagctaatcatcccctaaaagaaatgcgggagaaagctgcctcctaatacatttcattggcccttcatctccgtctgctgactcacatttgaatttagagacaatttgctaaactttctagatttttatttacttaacattgccttagcctttttgatatattcaactatagtattctccaggtttaaatattgtacgttttttttcacaactttaacaaattagtgctcagttctcctggcttgaaattcccatatctttcatgaagctgttgaaactaaaaggcttaggaggaaggtcacccacctccctcattctccttcccttcttgcccagaggaatttatgtctgtcttcctgccccaatatctacatatccagccatgactacattgtttggtttaagtaactgcctctcattacagaactagattcatttattcattcattctacaaaaacttgaagaacatttatgctggatttgaatccagtgtcagaattgtctttgattggttctatcttatttcatagatttggggtttgaatttaatagctaagcatataaatataattttatgcaagatagcaccttaattctagtccttatttaatacaaatagtgatataatgaaatgatatagttttatctagtttcatctagagaaatatggaaggaaaaatacaaatagttaaaaaaaggaggaaggctgaaaatatatagcagttgatatgcttctcagagtcatcttttactaatcagtagcagtggtgatggtcttttaaaaaaaaaaagtttcggttgcttttaaaaagagatttccagtgggaagcctgtgagtactgactggctcctgtctaacctacacttcctgtttggttgatgaaaaagaaaaaaaaaaaagccaaaactaaaaggtacattccagaacaagtagtcattttaacaactggcggagccaagaaaatgcgatctagtttccctctgtcccccagtctagagccattattaaataatttaatgccatagaacttatatcaaaaatagacacattccttaggaaacatttgaaacttactggttttgaccttaaaatgtaatcattcatgaagagatcaatctttcatatgttttcaaatatgaaacactcaagtccattgtcagaatcccaatagtgtggaaagaaacctaccagggcaggcttatctctgctcattctttgctaaaatatccattgcatttgctaactgtgaaacgatgggtaggttacttcacttctctgagcattgaagatgccctgtctacaaaggataacagtctctctcccaggggtagctgtaattgtgaaattaggcaacatatataggaaggtgcctaatggagtggcaatcatttattcattcattcccgaaatatttatcgattggccacaatgcccaggcacagagcaaggtgctagtgatatcaacacgggggacacttcacatttccccccattcctccctaacggtgcagcagacaccccactaaagctgaggaggcccctgctgctccccctccctctctgctccctgagtctgtgagaggcatcgctccagcctcccaagaaagccctccccctgcacatccaagcagctccctcttatcctgatgccctgacccgcctgcccacaaggagcctcctccctgagccgggaggactttccttctctcctatgacaagccctggccctaggcagctgaaaacaatcacccaggaagctccttcaccgtcagattccctgacagccctggatctagcgagaatcaggtgatttcgatgtgaaacgaggtttgggaaccactgctttcagtcacattctttttgtttgatcttctcagaatcagcaggcatttccctctgctactttgtccaagatccaacccttctcatctgcgtcttgccagtctctccactttagagctttgttaccagctacttctaacctcttgcacagaaatctctactcaccactgtggagagtgaaaaaggaatgggtttttatgtatttctagccagctcttggccctgcgccatgcagagtatatgctgtacattggactttcgggacacttctctgttaaattctaagccttatgtctgtggtgtctccacagtgagtaagctcttaatcacattccctattgtaccttcttagatgaaagagcaatgggtcagggggactttttaaatgtccttaaacttgattagtttaatctttattatggctacagaatgtttcttaaatttacatacgataaaatccactattttatattaagtagagttatgagttttgacaaacaaatatattcaggtagccaccaccataatcaacacacaaagcaatccattacccccagatttcccttacatcctttgttgtccccctcatcctgtacttccagcccctgagagccacttatctgatttctgtcccgacagtttgccttttccacaatgtcatgttatataaatggagacatacaatatgctgatgtgagcatttagaaagatcatgtatttaaacaattattagagtaagggctggctatggtgacttaattttttggtttctgacacctataatctgatttgaagtgtgtcattctgtgcatcatgatcctttttgcagaacctgtgtctattagaaaatccagatgaagcaggctcttcctgttgtccttcatttggaaaagacagaagaacagagcgctttacgaaagtcaagttacagcttcctaattttctctcccatggacaaactcttccctccccccaccccgacctagcctcttacccactatcctttgcaaattcctatctcttatattgcccagtaattggggcgtgggggggtgaggggggggtgagttactgctgatgaaccaggaggcagagcaaggtttattttgctaaaggcttcagctgctactgcctggacctcaataagcattttctgctctttcctatcactactgtcttccctttctttgagaagcaacataaagataaaaagaaaaatacttgattttgtagcatgccagaatattaagatgctcctgaaaagtgtgggatttaaggcttctcaaaaaagagcagaggagggagtgagagaagaagacggagaaggaggagaaggggaagagaaaggggaggtggaagaagaaaaaaccaccatcagaaactgagtattacacaggacgtaacctgtgctctgagagtgaaggaggccacacagcagtagaaccccgacaggaaaatcagaaaacattatattttttcccagatcccagagtatcagatgttccattcagaaataatccctattgacccagtctctgtgtctctctctctgccaatagcatcaagcacagtaaccctttccatgctaatcccgttattaatgccatccacaacaagcgtagtgtaagtaagacacgaagtgtaaaaaaactttcttccccgcagtccgggctctcagagccctccttgtaggtcaacagtatcaaaggtgcttaacgcagatacaccaggaggctcaaagcccaaacatcgaaaaaaaaaaaaagacccactcttgtgctgtgtgtattgcccacgggtgggaggatgcaagtacaattacgttttttaaaactccagtccagatattggcttttccttggatacttttgtgtggctctcccagtacagtcagatccgccgccgcagcctagcgctccaccccgggttttgcgtcctcccctcacctgcctttcagtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagaggcaagtattgcgcgcgggctggctcccacatggagctgcctcccggtgcaagtgttgcaagggtgcgctgctccagcccggggagcgcgggaggcggcggagagagcgtccgggtgatgagcggggcactgtaactggattttaacacctctgcaagcagcgcttttggtcaaaaaatttccgattcttgatcttctctctgcaaggtcgggggttctttggggagtaaatcacagcgtttgggtttgcattcgaagcactaccaagtctactccacagggtcactgcacggggagcaagtaaaggaaaacgaggagaatctgagagtgctccttcgtgcagtgtgtgtgtgtgtgtgtgtgtgtgtgtgtgtgtgtaggcaaagctgagatttacatggtgtgaactgttaaatgttaacagttaaatcccacacttttcaggagcatcttaatattctggcatgctataaaatttttgagacttgtttaaagaaggggacttcctttttaatttagaacaaattagtagttgttataacattatagatactaatcagtaacaatactagtaggtaatgctttctgtaagtagacacaccccaaaagtatctgaaaagtatcaccaaaacggagcgtgctttcacactcctgcaaaacaaattagcccttaaacagaataattaacatcccgagggaagataaagcatataggttccttgaatcattacgttacatttaaagtcggtcctgttcagtttgcctttgtccctaaggagtaaaaatagcatcaaattgcttgtttggttttccccttttgaaactcagcatagtgtttggttatccatgaaggtggctttaatatttcaccctcatatttggcagacagttctggacttgctcctctccccgtagggactgagtcccactggcagtgtgtggagaatagaattgattctcgctttttctttgcataatacctaatcatcaccattagcacttcagacgttcacagctttctgaataggtgtcatttcttccacataccctattgatttgcatcattaacaattgaaaggaagctcttcttttgattaagaagccaaacaattaggaaagcgtggattctttcatagtatttattgagaggcgtctccacctgatctaggctgtgtttaatgggatgagagagactaagagagaacagaaagtgtaattaccgcctctccaggcccgtctttactttttccagaaacagagaattatgaaattatttgtaatgttacaaggacccttggagctcttctagtgcaagtcaagtttatttcacaaacgggaggtctagacagcctttgtttcttctgaacgggtctgcaaggccaagatctggattctgacccacagcgactgctgatccaggaattccatgcacatatgctatgcacttagcgctgattgtgaagaaacaccaaggtggcccgtcaagacctgaactaccacaggtctaacttgggaaagcctcattcctcacgttctttccgcttctactgtaatggtactgtgcctcttgccagcccacacttattcatttgaaatgtgcactttggaagttcactgcatttaatcgattcagaggatttcttttttttttaattttttttttaatcagtagctgagctatactacctagttctaatccgtaatagtgtgttaaaagactgttttctgtgtagttgctggctgttatttaaatcccaaggctgctgaaagttggtaatagaaccaataatagcaaccattactcaaaagtctattgcttactattaactataataattaactattaagtattgatattgtccccatcaatttttaggcgttacctaacattatccccattttacagatcagaaaacggaggcttcagaaaggtgaagttactagcccaatgtcactcaccttctaaggtggggagcagaagccaggttggtctgacccctaagctcatggtctttctatactaccttagtagtatagaaatgttctaactttcacattcccggatgtctgagctcaagacaaattttaaataaattagcgtggctttgatgttctctcactagtgaaagggtctataacactttaggcaaaatgcattgaaattatgttaaaccttcatacactgccaataagcaatgacttcccagaaaccatactccacatttgacccagtctctaatttagtgagaaggtgagatgcatggaaagaaggcaaaggagagtgactagtgacccccagaaaagggaatctcttcccgaggtttgtgttgtgccctgtggagctgagaggagagtagggaattgatggagcagaggcttagccaacgcatctgaaagagaagagtgttttatgtctttaatttcttcttgtcagaatcaaccaagcccagagctatttacgtgttgagaagggtctcccatggagaggccttcccagtggcccttctactctctgctgcggtggtttatcatgtcttcaaaacagactcgccaccaggcttccaacaggataatacaaatgtgaaatttttgtcctcaataaagagtcagaaatgatgaccattctgccactttcatcattttaaaatctgtattcctgaaaactggcctcgaatttatttctgtatagtccaaggtattgatttgaaagtgagaggctagcatgaaagccaacacttctcaactttaaaaaaaaatgccttaatatttagtattttctcattctaatgtatcctgtaagtgttctttctgtacttcttgttaaggcatggctgtgtaaacttcagagggttttgggaacagcctccattgtcatccacttttcattctaaaatcttggtatatctgtgcatacatgcacaaggcctcccatgattgcactgcttttacgaataatcatagtcaaaattcattttttaatactgctagctcaatttttatttcttattcctttgaaattgatcatcatttggacagggactgcattaaagctcaacactgaccttcattgtggccacaggaagaaaagatctgctaaatgaacaaatactgtgatcgatattgtgcaatggcttgagggaaaaaggaggttttaaccacttaaagtaagcccttttagaaacaaaaactatttcagtgaaaatgctaatcctacacctctccaaagtaaatgtgcttagaggacaccagccagagtttctttacaatgggaagttgccttccaacaagaaagggttttcaaagtgcagaagaaaactttatctggaaaaggtgagaagcagagagcctccaggctccagccccacacactctcatcttcaattaatactccacaaagggaaagttccattgtgggccacagcactccctgcttgagaacctgtagggacttaaccgctgggtttatccaatgaagtgtctgaggtccccgctgtttagcttggccctccactctctgttcccaatttcgtaaccactacctcagccagtctccccagcagagcacttttatcttatagccatgaggcatctgtgacatgtcccacaacacatcacaaactctatttgtcctccaatgctcagtgaccttattttcccaggcaaaagtggctcccgtcccggtgcccactaagccttgataccagcccacagtacagtgcttctcagactaggtcgtctcagcatttgtcaatgtattttatttatgtttcgacgtccagtctgttcatcttcagtacaggactgggtcatactcatctttccatcctttcccttgtccaccttcctttcttcgatttgaatattttctgtagttgctccattaatcagtaattaattaattgcagaaatgtatttcccaagatgtagataagtcacacctcagaatgctacaaacatttgtagatgtgactgatcagtaattgtcaggagactttgtcaatctggagaggtgctgaaaaacagagacaagaaaatgtcaactttcaaaaatactcatttaaaaaagtagtttccaagaaaagcgtagactggcaaaaggatgattgacaaaattctggactagattactaaataggtgatatgtgagaatttagaggagaatcgtgtgatttgcataatccaacatgagttccccggaatcaagccatcccatgtgaaccatatatctcttttatatataggttctgaaactggtgaaatggggaccacttgaggttagagattcgtaattcagtgttgcctctgatcagcctggaattgtagtttatatgccagcaactgcatgtagcctgagggctcccatgactgggctacagccaattgatcacaatctaatgatacccctaggagtgccttgggtgagagcgttgtccggggcaaaccttatgaaactttgtcagatggtcttcacacagcatttcttgattttagcagagcctttgactcagtctctcctagcagattttttcacttactccacagatatttatttaggtgtttattcagtgtcaagcattgtattaggtgttcagtgtttgtggctcagaagcaaattctgacttagttgataatatggagagcaaaaccgagtcaaaaattgattgcctgaaattatctttggaactgcaggaagtcaatcgattgatgaattcatgtgtgtccgggtctctggggtacactgtgtgctcccccattcactccagtccctgctcagagtccttctccaatcacctcctctataaaagcaccttgccccatcatttcctattccctcatgctgttttatttttcatctttgcacattttattctctgcaatgatcttattcacacaagcagtcctgtagttgcctgctctctgcccccttgcttggaatgtggtatgaatctagggaggcatttcacagggctgggtcttttgttccttgccgtccattcaatatgtctatcagtgacaattgttgtcattcctgctaatctaatttgcagatgatagaaagtgaggaggcagagctggcatggtaaataaggggatcaaaatgtacatcagcagcatatgtgaaagcactttgataattgaagaattataattaaatgcaagttatcattttttaagtgcgtataaatctaagccaaaaccaataaaatgaaagtatcaaggttaaatataagctcatgcatttaggttcaaaaaatcaattacacaaattcaaaataaaggagacctaagagggcagcacagtccatgccgcgatttagccatgagctgggcgactctagggctgcaacacagtccccgagtggtggagccatggctggaaattcttcgaatgttatcagttaggagggccacatggtgaggtggacattaccaagcccgagtgtggccagtggagggtcactcagaacagcagcaggaattgggacgtttagcctgaaggagaggggacttagggaggtggggacccatctttaactctctgcggggttcacatggaggagacgggcatgtgtgtgctgagtgctaagttagaacctctgggtcctggggggcagactttcattcaaggtacggagaatgatgggagcccagggccagaagcctataacccacagcatctggacgaatactgagcgctgtcactagattctatttttatttgtttgtttgtttgtttgtttattttttgagacagagccttgctctgtcacccaggctggagtacagtgacgcaatctcagctcactgcaacctctgcctcccaggttcaagcaattctcctgcctcagcctcctgagtagctgggactacaggcacccgccaccatgcccgactcattttttgtatttttactattttactctactattttagaagagatggggtttcgctatgttggccaggctggtctcgaacccctgacctcgtgattcgcccatctcggcctcccaaagtgctgggattacaggcgtgagccaccgtgcccggccgtcactagatatttaaagagaaactggacaactgtggggcagaggccagctcttaagagggatcctggctttgggttggatcttcaattgtctttgttctttgtctttccaagtctaacattcttatctgttctaaacttccgtatttttatttgttctgactgatttttttttcttggtgtgacatttgatgtaaatagtacttagcaggcttagcaactcctatatgaaagtgctttgaaatttgctgggctttggaatctctgttgtttttgcccattaagtaattccctcccatccctcttcaatgttcccctttccctatcaaccagccctttctgcaggttggagtttgatagacttggcacttggcacaccccctgagcgccagtgtcaccctctgcgttgtgaatttatagatggagaccccttcatccttttacagtcgtgctctgatcctggggtccctgaggtccagagcagaacctgaactctgagtatcaggcaagcgcatcttacttcaaaaaatgggaagaacaatttaaaaatgcaacttggatatgtttttataagatattcccgctttctgttttctacacttatttagcattttaacattttcagaatacgtgaaaattagatttagtttcttttttaaatgtgaaatataagaaaattatgattacccgtaacacatttgtgattaaaagtacattttttaggaaaaaagtattgtttccagggaacaattttctattaagttggtgcagtaatgattgcgatttttgccattgaaagtaatgcttaggccgggtgcggtggctcatgcctttaatcccagcactttgggaggccaaggcaggcggatcacctgaggtcaggagttcgagaccagcccggccaacatggtgaaaccccatctctactaaaaatacaaaaattagccaggtgtggtggcaggcacctataatcccagctacctgggaggctgaggcaggagaattgcttgaacctgggaggcggaggttgcagttagccaagaccgagccattgcactccagcctgggcaacaagagtgaaactccatctttaaaaaaaaaaaaaaaaaaaaaaaaattaatggttaaaaccacaattacttttgcaccaacctaatacttagaaagatgcaataatactagatggttacctttaacttacaggtttcgggtttcacagaaacaacagcaaacccaatagtgcttcactcagtttccctcccaaagacagcaaagagagaaaattaactacctggccaggcgcagtggctcacgcctgtaatcccagcactttgggaggccgaggctggaggatcacctgaggtcaggagtttgagaccagcctggccaacatggtgaaaccccgtctctactaaaaatacaaaaattagccaggcatggtggtgggtgcctgtaatcccagctacttgggaggctgaggcaggagaatcgcctgaacccgggaagtggagattacagtgagctgagattgcaccactacacttcagcctgggtgacagagtgagactccgtctcaaaaaaaaaaaaaagagaaaacaaaaaaccaactatctaaggcagaatggtaataaactgcccagtaatgctttcagggataattaaatgagtgatgagggcacaattacaaataagctaacccgagttacttggaaagcagatggaagcacccaagaccatacaacaagaatgaaaccccagaacagtaaacacacggtattcctaccatatatgccccccatcggtgtcacctaaaccaacatctctttgaccttttttttactcatgtgaccagttatttgattgtttggctgtcaaagtcacaccaagataataaattaggcctttcagagccaaaattatattatctagggtattacagtgaatatagagttaaataattttagtgtcctgaaaacattacaaaacacatatcagaaataagagccattctatgtagtgaatcgggggagaaatgagagaagctcagagaccaacatagagaaaagcaggagaaagcagaaagcactggaaacaaacatgtctgcttgttggtggtgggcgatggatacaaagatacccagccagaatccccctggaacaagccaggcattaaatctttacagctggagttgcattaaatctttacagctctaagctgcttgctgcaaacatcctgtagttctcgtcaattcaaactcatccccaactttctttttttttctaccttactcagtgcgtctgtgtctgggtgaacttcagaaatctctctcttacgttttcttgcaagactctttggctagttttatctgaaagtttgtttgtttttccagctagtagttcttccccctcttccctaagctcttgaagtctaacactgtttctctggtcagagggatcagacaaagagagctctgctcccggccacccatccgtctcattgattcaagccactgggtctgagtgggccccatcagagggtgtgatgggttccagacaacctggacgtgcttttagaaagcagtcaagagtaaatccataaagccttatctttgtgttggaggggaccacattataagcaaatcgtacattttcttccaatacaaagtaagatagtttcctgcattattagtggatatttttgcaaggacatatttaaaaatatatattgcccaataacccatcattcagtttaattccacatccctgctgggtgccttccagtctaccttgggcaacttaacataaatatggaaaatatagtttgtgtttatggagctcatcgccctatgagagaggccaggccctcacggaggacgaggtgacagcgtgggcacagccagctcttgaagaatatcataggtgatgaatgctctagagatcccaaggccaaagcggctcaggcacacgtcattcatttgtttgtaagcaccgtcaaggcaaagagaccaggcatctgtctttcataccccagccacaccccctgaagcagagtagataatagatgcttacaagacagcgagtgatttcatctcagtatgtatgaacagcttcaatcacacagattttgggcagattcactacctaatcggatgcgagacttttcatttcttctgacctatattagtaaacagcaatataatcttttctaattacagacacataaaatgattgataaaatccaacaattgtatgacccctccacaaagcattttttacattcaagcctcacaccagcccctggaaatagatattatttttaatcttaattcatccagcattgtgctgggtgctggggatagataggccagggaagaaagattcgaagcccctgcttttatggagctgacttgctggtgagaaaaaaataaataaataaaacagcaaacaagaacaaacaaatacatcaataatttaagtcattgttaaatacgatgaaaaaaatggtagtatgatagagagtgatcaagggaggaagtgagatctctagagtggatttgaaggaaccagatctaaagacagggggttccagttaaaggtataataggagtgtccaacctttcggctttcctgggccacattggaagaagaattgttttgggccacacgtaaaacacactaacactaacggtagctaatgagctttaaaaattgcaaaaaaaatctctcttttttttttttgagacagagtctcactctgtcgcccgggctggagtgcagtggcgctatctcggctcactgcaagctttgcctcccaggttcacgccattctcctgcctcagtctcccgagtagctgggactacaggcacccgtcaccatgcccggctaattttttgtatttttagtagagatggggtttcactgcgttagacaggatggtctcgatctcctgacctcgtgatccgcccgtctcagcctcccaaagtgctgggattacaggcgtgagccaccgcgccaggccaaaatctcatgatgttttaagaaagtttacaaatttttgtttacaaagccatcctggaccgcataaagcctgcaggccatgggttgaacaagtttggtatagcaggaccaaagaccctgaggtcagacaaggccggcatttacctgaacagaaggaaaccttgataaatagaatgaatggggaggagaaaagtagaagctgaggtcatagaggaggcagtggccaatttagcgagagggcctcacaggccaagggcaaggggtttgaagtttattatgagttgatgggaggtcagtggagggctttgatgtatcattttggcctctgtggatgatggatggtggggagaccatgagtggaggcagggaggctagcagggaggccactgctggagtttagtggagagatatggtggctttaatgagaacataattgaaggtacaaaaatgggcagattgaagatgtatttgggaggcacagctaagactatctgcggatgtattcggtgtggggaatgtggaagagagaggctcaaattcccaatttatggttgaaactgacactcaaagggattaaggaatttctgtctacagccgcaaatacagggcaggcaaggactccaggctggttctctaattcccaaatgacagctcttctcattcttgcatgaggatatgaggtttgcagaaagaagggattcatgagtagtaagtcctcttaatcctcctagtatggatctaatgattttttgaggtcatgcgtagtaaacaatgtgtaatatccattcaactagtcagctgatttgtggttacttgcaataagtcattattttcaatggggtcgataatactgtctctgacactaggtgtttgtaaccacaaagtgcacttcagttgaattcctttccgaggttgttttatgttcagaaccaacctttcgtagttatatcattagttattagagggataccaggcaacagatcgagtttatttcttgtaagcgttcttgttgcagtcatatatttcgtggtttcattaaatcggccttggtagacaagctgttctttcaaatccctctgtgagcagcaaatgctgtggattgagatctgtattctccagatgatttgctaagtcatctcagaagagtcctctgaactgtgaggtgtccccagcccttttgtcccagatccaagaaccaaaaaaagaacttgaaatggggatcctgctgattgtgcctacacttgttcattcatttcataaatacttactgggccctccagtgcacaccaggcactgttccaggtgctggagagatacaagcgagcgagagaggtcaggctgctgccttcagggggcttcttattcgtgggcaaaacaagcatgacaaatgggcaaacaagattatcacagtttaatacgtgataagttggtcaggtaaggcctgataaggcaacttatcacgtatcaaggttttggcctctgtggatgatggatggtgggaagaccatgagtggaggtagggaggctagtggggaggccactgctagagttcagtggagagatatgaccaacttggttaagttggtcaggtaaggcctcctcaaggacacggcacttaagcaggaggctggaagtataacaaagcagctatgagaggagctggggaaatgcatcccagggagtgggaacagcgaggacagagccctaaggaaagtgtggtgcattgtttagtaccctgttggctgctataatagagaaacccaggccaggcacagtggctcatccctgtaatcccagtactttgggaggccgaggtgggcagatcacgaggtcaggagttcaagaccagcctgaccaacatggtgaaaccccatctctactaaaaatacaaaaattagctgggcgtggtggtgtgtgcctgcaatcccacctactcaggaggctatggcaggagaatcacttgaacccaggagccggaggttgcagtgagccgagatcacgcctctgcactccagcctgggcaacagagtgagactctgtctcacaaaaaaaaaaaaaaaatagaaaccgagactcacaggggtttaagcaagatggatatttatttttctgtcacttaatagcatgggtggacagttcaggactgatgagatagctctgcaatattttgggacccagactctgctgtgctacaatctggcattctcaatatgtgacccctacctcatggtccaagaaggcttctccactcctgccatcacacctacttcccggccattcagaaggggagaggggaagagacggcctcttccctatgtagaggcataatatccagaatttgtgcgtatcttctccaaaggagatggaatcagataagtgtgtggtaggcaggtcattcgggaccatgtagatcatgataggatattgcgttttattccaagagcagctggatgccgctgaagggttttaagtagtgaagtgacatggtctgatttatgtttttacaagaacactctggctgctgagtggaggatggatgagtggaggatggatgacagaagggcaaaagtggaaatggaagatcatttaggaagctgtgatcttaaggagcaaggcaaggtggactcagacactgagacatcatataattgtagctttagagtattaactgtttaaagagacaatgagtaaagactgaatgttcatgcacctctttctaaaatacagggacagcctttgcgtggacaacttactggatgagcaggtttaaggaattgtatcctataaaagatagacgtgaaaccagccaatgtgaatgtgccgccaaattggacctggttatatttgtggggacccttaacttaggaatatagaaagcacatgaaagtgcctgtcaagctagagccctgggcaggggcaggctcagtctcccaggaggttagagctggaggccctctgagctcatggattcaacccttgtgctgcaggtggagaaactgatggtaggagtatggggggctgtggcttgcccaagttcaactttggacagttgcagaatcaaggcaggaagccaggactggaagccgccactctcaccatgcaccgtgagggggtatccttgatgggatgctttctcctgaatcacacatttaccttttggcctcctttgccagcacctcccttagaacaagttcccttctttacctttccccaaagtcccctggcctgtacctcaagtgattccatcagttaccttgtcttccaaacaggactggccagatgacgatggtaaagtgattttgagagattataactcacgtttgctgaaatgttttgaagtttcaagacagtagtatgcactgtgaatgccagtgttgctcaagatcctagagacagccctgggtcctggagccccggcagcctgctccaaggtcaacaggcggggccccggcaattgtttggggaccattttcacaaccttaaggtaatttgtggttcctctgagaatgcccactgaagtgttccccctcagaatgctgtggatgggagatagaaggaaacaaaagaggaggaagcagtgaggattttactggatactgcagatgcacttccacatcggcatgggttcatactggattatgcaaaagtatggattctggaatgattcattccccccaaaacctggaactcgagggcagcatgctgcctcgttgtccataaaacactcccttttgtctctgcagggatcttaaaaaaacaaagcaagctttactgtggcaaaacctcctctacatattatcattgtctgattggattttaagcacaatgctatcttggtctacacattttcttatacaagtgacagtaatactaaaaatctcagaattattatcaagagccttttggtagggtgaaagtttcttttaagtattttcattttcaggagtgagttttcacacacacacacacgcacacacaagtatcaggaaacaaaaaggaaatgtgtgcaaacttccaatttaaatgttctacatcttagttgagatggctatgatacagatacatgtatttggcaaaactcatcaaactaggcatttaaaataagtacatttttggggtacaaattatacctcaatgaagttgattcaaaaagtcaaaagtaaaccaaaaattccaattttatattccattaataagtttttggtgtctgcttctggttttattaccgaggattctcatttgagtacactcagaatggaacagagctattatcatcgaacgtttcctatactgggactaaagtctggccaggaaattaacttttaaccctaactttgtgctattttgagataaaagaaatgcacacctcagaacagcaaggtgttacagcacataactgcctgtacaatttaaaaactcgataaacccaaagctttggtagcaagtcttagcaggtgctgagaaatacgaaacgattaatttttttttttttttttttttttttttgtaaaccagaaaacaagtctggtgttaagcctgttgtgcaaatactagcattaaatattttgtagcatatcttagttccaagtatttcttttctgtcacatttttctggttcctcctgataatcaaggcaatattctttgaactgtttccttagaaaagttgttgaaatgaccaaatttctaattccattgggatttggacacatttctgaaatggcccagaaatcattttggggagcccttaggctgctgttccaatccagcacataggtgtgacagcggagacccactcggacttcagggactgcctgcctcctccctccacacccatctcctgtctccccaggacctgtcctcaggagctcaaaagaagaggggtcttggtcctgagagggtgagggggcgaccgggaggaagcacttcctctctgtttcttaagacatctcccttccctgggacaacttccctaaaaggctttctttttttttttttaaccacttttccaaagtcagaaatgaatacattctgaaaataacccaactttctttttatgtttctttctttccacccccacctcaagcccctagaatggccagcccacctggctagcaagaacttaccttcctgagcatgcctggggacagaccctagcacacaccccaccctgggctcgtggcgggactctggctctggccaacatggagatcccagccacacactgatttggaggcctgagtgtcaatgacaaaagcaatccaaacccaaaactctcaaaattgattaaacaatggaaagcttggctttacatgagatgtgtggaaagcatcctgcatccaggtactcactggaaggcagaaatttagcagatgttgctattattatccttagggttaatcatagtgattcctgacttacagaatccaaataaaggaaatccacttcatgcatcagccgccagctgctttttttttttttttttttttttttttttttttgagacggagtcttgctctgtcgcccaggctggagtgcagtggtgcgatctcggctcactacaagctccgcctcccaggttcacgccattctcctgcctcagcctccggagtaagcccccagctgctctttgtggacactcattgcccagacccccactatggtcgatcagtattaattgcattaacagatttaattataaaattatttcaactgcctgtttttttctgtcttccattctgtgttataatagtttgccaggttagctccaaacacttaatgtctgttacttactcaatataatcccacccagtacatcacctttactgggaaagaagcttgttaatctctgtttaccagtctgctcccagttattcaaggactctctgaacctaaaatgtataatatgacctaggtcagaatggcgttcccataagtgagcaccaacagtacgcagcggctgacacgtgtgaatccatctcttgttcccttgaactgtgaatcaacatggatgtagccatagtcatatctatcaccttttgtgagaaaaattttactttgaaaacaaagtaatagactgtacagttaaaggacagcagaatccagcaaaggtctgtctgtatcacaaaggaaagccacatcatgtgctttattcccatcatcagtcaacatccattttttgtagctctgggaacctaggtgtctgagagccagcgctgcgtattggtagcactggttctgccatctctaagccccaggacaagtatcctaacagaactaagccctggcttcctcatctgtaataaaataagtaccttctagtattcttattttattgtgaaaagacaattctgtgcacatatggttacacacacatagactataatgacacttgcattttattggtattcacaacttttaaaaattttcctatttaagacacagcttaaaataattaaaaagaaatcatcacatagttattactgaagatttgcttctatgttccataaaacatggttttaaaatataaaaaaaagacacagcattgatttccttcaatctgcactttttttcccattttgctcagcacacaaccttttaactcactcttaaaaaaaatccaccataaaggactggaaattaagagaagggtgttatataaaaaatgccatgtgtgctctgacttacaaagtcttcttcagtccatgaactcacagacagtgtcagccactgagagtgtcgtcgtcaaaacgaataatagatgtggaaagccgtggctcctgctcctgagagctggacgcctcttggctgacctcctgcttgagccagatccaagaggtgaaggctgaagcaagagagctcccttgagaaagctccagagtttgtagcctactaaaccagcagtgtcctatattacattaattctcctgatgtattttcctgacatttgtcagcatttccttctatttgccaaacatggacaaagagaaaaccaggttttagaagtatgctcatttataaagtctctcctgagtcctcacctttccatcccttctgccatcacctcagtcagacccttaccccatcactcaagacagctgtaagtctcctggcttgacacttcgcttcaatctcactcatctctgattaaaattgtcccatgatcgaaaattttatgttgttttcgtcaccattaaaaaaacaaaaaaacaaaaaaaaaaacccttcctcttccaagatgctccagtgcttaacaaatcaagtgtaaactgatttgaagcgtgaggccctgcgtgatatatactgtaggagacctttccagctttatccaatatccatccctagtactttgctgttaccccatgatatggtttgactgtgtccccacccaaatctcatcttgaattgtagctcccataattcccacatgtcatgggagggacccagtgggacgtaattgaatcatgggggtgggtctttcctgtgctgttgtgatagtaaatgagtctcatgagatctgatggttttataaaggggagttcccctgcatgagctctcttgcctgccaccatgtaagatgtgattttgttcctcctttgcctttgcctatgattgtgaggcctccccagccatgtggaactgtgagtccattaaacctctttcctttataaattacccagtcttggttatgtctttattagcagcatgagaacagactaatacaccacacatgctcattgatttcttggttttgtgaaaggcccatctccctctcccatcagccttctctttgcaaattgtagcccccgttcaatgatcagttcagttggcactgacacccacaggcttcccttgatcctgtgccccaatctagatccatagctctctcctctggatgtccttcatgtgactgtgcatcatagccttctgtattttgcctcggtcagtgtttattcttgactatgagatcctgcagggtattgtagtataactgtttctctgtgcctcacagtgccaagcacagggccttttgtatagagcatactaataaaatttctgattccaactaaattcttgtatgcacacataggaagtgtgacttaatatatgcatatggaatcaaaatgattactttatagttagcatgtgtatgtttgtatgcagaaaattcaaaacaagtattcaaacaagcacaaagttgtgtaactaggaaaaacacatgctcatttactcctgacctgtggggcccaggttccaggccctacactatgtgatgaagacacaagacaagaaaatatggcaccttctttgagaagcttccatctagtcagggagaaaaacctgtgatcatataactgtagcaggccctattactcctgactacactggagaggccaaaaggagcgtgcctggttcagcctaggggtgttcaaggtggtcgtatcactggctgagggagtgtctgagggaacacacagccagggggctgggagaagcagggtgggtcagagcacaaagagacttgttcatcatttcgaggcgcctgtgctttctactagagatagtcactgaagcagaatgagaggatcctacgcagtttcagaaacatccccctgagggccaggtggaggatgaaatggggggaagaaggcaagatggcgggcagccatgagaccatggcaagaactctcagactggaaatgaggctggcttgagggaaatgggagacgggagcatttgagaatgtggagattgcatgagaagggatggcttttgggtgagtgaggatggctggcctgcctgttcacccgctgggagcctggtgaggtctcatccacttaccatgttgtctgggctagagagaggtagcacctgtagaaaccgcaattaggggtcctatgcttttgtttaactttctggaaatagaacaggcctcccttttaatacatctgttattcagcctttagatattctgctttcaagcgcgtaatcaggaatgcattagaataaagcagttaggagcagagtaacagaagggttaaagtatttaacttctccaggcctgtttcctctgtaaaatgagaaagaagataataatagcacctatttcacagaggagctacaaaaattaaagaagttaatgaatgtaaattgctcagcctagggccctgcataaaatgtgcacttaagacatcagttacttttttttcctgtgtgattggtgaggaaggttgagaaaagcatgaggactccttagctcttccgaaatacagtcatgtgctgtgtaaggacgattcagtcaaccacagactgtgtgtacagtggtggtcctatgagattataatatggttacttttactgtaccttttctgtttaactacctgtagatacacaaatactaccattgcgttacaattgcctacagtattgagtacaataacatgctctacagatttgtaacctaggaaccatagaccttaccatatagcctaagtgggtggtaggctctgccatctaggtttgtggaagtgcattctgtgacgttcccacaataacaaagttgcctaacaagactcatttcacagagtgtatccccatcactaagcaacacataactagtacttgctacagttgcaatataggcaaagcctcccttcttaaatataaataagcacacttttcaattcggagatgtattttgtatactaaatttgaagacattgttttgcctttttgtagggagagctggagattctgctcttatatccagagtggcatccgtgtgacatagtcattctttgtatgtgtgcctttagcctatgggtcattgtcagaatttagaaattcaaggtgcagccagttacattgctagagagatggaatatttcagagtctctgcaagcttcctttaagaaaaatgtcttcttttggaaagccattcagaaaacatactcagtaggacagtttcaacttattaaactttcaggaaatttttttaattgtctcacactgtctcttttgctgtataaattttaacagcagggtaaagagagaagcgttcttgaatttcactagctgcggagaaaatatttctcactgccctgggatacataggaaatcacagtcgttagtttcagatgtttagtttgggatattcaggtgcattcacaataccttttgattcattattactttaaaccatttgtggtttgatcctacaaattgaggacttttctccagatgtgaaaaatacaataaaattttctaacagaggggatctcgagaagaagttatctttatttctgcagtttctacaagagtccataaacccctttagaacatggcaaaaactgcagattggcagccatgggttggctggactgaaagggaagggggctcacatttaatttagagcataagaataagctaaacagcaaggcagtgacaaatgatacaacaagcaacaactcctagctgactgctccgaaataaacacatggattccaggcctcacctagaccaagaacatattctgcaactaaaattaaaccttcgggacatgcaaactctttagggaaaggagtggaagaaggagaagaagaaggaactcagaggttaccaagcaattgagtggtgaagagaacaggcatgaagaaaagagaacaggtgtgaagcaacgaaggaaattgcttctccaaatgaaaagttttgaaacacagccctcaccaacctcagaaaaatgctaactctgaaataggaaatggagacggaattggaaatggaacgtgaggaatatcagtaaacccttgtaactgtgcgatcaacttctttgtaagatttttaaactcaaaagtaaacacttttaaaaacttaaaagtgtaagattttaaagtggtataaagatcttaattaggcatttaggtagtgcatgctgtggagccccaaacttacagaagtgacaccagaaaaagccagaatgatccctttctgtgttccagtacttgtgggaaaaaattatttttattaatttgtaaagggctaaaatatttatggactaaattcagatgagtaaaaagatgaaggtgttagagtcgcttttctttcttttttttctttttcttttttttttttgagacagtttctctcttgttgcccaggctggagtgcagtggcgtgatcttggctcactgcaacctctgccccccagattcaagtgatctcctgcctcagcctcccaggtagctgggattacaggcacccaccaccatacccagctaatttttgtatttttagtagagacggggtttcaccatgttgaccaggctggtcttgaactcctaacctcaggtgatcacccacctcaacctctcaaaatgctgggattacaggcatgagccaccatgcccagcctagagttgttttaattttctatatcgggtctcatcttgttctgaggcatccatttctatgttcttggtttgggttgaggggagattgaagcttgcacttaaagtcaactaagtctctcatttaaaaagtgtttcttttaggtgaattcagtctctctgaggcaaatactcaatctctctgccttcatatctcctttccagagtgtcaaggggcccgggattacacgcagtcttcagggtctgtcttcatctcctaggctgtcataacaaagtaccacaaactgggtggcttacagcaatacagatttatcctctcacagttccggagcccagagctctgaaatcagggtgtcagtaggggtgggtcctcttggggactcagagggggaactgttcttctcttccagcttctgatcgttactggaagaccttggtttttctgggcttgtagaagcataattttactctctgcctgtgtctccacctgcctttctccctgtgtgtgtgtctgcgtcttctctttttataaggacaacagtcactgggttagggcttaccttaactaaagatgacctcatcttaactcgaccattgtattagtccgttctcacgctgctatgaagaaatgcccaagactgggtaatttgtaaagaaaagaggtttaattgactcacagttctgcatggctggggagtcctcaggaaacatacaatcatggcagaaggcaactcttcacagggcggcaggagagagagaatgagtgccagcaggggaaatgccagacgcttataaaaccatcagatcggccgggcacggtggctcacgcctgtaatcccagcacgcctgtaatcccagcactttgggaggccaaggcgagcagatcatgaagttaggggttcgagaccagcctagccaatacagtgaaacctgtctctactaaaaatacaaaaaaactagctgggcatggtagtgcgtgcctgtagtctcagctacttgggaggctgaggtaggagaatcacttgaacctaggaggcagaggttgcagtgagctaagattgactctagcctgggcaatagagggagactccatctaaaaaaaaaaacaaaaaacaaaacccatcagatctcatgagaactcactatcacgagaacagcatgggggaaaccacccccatgattcaattacgtccccccaggtccctcccttgacatgtggggattacagttcaaggtgagatttgggtggggacacagagccaaacagtatcaaccacatctgcaaaaactgtctttccataaaaaggtcacactcacaggtaatttgacatagctttttggggcacacaactcaacctgtaataggatccttacaggtctttgctgtggtggctatgctggtctggtggccacccttgtggcgctgaggtgctgaggttgggggatgttctgccgtggcttattaaagggcatagtgctagccatctcccattcttcctgcatctgtactgcgtgcaggctgcaggggagcacagcactacctaagccccatccaacagacaagtgtggctctcttaacagggggacttactactcgtgtgccaaattcaatgctgctaataggaagcttgaaagcaaacagtctatgctttggcaaggaggatccactctcactccagccccatgtttcaacgtttaaagggaagccagaatacatacacagatggtctccaacttatgatggtgcaacttacaacatttttactttaccatggtgcaaaagcaatacccattcagtagaaaccgtcctttgagtacccatacaaccactcttttcattttccctacagtattcaatagattgcatcagatattcaacatgctattttttttttaaacggagtttcgctttttgttgcccaggctggagtgcagtggtgtgatctcagctcactgcaacctccacctcctgggttcaagcgattctcctgcctcagcctcccgagtagctgggatcacaggcatgtgccaccacacctggctaattttgtatttttttagtagagacggggtttctccatgttggcctggctggtctcaaactcccaacctcatgtgatccgcctgcctcggcctccctaagtgccgggattacaggcgtgagccaccacgcacggcctcaacattctattataaaataggttttgcattagatgattttgcccaattgtaggctaatgtaagtgttctgagcacatttaaggtagggtgtgtttggtaagttgagtgtattaaatgcacttttattctgacaatatacaagacagtaatattattttttgactgaattagtggctgaattaataagtgaaagacaaaaggactgcttttgcagggtgagctcaaaaacgtacgatgggtttactgggatgtagccccttcatgctggaggaacctctgtacgtgtgtttccttagggctttgcaatcactgttccttctatctggaatgcttttttccttgggttccttttgagaggtgacagcgtgctggcagtcctcagagccctcgcttgctctcggcacctcccctgcctgggctctcactttggtggcatttgaggagcccttcagtcccccactgcactgtgggagcccctttctgggctggccaaggctggagcccactccctcagcttgcagggaggtgtggagggagaggcacgagcgggaactggggctgcgtgcgggccagctggagttccgggtgggcgtgggcttggtgggccccacactctgagcagccagccagccctgctggccccgggcaatgggggacttagcacccgggccagtggctgcggagggtgtactgggtcccccagcagtgccggcccaccggcgctgcgctcgatttctcgccgggccttggctgccttcccatggggcagggctcgggacctgcagcccgccatgcctgagcctcccacccactccatgggctcctgtgcggcccgagcctccccgacgagcgccaccccctgctccacagcgcccagtcccatcgaccacccaagggctgaggaatgtgagcgcacggtgcaggactggcgggcagctccacctgcagccccagtgcgggatccactaggtgaagccagctgggctcctgagtctggtggggacatggagagtctttatatctagctcagggattgtaaatacaccaatcgggactctatatctagctcaaggtttgtaaatacatcaatcagcaccctgtgtttagctcaaggtttgtgagtgcaccaatcgacactctgtatctagctgctctggtgaggacgtggagaacttttatgtatagctcaaggattgtaaatacaccaatcggcactctgtatctagctcaaggtttgtaaatacaccaatcagcaccctgtgtttagctcaaggtttgtgaatgcaccaatcgacactctgtatctagctgctctggtggggccttggagaacctgtgtgtggaaactctgtatctaactaatctgatggggatgtggagaacctttgtatctagctcagggattgtaaacgcaccaatcagtgccctgacaaaacaggccacagggctctaccaatcagcaggatgtgggtggggccagataagagaataaaagcaggctgcccgagccagcattggcaacccgctcgggtcctcttccacactttggaagctttgttctttcactctttgcaataaatcttgctactgctcgccctttgggtccacgctgcttttatgagctgtaacactcaccgcgaaggtctgcagcttcactcctcagccagcaagaccacgaacccaccagaaggaagaaactccgaacacatctgaacatcagaagggactgactccagacgcgccaccttaagagctgtaacagtcaccgcgagggtccgcggcttcattcttgaagtcagtgagaccaagaacccaccagttccggacacactttcacctggctcagagctcaaatgtaatctcctcagagtggccttccctgctcctgctacctagagtagcatctccccgtctcactctctcccttctcctgctttattttcttggtaaaatatcatttcagagcacgaggctttctttaagcaaaggacagacattttgcttattgctcaactagtttttgagctcatcctgaaaaaagtagcttttttgtctttcacttattaattcagtcaaaaaataatattactgtctagcaggctgggcgtggtggctcatgcctgtaatcccagcactttgggagaccaaggtgggcagactccctgaggtcagcagttcgagaccagcttggccaacatgatgaaaccgcgtctctactaaaaatacaaaaattagccaggcatggtagaatgtgcctgtaatcccagctacttaggaggctgcaacaggagaatcacttgaacctgggaggcagaggttgcagtgaaccaagatcgcaccattgtactccagcctgggcaaaagagtgagactccatctcatatatacttgagatgtatatatatgtatatatgtatacttttatatatatgtatacgtgtatatatgtatgtgtatacatgtatacatgtatgtgtatacgtgtatacatgtatgtgtatgcatgtatacatgcatgtgtatgcatgtatacatgcatgtgtatgcatgtatacatgcatgtgtatgcatgtatacatgtatgtgtatgcatgtatacatgtatgtgtatgcatgtatacatgcgtgtatgcatgtatacatgcgtgtatgcatgtatacatgcgtgtatgcatgtatacatgtgtgtatgcatgtatacatgtgtgtatgcatgtatgcatgtgtgtatgcatgtatgcatgtgtgtgtatgcatgtatgcatgtgtgtgtatgcatgtatgcatgtatgtgtgtgcatgtatacatgtatgtgtatgcatgtatgcatgtatgtgtatgcatgtatgcatgtatgtgtatgcatgtatgcatgtatgtgtgtgcatgtatacatgtatgtgtatgcatgtatataggtgtacatgtgtatgcatgtatataggtgtatatgtgtatgcatgtatatatgtgtgtatatgtgtacatgtatatatgtatgtgtacatgtatatatgtatgtatgtatacattatgtatacatatctgtcaagcataatgtcagaattagcaatattgattaaattatgtagtccttgaaggtagaaactctttttcactattgaatcctcaccacctggcatacaatagatactcaataattccttgtgtgggtgataaatgaatgggattccataacaaagttgatctgtgtaagacttttatttcactctttctataaaattaagtccacaatttttccatggatccttgcccaagaccacatgttgaaaagaacttatacgaatggcagatagcatcacggctaaagaaatagaatcttttgaagacaataactattttacttttaaaattgctcacaaattaaagaatgctggtagagataacaaagatgatttccaggagtaagaggccatcatgcagtttgtgatttccagatacttttgcagaaaggcaaccatgctgtagagtcagtagcagagttttcaccacctgtctaagacagaggaaaatgaccccaaaaaaaaaaggcaacttcaggcccttcttcaaaaatgcaaatccagggctacttccagctgtctccatagcatggcaaaacaatattcccagccaagcttcaagccattaagaaaaaccatcacagctgtgcgcggtggctcacgcctgtagtcccaacactttgggaggcccaggaaggcggatcacgaggtgaagagattgagaccactctggccaacatggtgaagccctgtctctactaaaaatacaaaaattagctgggcgcggtggtgcatgcctgtagtcccagctactcaggaggctgaggcaggagaatcgattgaacctgggaagcagagattgcagtgagccaagatgaagccactgcactccagcctggtgacagaacaagactctgtctcaaaaaaaaaataaaagaaaagaaaaaccatcacatatgtttggcaggggccaacatatccatggggttcagtaggcccacagtacttccagggacccacaaaagtgttctaataacatttaaaatcagaagaaaaaaatgaactgttaagtcaaaggaaaaatgttctaatatataatatgttaatacataatatcattatattcatctttataccaacacagtcctaaaatattacttttgatttttttttaatggaggaagaaaaccttgaaagcaaaagtgcctagggcctgtgaaagtcatcacatgaccctgatttggcgtctgctttgccttaaaaaagcattctagacagatattcagctggaaatactgaaatgggctcatgccaaaagaactagatctcttgttatccagaaaaccatattttctaggcagattcatttcccccaagatgcctaagagtcatgataacatattttagaggcgagattaatgcgatcgccccataaaatattttaagctctcatctgttctgaaacaaagtacgcaacatgtcaccaagagaaaatgactgctcataccgagaaaatgtattttcttcgaggtgccacagccactgtaatttgcacctcctgaagtgtagatggaagtcccctcaacatgtacagacagttaaaagagtcacggtaatgataggactagagaatgtgcccagctgagaaaataagcacacagcgagcattgtcagagctgaaaattaagatcccccaagcaaacatttcagatagagcccctcatcttttgttaaaagtaaaatgaaaatcaacagccctctacaccacatctgagccatggaagtcactccctttaggtgtctaagagacgactgcagcttcagtgcctggctcagattagctttgttcttccttgtctcttatcctttgaatagctctgacagtgccacaaggagtaattaccaattcgcagggggacacatcttcagttaaagtggattatctgcaagttgaggggtgggggttgctggcggctacaactgagttaggtattaagtataatctgcaaatgcagggagagttctgcagagccccaggcagttcttaactttctagaagtagctcccagctgaggcctcccctggtctccaggcatctggataatgtcttaactggtagagtgatggttaagagcatgagttttgggggcaaatttcctggttttatgcactggcacttcctagctcatgtgattctgggcaagttacttcactacagtgagcgacaatcagaatgggtccaaaattgtaccagccatagcaaggtgctgcagatgtagcaggacgaattgcagacaaaactcagacaccaagttaaagaaggaagaggtttattcagccgggagcatcggcaagactcctgtctcaagagccaagctacccgagtgagcaattcctgtcccttttaagggctcacaactctaagggggttccgtgtgagagggtcgtgatctattgagcaagcagggggtatgtgacaggggctgcatgcaccggtggtcagactgagacagaacagaccaggaagtttcacagtgtctttctatacaatgtctggagtctatagataacatcagttgctaggtcaggggtcgaattttaactaccaggcttaggtcaggcgggcccaggcctggtttcgggtctggttcctaggcactgggctacctgcctttagtttcgcttctctttccttttctgattatagaacaatataaaacaatatgagagggtctgtctctcttctctcacaaacattaataagacattgtgtttcaaatgctaagcatacatctaatacatggtaataaccccaagaatctttagctgttaccattatatttttatattttttttaattaaaattgaatcccttttttttttttttttttttttttttttttgtcttttgtgacagagtgcctctattgcccaggctggaacgcagtgctgtgatcttggctcactgcaacctccgcctcccaggttcaagccattctcatgccccaacctcccaagtagctggaattacaggggtgtgccactacacctggctaatttgtgccactacacccggctaatttgtgccactacacctggctaatttttgcattgttagtagagacagggtttcgccatgttggccaggatggtctcgaactcctggcctcaagtgatccaaagtgctgggattaccaacataagacatggcacccagcctctgttatcattattaagcattcatttaagccaagatctaaggggaaccaaggcccagtagcaaatctgctaatactcaggaaatgggtttgtgagaaatgttgctgttctttatcattattattattattattattattattattattattactattactgctacattcactatgagaaaacattcacgtctcagaaataacagtaataaggggtaagcattgccaggaggaggcagaaggcacatactggccaagtccggctctacgccctgtgtgtacagatatgtcttccaactttcgaaaagtctttgtaaaggttttcgctgatttgagctgttttcagctaagtcaccagaacatccagaatctaattttaaatgaaggttattataatgtccctcagtttcgtagcctcttattcaagagagattagaattctgtgaaggaaaagctttgttttaagttccaagggatgtaaagatttgctaggctgtctttaaatcccatttgggaactcaccatttatataaaaatggatgacatataatgtgtctttgggaacagtgaactctgaagagaaagatatggtcaaatggcccggcctcctcccacctcggaggatacactgcaccctcttcctacccctgatttggccctttcacaaatctcagctctagactgaggcagaaggacataaagatgcccatttccaaagctctccggctccccagtgcctctggttctatccatctttgtgacctgacgtctcagtggctgggtcccagatagggagctctggtctccggttcctggaggctgagcctgaatccctccacgcagaaagagagtcagggacagcaccgggggctgaatccctgccccaccttctagcagagtgacctcagtcaggtgactttactcctcaggctgtttcttttctggataacaaaaggtcattcaaccccatcttgtggattttctgtggagatttagttagataaaggactggcacacagggtgaagtgaggcagccttcccctcttccgcacagtgccacacagaacaggggtctgaggacttgccttctcccctgcatggctggtccccccctacccctgcccttccctggtgtttccaccgcaccccaccagctggaatgacatccaggattgaactcaatagccccttggcttacagggccactttctccacacctaccctggcagacttgatctcatatttgctttcagtataagatccagttgagcatccttccattaatgccccacagaacaagtctcagccttctccctggtgccggcctttccaacacctgaaggcagtgacggtgtgcttctagagtcttctcttccccacattcagcatccacagttccttccagtctgcttcacatgacaccgtctcaagcatggtgccatcctcaaaacacaccccggtttattattgctttcctgctcaagatgctctgtccagaactgatcacctctctggggtatgctgaccaccccaggggatggtctcagaaaccactttctaaattggaatatagactccatccttttcatgactcagtcaggtctcactcttaattcctaaatcccaaataattaacaaaaataccagagtcctgaggggttgctggaaaacaaaactggaaaaaaaaatccagttttcttctatcagccccattgtcccaacaaaggagggggagaggaggctacgtgcagttaccaggtgtgtcctatacaatttggtattgaaggtgattggggtgggggaaggcacgatggcatttccaaatatagaaattggttattcgtttctgctaaactgtatttagttatatctagggaaatcatttcagcctctcggagtccctttggctcacgataatgtcctcttgagtggagccatccctttttactaaatgccatatggcacattcatcaatgtgccattgatgtctttatccaagttaataaaatgattaaatgtaggcttggaatcaccactaaaattctccttgaagccaatttctacctatttatcaaattccaccactgttcatctcatgattaatctacctttaaaatactctcatgcatcactgaacgacagggatacgttctgagaagagtgtcattaagcaatttcatcattatgcgaataccacagagtgcacttacacaaacccagaaggtgcagccttctacacacccaggctctgtgctacagcccattgctcccaggctgcagacatgtgcagcacgccactgcactcaatactgtaggcaacggtaacacaacggtatttgttcactaaacatagacaaagtatggtaaaaatatgatataaaagataaaaattggctgggcgtggtggctcatgcctgtaatcccggcactttgggaggccgaggcaggcggatcacaaggtcaggagatcgagaccagcctggccagcatggtgaaaccccgtctctagtaaaaatacaaaaaaaattagctgggtgtggtggtgtgtgcctgtagtcccagctactcgggaggctgaggcaggagcatcgcgtgaacctgggagttggaggttgcagtgagtcaatatcacaccactgcactccagcctggggacagaacaagactccgtctcaaaaaaaataaataaaaaataaaagtaaaaattggtacccctatataggacacctaacaggaatgaagcttggcaggactggaagttgctctggatgagtgagtgggtggtaagtgaatatgaaggcctaggacattatactactgtagattttataagcactggacactttggccacattaaatttaccttttacaattttctttctttaataataaattaaccagctgggtgcagtggttcatgtctgtaatcccagcactttgggaggcagaggagggtagaccacttgaggtcaggagttaaaaaccagcctgatcaacatggtgaaaccccgtctctactaaaaatacaaaaattagcctggtgtggtggcatatgcctgtaatcccagctactcgggaggctgaggcaggagaattgcttgaacccaggaggcagaggttaccgtgagccgagattgtgccactgcatgcactccatcctggtcagcagaggaagactccatctcaaaataaataaataaataaaataaattaaccttagcatactgtaccttttctaactttatagacttcttaatgttttcaaactttttcactttttcatatttttgtctaacacttagattaaaacacaaacacattatacagctgtaaaaaatatttctttttatatgcgtattctataagattttgctatttaaaaatttgtttttaacttttaagacttttttattgaaaactaggacacaaatgcacacatttgctttggcctccacagggtgaggatcatcaataccactgtcttccacctgcacaccttgtcacactgggaggtcttcaggggcagtgacacacatggagctgtcatctcctgtgataacaatgccttcttctggaatagctcctgaaggacctgcctgaggctgttgtacaattaccctttttaaaaataaaaaataaaaaaaaagtaggccaggtgcagtggctcacacctgtaatcccaggactttgggaggctgaggcaagcagatcatgaggtcaggagttcgagaccagcctggccaacgtggtgaaaccccgtctctactaaaaatacaaaaattagccaggtgtggtggcgggtgcctataatcccagctacttgggaggctgaggcacaagaatcgcttgaacccagtaggtggaagttgtggtagctcagattgtgccactgcactccagcctggacgacagagcgagactcagtctcaaaaaacaacaacaacaaaaaagaagtatactctaaaataatgataaaaagcacattatgataaatgccaggcaatagaaaaatttcagctccattataatctcctgggaccaccctcctacatgtggttcatccttgaccaaagcatcattatgtggtgcctgactgtactactcaaacatattacaatgagaccatatctatttgtcttgaccacaaaaatgtcatgagaaacttactaaaatgctttgctgaaatttagatggcctctctcagtgctctcccacctaggaggctattaccccaatctgaaaataaaggaactggctttaggggttcagcagtgagaataggtgttgacaggaagaagtatccaaaggcctcccagtgggtctccggactgtgtcccttggtggcatccagggtggttgcgatcgtatggtttaaattttgtgatgatccactggagcttcaagttcagcctcaaagcattaggctctgttttctgaacatcattttatatggcaaggtcccgagattctaattttttcttgtgttaattatgtgacatggagcgtcagttaagggaaccatccaatacactttccagaaacagttctccctctcagtttcttcgtgtgcttgactggctcatggccctggggaaaccatcgctttcaatccctacctcaggtccatttcgtgatgtttatgcattcatgcgatcttagtcctcaaaggatttttttttcttctcttgggtaagatagctttagaggccttctgggataggaattataatacaactgagaacaaaggaagaaaaataaaaagtgaactactttctgttttactgaatcattcaacttgacattatctggaaatacaaaaatttgctaacacacttttcctagcctacactttgttatgctgcttgtgaaatgtatgaggtcaacacctttctacccttttttccccattgtcgcaaattctcctgctgtccagagttagtttcaaatgaccctctgctagtcttggccggcatacctaccagtggcttggagaggaattaaggaaaagcttgaaaactgaagctcatttttttgtatggtgttggctagagtttaacgtggttctccaaagccaaaaaaacattttagcagaagcggagcacacacagagataaattatttttctgtactacatttcagttggtaatttcgtacacaggattctatttctgctgctatcaagataaaatgcaaaagtggaaacattccaatgagtaagaagcaggtctgttcattcccagctcatgagaaactcaggacgcacattagtgttctgtttcccagcagcaaatagccaggacatatagcttcaatttactgggattcgaagaagtcaaatcagacctgatttcccatgaagtaaatcatagcacccagctctgtggtttgagtgacaggtacatccattattctgaaaggtcttgttactttcagcagagcttgttattcttagccctaaaaaatcatgccatgtgacagggcacctgaggctgaggaatggggcaccagcaccttccaggctttctatcttacatctgacaacttgaaacatccaggaaagaagtggaaaatccacatatcagatgtgtgctcctacccattccaaatgtctggtgtttgggaaacatttaagggatcataaattctcttttgtgtcaatgtttttggtactgtgtaattacaactatatatgtatagttatgtatatatgtatgttatactatatataaaactatatatagttacatatatgtatatatacaactatataaatatataaactataaatataaaatataaatatatatatttttatatatatatagtatattatatatatacaattttttttgagacagagtcttgccctgtttcccaggcttgagcgcaatgccgtgatctcggctcactgcaacctctgcctcccaggttcaagtgattctcttgcctcagcctcccgagtagctgggattacaggcgtccaccaccacgcccagctaattttttgtatctttagtagagatggggtttcaccatgttggccaggctggtctcaaactcctgacctcgtgatccacctgcctcggcctcccaaagtgctgggattacaggcgtaagccaccatgcccggccattacaactatattctaagattaactagcaatcataagttttttgttttcagtctagattttagaaatgcgaatgacaccaggcccaacactttgggaggccgaggcaggtggatcacgaggtcaggagttcaagaccaacctggccaagatggtgaaaccccctctctactaaaaatacaaaaaaaaaaaaattagccagacatggtggcgggcgcctgtaatctcagctattcgggaggctgatgcagagaattgcttgaacctgggaggtggaggttgcagtgagccgagattgcgccactgcactccagcctgggtaacagagcaagactccatctcaaaaaaaaaaagaaaaaaagaaacgtgagtgacaatttcaacctatttagtatccccaaaagctcaggagctgtgataaattgatacaaataaaaatgtaatacttcatctttttgcaaaatagtgcagtgggctctatgaagacatttctttttattgttgactctggaaagaaaaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgccttacaggaaagaaacaacagttgaaacactgggaattttccccaatagggagaaggcacagaaaggagaaagctaaagaagagagtgaaagaggcccaaagagaatggaaaagtgagagcaggccatttgccagggctcattcctgccatccagccccagcttctggctgctcagtggacgcttctgccaatgctcacagccccacaggcctgggcccgggagcctctgctgccacccgtggtttctctccctgttccaccatcggaaccccgtgccccaggctctctcccttgaggccacctcagaaggagataccaaggggaagacagctctttaagaagtgtagactccatgttaaattgagaccccgcagacagatacggctttgaaacaattgattttctgtggtgtcatagggaaacctgccctcctcaaagttgcgaaaactgtcagggaccctatgaaatggagcgggagtcacaagttttctacccagctctaaaagaggagacaaaactaacactggttcacaatagataacagaacggcttcagcaaagggcaagcaagcgtagagagatgctggagaagaacaaggcactttatccatgtcccccacagcaccctgcctcagcgccggggcaaaagaatctttgtgtgagcccagggagtcggcagggacatgaggggttgatgcggcacttgctcagagcaatcgcagtgctgccgctggaattatctttctcacacagttcccagtagtggttaaaaggctctgaggtcagtccgcctggcccactagctaagggctcttaagcatttaaggactctttcaacatttgtttctgttagtttctaaaacttggaacagagggccattgatttaactggtataacaacgtgtgggtacattgcacttgttaccttggaaatgcctctactcagtctcacctctgagctgagttagtttgggaagatgttgagcctacaggtagtggggagatggtgagattcaccaaggcatgtgttgtttgtgattgattgggttgggaaagtttcctgactgccaaaacctccatcagacactagccggggattctgtaaatctcagaattccaaggggattggattttgaagaaaggagatgttcacgtacaggctactagaattcttgttctttttttttttttttttttaaagaattctgaagaagaaaataagtaagagatctaaaacagaaccatattttgccaggagggcagagcagggctgctttgttcaatttgttaagagggtcagggaagcatcagaaaagataaggagaaaaatcaatcagaaccaagtcactgttgtgagtttcggcagcgtctgaagtagccagaaggtactgagaaatgtattttatcacatatagtcttattttcaccctaccgtattttctgttaacacaaggttcctttaaagtcaagtatgcagccctaaatcttatcgacccattaatatttcatccaaaacaatgtaacatcttaaactgaaacctaaatgtaagctttggacacaagcattcaaagacaggtatgttgtacagctggactatggtgagtcaagtaacattttcatttctttttttcttttagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcaggtaaagtcttcagcaacctcaggcaggttgcttcatttctttaaacctcagtctcttgggactatggaatggatttaataacagaacctcactggtaatgtcattggaggattaagaaagggcaaaggaacgttgtgagtacggagttctcagggcagcacttagcacatctgaaatactcagggccagaaataaataagttgaaggtaaagaatgtaggaagtattaactcttcaattaggttaaatgatgacttgcctaaactgatgtctgcgccatgactgtgggtgatttgatcaattcactgtctcacttttgcctcttatgactcttaatgacttgctgtaacataatctgtgttttaatttaagaagagatttacctaaagcaatatagagatccgtctcctggctctgtatttatatgaataatactggtggcttccagatctttaagaggtgcctttaagcttgcaaaactctgtggatttagtcccacttctttgagtgggaagacatgtaatttgaaagcacagggctcaaatgaaaggatgtagctgttggctgaaaaattaattggatgaaaagagtatacacataaccctgggtgggagacagcctattaagctgtatctcaggagacttaggtcgtactcctagctccacctaaattggccttgggcaactcaagtgacctgcccaagcctctgctttttcacccataaggtgaagaaggggaggggagtgtaacctctaagtgacctccgaatccaacattcagtgggtctccaggcaacatgtgatgttgctgaagctaaaaagaggaagaagatgaggcaggaagcaacagctaggaggcctggattccagcaccatcactgcctctcaccagcagattaaccttaggcagttttcataacctcattcctcagtttccccacttcctaaatggagataagacctaacccttggaattctatttaaagtgatgtgtttaaatctgacgtgttttatcacaagcgttaaagtttagctacaataatattaataatctaatattattatattagacacaatttgctataatgcttgaaccttgagtaaagacttccaaatcctctccccctgcaaacttgtaatttgtaacagttcattctctaaacctcgtgcatttgattgctttaatcatgttccggccctgcacatggagtgtgtggcttcagtgcagccattgtcattgtgattccttgccagggctgtgctgcaaagctttgtgaagcttagagagaagccaaaattgccctgttgtcagaataacccatttacagacgaaacaatcctctttgttcctcacacatggattcctagaacttgacgcggggcgctgtgagctaagggcacgtatgaagaattcccttttatgaatgttgttaagattacacagtgggctggcttgaacaaaggaaagcattcctaatgctgaaagaagaaaagtaagagtgaaaatacaagaggagaaaagacatgtcagggccacagaggaacagagatctctcagataaattcctccaaatgcccgagtagacaaataccgtgaatgatctttgcaaggcaggagtccttccgctgtcaaagggacccactgcctgaggctgtgagcacctgtggtctgagtcagggccaatagactagtttctaaaacatctagatcctaccttgggccaatatgagttttatgtattattacttaattaggaacttgtttgttaagatctgtgagatatgactgtagggaccaaagagtttttgttcctttactttaaaaaaatcatgctttgagtgtgacaggttttttttttttttttttttttttggagacagacagagtctcactcagttgcccatgctggagtacaatggcaccattgcaacctctgcctcctgggtttaagcgattctcctgcctcagcctcctgagtagctgggattacaggcacccgccatcatgcccacttaatttttgtagagacaggatttcaccatgttggccaaactggtcttggactcctaacctcaggtgatccacccgcctaggcctcccaaagtgctaggattacagagtgctaggattacaggattcttttgattgatttatgaaaatgtatatagggaacatatctgtatttgatgttcaaatccaaattctgtaattctgatattatggtaggcctgtgctatgtaacatgagatccatttgcagaaaaatttccacttacacttggagagttcttacccagtgtccagcagatgaagtattaatgcaattgtcattataccaattacaaggacagaaaacagttgaccgggctcggtggctcacatctgtaatcccagcattttgggaggctgaggtgggtggatcatgaggtcaggagttcgagaccagcctgaccaacacggtgaaagcccgtctctactaaaaatacaaaaattagctgggcgtggtggcgcacgcctgtaatcccagctcctcaggaggctgaggcaggagaatcgcttgaacttgggaggcagaggttgcactgagctgagatggtgccactgcaagactctgtctcaaaacaaaacaaaaaaacaacagaaaacagtttacaaactataaggcagaggtttattgaaataatatgattttcctcttttaggtgaataggaacatgagagacaatgtgggttgaggggctggaaggggcagaggacagacgtagaaatgagggaaggttacttaacagcagcctctggttgctcagtgtcagggaggaaaaacttttcctctgtcctcttaagttcagtacctgggggcctgcaaattaagctgataaaagacagattaacaggtgggcagggggaccttatttatatgcatataggagcttgaaaaagaagaaactcagtaagtagttaaagctagaaacttatatgcccagcttagtagggaaaagaggcagtgggggaaaaggcctctataggaggaacagatggatttctagaagaacaaatgagagataaagagtttgtgatagtgcttgttcatgcaggcctgagtgatctctgtatctcattcatggccataaaacttccctggagagaggacttacggtaggtttcttgatcatcttcctgggagtaaaagccacccgtaagagggaggtatggcagcctcatttttccagaagtctctgctttttgtcagataaaggaagcaccaagaaggcttctttctgcacctattgaatccccagtggcttcagtttaaaatgagttccataccaactcgggttctaagtgcatccctcacatcagcaattgcactctggtttcgtgagcctaaggtcatcattctgaatttggactttacggttttgcacttttctggtaatatttcatgtttgactagaataagattccttgctatcagatatttaaaaacaaaacagtatatacacaaaaatgcctttctacctgtaaataacgtgaggtacttgagtctgtgtagggttaggatggaaagaaaataacatgagagctcgtgagtcctggcttgactagaggacatttggaagtagattatctcatctggtgccttggaagtttattcctcaacaagcagcaatgggtctcctggaagcttttttagaaatgcagaatctcaggcccctccccatactgactaaatcagcattcgtgttttttagcatggttcccaggtgacttaccactgcaatttaaaagctctaatcttgtatagtgcttctcaatctgggaagcactttaaaactacctggggagctttttaaaacccaaaactacctggggagctttttaaaaccctgatgtcaagactatacttctgtcagaggtgtctgaaccagagcaactccatctcgaataggggctgggtaaaataaagctgagacctactgaaaactggttgcagtaaagaagccagctaaaaccatcaaaaccaagatggcaatgagattgacttctggtcatcctcactgctacactcccatcagcaccatgacagcttataaatgccatagcaatgtcaggaagttaccctatagggcctaaaaaaaggggaggcatgaatgatccaccccttgtttagcatataatcaagaaataaccataaaaatgggcaaccagcagcccttggggctgctctgtctgtggtgtagctattcttttattcctttttgttttattattatactttaagttttagggtacatgtgcacattgtgcaggttagttacatatgtatacatgtgccatgctggtacgctgcacccactaactcatcatctagcattaggtatatctcccagtgctatccctcccccctccccccaccccacaatagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctagaaaggacatgaactcatcattttttatggctgcacagtagtccatggtgtatatgtgccacattttcttaatccagtctatcattgttggacatttgggttggttccaagtctttgcaattgtgaatagtggaggaggagaggtgctctgctttttagagtttccagtttttctgctctgttttttccctatctttgtggttttatctacttttggtctttgatgatggtgatgtacagatgggtttttggtgtggttgtcctttctgtttgttagttttccttctaacagacaggaccctcagctgcaggtctgttggagtttgctagaggtccactccagaccctgtttgcctgggtatctgcagcggtgtttgcagaacagcggtttttcgtgaactgcgaatgctgccatctgatcgttcctctggaagttttgtctcagaggagtacccggccatgtgaagtgtcagtctgcccctactggggggtgcctcccagttaggctgctcaggggtcaggggtcagagacccacttgaggaggcagtctgcccattctcagatctccagctgcgtgctgggagaaccactgctcttttcaaagctcagatggaaatgcagaaatcacccatcttctgcgtcgctcatgctgggagctgtagactggagctgttcctattcagccatcttggctcctcctattcttttattcctttactttcccaattgatacagtttgactatgtccccacccaaatctcatcttgaattcccatgtgttgtgggagggacctggtgggaggtaattgaatcatgggggcaggtctttccatgctgttgtcgtgacagtgaataagtctcacaagatctgatggttttataaaggggagtttccctgcacaagctctctctttgcctgctgccatccatgtaagacatgacttgctcctccttgccttccaccatgattgtgaggcctcgccagccgtgtggaactgggagtccattaaacctctttcctgtataaattacccagtctcaggtatgtgtttattagcagcatgaaaacaaactaatacactaataaacttgctttcactttactctatggatgcaccctaaattcttggatcttgcgtgagatccaagaaccctctcttggggtttggatcaggaaccctttctagtaacacttccatgcaccatttctatagtttcttaccagagaagtttctctgaacatgtggagcaccggaaaccacgaggaggcggctcagcattcactcctgagcatgaagctggctcttggtggtgcttctctgcaattgccttttgctgctgatgatcactcttctcttcctttgggagagtgaaagggaaaggaagccatctgaagggtcttcatggttattttttaaaaagaaaaatcccaatatctagtactaaacccctgacggaccaaatcagaccctcggggggataggagggacacaggtgtgtgtgatgtaaacccccctccccaggagtgtccagtgtgtgaccaaggtcaagaatcactcaccaaatgaaagaagggtccctttggtaagtgcatcaaaataaggttaccaaaagaaaaaactgaatacccaaatactgcccaaaacatggtttatgaaaaacaataaagccgttaggtggttaaatcacaaatagtaaaggctgtaccatcaagcttgcaaagagaccaggctctccggccattttataaggaagctcactcagaggagatgtttttacctaaacttgaggagaactgatctgcctgtttgcaactggaaagcagacttgaaacaaacaaatgaacaataaatttgcagtgtggggcaggactcggtggctccagtgaaagcacctcattatgaggaagatgtgaaattattactgtgttttgaattggctgctaacctactctgaaagatagaaaaagatgctgctttaaaatgagggctgtgcttttctgaaaatacagcaggtgccttgctgtgaagagtaaggaatcatatggccttatggttaaagggatcttggcaaaccagggctactcaatccatacctataccaggatgtttgcatacctataccaggatgtttgttttgcaggaacttggtgttagaatggaaattagaattgaagacatctacccataggtctggtgatctttctgctcccatacctgtctttctactgtctgagatcatagtaaatgataaaaacagaaaataggttctaaggtatgctggctttagtaataagattctttttctcatctgtaacactactgttacacttctataacaaacactatttgttacctctccaatgtcctttgggctctatcagtgttttctaaaatgagggacatttatgttggtcaggttgtgcactgcacaactataacagatgtcatttgtagtgcagtctctggcttctggagcagtgcagcatgtagcctagatagggggtcgccattatgggaagcaaatagacatggcctcgtgtaacatacaaagcaagtcatttcctgttcatttgtctttcagtccttctgattttataaagagaaagtctctatttggttctggcacgcttttaacacctctcccatgattgtattttaccttataataaagagagaacaggcttctggttagtgcctcacaggcaatagaattactcagtagggatgtaaagttttatcaatagatttatataaataagaaatttaaccaattttgtgaaaataagtaaataaataatacttggattttacagtatatgtcaagaaaaatatgaaggtgattttcacatgattggagtttgggaaacactgggcagtagagaaagatcaccccaagcgctagggcctagcatggggctttaagaacacatttttatagggggatgaggtaaacaaaagacttacacattatgatttaagttgacttgatttaaaacaattctgctctattggaaacatccaatctttttttcttctagttatttccctctttgataataagtacagcctgtttctaaaccattatatggtccttaggaatatttttagaacagtagttacaaggtagaaaaagtaacccccagccctgagttaaggtttattttaaggtcacagaatgccaggcaattgccgtgatttacctctcagaattatggactctgttgtgtttcttcctttttgtctaatttagggaatcttatttgcttggaatgaaaaggatttgccagcaggaagacagccacagatggcagtgcacattctgtaaaatacaaaaacaaaacaaacaccagaaaaaataaatccaagagtctgatcccataaatttctgcactaaggagcaactccaaactgcacaccaagctgctttaaaaggcgtttgtgttaagccttagagtgttttatcacattcgtgatatttgatacagaatacgtcagaccaaaagccacatcctaggatcttctttaaaatatcattaaaatagatgaagcattttaagatgtaaagtttcatttcctaagggatcctctagttgtaaagattgcagctagttgttgttgttattattatttgagatggagtctcgctctgtcactaggctggagtgtagaggcgtgatctcggctcactgcaacctccacctccggggtacaagcaattctactgcctcggcctcctgagtagctgggactacaggcacgcaccaccacacccagctaatttttgtgtttttagtagagacggggtttcaccatgttggccaggatggtctcgatctcttgacctcgtgatccgcccgcctcagcctcccaaagtgctgggattacaggcatgagccactgcgcctggccacagctagttattttaaaggacttctagtaggtccaggctagattctcagcaaagtttgcatggtatgtgatgtgtggtgcatctcaccccagaaaggacctgggagtccttctgtaaattgctagcaggtgaattcacagcatccactgtaaccttaagttatctggttctctgccctaacgctaacctgcatctgacactgggaggtccttgaccaggaattctcacagctcctccaacagggaagtgggtaggagatggaaaattcagaagcaggagtggagggaagggagttaacacccaattctccacctcccccagaaccaaggccaggattgtcaagaatccagggttgagaatcccctgccaagctggtccagtggattcactcaggttggcagagtggctgaaaaccagccctcttaggcacgtgggtcttctcccagatatattaggaactagatggaacttggcacttgggatcactcagtgtaacaaccccatacccccattagacttgagtatacccagcactgagctaggaactcactcaggcttcccgtcaccacatcggacactttaccactggccacagattggtttctgaagacctcttacctccatcgttatgacttctaagttgatttctgtctatattccaagtttcctttctatcatctggccataaaatatttttatatcttcatgtgcaaagagttatggatataaagaactttttaaaattacatatatcatctattctgttttctacctaactacaagctgatcattggttttctttaccacctgcaagcacttaaaagtaatcattcctgctcttataattacatctgaattatttctgaacagatcccttttctctccttatgctaagactgcatgattaatgcatttttatctctcacactcagtctttttattatgttatttgtctttttccctcttcagtcaccaacacagttcacacttaatcgtgtgaagaaaaactatcatcccttgcttgctaatgtgcattttcctgcaaagatccaaattccacttttcctgcaaaaacaccaagcgcatttatgtatctcaaatcaactatggtattagtcttacctatttttgcctggtcattttagttgtatcccaccttttgtttctacagtgttttcatagaaaatcagtttctacagtgttttcatagaaaatcacattgtatccatgattttgttgagtcaaaggatatgtgtgtttttaattttgatactactacaaaccatcctctaatgatataatccgattgacagtccagcaatctatgaataccttttccccacatcctcaccaaaacagtgcatcatattattcttttaaatgtggctgttctatatgaaaaataaaattttcttgttatagtttgtatttcattaattatgagttgggttaagtatctttgcatatgtttatatatcatttatatttatttttccataaactccctctttatattctttgctccaataattatttatatctttatattctttcctattgatttataagtattcttaatatattaagtaaattagtatttttaatgttttccttgtttcatctcaatttttttgaatttatgggatttttttttccatgtaaaagttactaaattttacatggtgaaatgtaaagtgttttatggcttttgggttttgtgacataccttctccatttagaacttattttttaaattattccatgttttttataataattttgtgttttatttgtaagttctacgtattttcttccctggaaatttatttgggtggaaggtggaaggtaaaaatctcactttattttttcccaaatggcccactgttccagccccattggttgaggctccatcctctccacctttaccatcttctaaattcccttcatttctgagtccctactggactctctggtctattacattgatatgatgccttgtgacatgggagcaaactgcagtacttatcattgagcttttattatcacatttagtggctcatagagctaatttccctttttttctgagttttttttcccagaattttcctgttcatccttgcacatttgcttttcccatgtggatttgagaattttaatcattttattggaattgtttaaaatttttactgggattaaggtttatgtataagttcattacctggtgatgcccagttacaccatgcgtgtcttctccatctctctccaagttgcgaaatgattcagataagtgtcatccagattttaatgtgcttagaatcacctgggggaaattagcaaatgcagattcagctggtcaaacatgggattagagattctgcatttccaacaagctcccaggtgctgctgatgcagcgggtccctggaacacactgggagtggcaaggagataagcagccttgaggcactgcctctggtagatttcataggtttcccctggaaaaccacttgagcccactgcttcttgtgggagcagatctttgacaactctctcaagttattttatgataatctgtctaattagattttctttctcatctaggataatacccgttattttatctttttctagaaattcgtgcatttaacctaggttttcaaactcattactgtggagttgaacagaaacttgttaataatttaatttccattccctttttcgtgttttttatattgaatgtttctgttgaccccccccccttattgattagattatgtggctttttttttttcttttctcaaagaaccagctcttagatttatttgtcaattctttgttttctttctactgtcgtgtcttctttaaatttatatttgctggcctctaactttctaatttgaatgtttggctctctctcttattttccttcttggtggggtgtgtgtatcatggtcttataagaatgtgaaccgaagtcaacaaatcttaaactccagccatgctctcttctgaccacacctctgctgccccagccccgcctccaggactgcaccctccagatgtaattgacaccaatggcttgcactagactttttgctaagggacctgaaaagaacttagaggctggcgtaagttgccaaagccttcccacatcactgagagaatagacttggcaggcttgtgttttgaaaagcagttgggggtgcgctctgtcaaggctcagccatgatgaagaaataatcaaagagcaaaacgtcacttaagtggctaaacatgactggcagcagggttggattccccttcagcatcgaacacctcacaggccatcctctgtgtagacgggctgctttctagtggctccacaggcctggccgtgtcaggggctgcctttattcaaagacttctgttctgtcttaaccaggatcacttaactctctgaaactccagtgataaaaaagcaaaaccggcacaaacatacagctttggaactatctccaaggtcattgttttttcccctgccgcgaatttctttcattcctaattttcctctacctttctttcccttcatcccctacgatagattttgaaccccagggaggttaggactctgtcccgttcttctccctgggctgtccaccctccgacccccaccccacctggcatggcactcaaaggtgcattttcctggggtctgtgcatggaaatcattgcagctgtcagcctgtgtcacgtggggctggctaagtgcggggcaacgcggttgtacatgttgccatggtgacttctctgttgatggcagaaccactgactccagcaagtcacagtattcatttttgcgtcatgctcgtgctacaggaatgctatgagtagcccatgaaaagggaggcgagttgagctcagtgttatcccttgacttgtgtgtctttccttacccccagcgatcccccattcagatgcttcctactgtaccgcatttttgagtattcttcagtatcatgcttctgttacagcaccatatcactcagctatggaagcactcagaggagcacaacaccctctaaattatccgccatcacttcttttacggcctcatttaaaaagacaattgtcagaattcccaggtgtgaattctcacaggggaatctctgtcagtcaccacctggaaatgttagttccacctctgctggccaatcagcacctcatgtccttgctatgatctctacagttgcagaagcattatcctgatgaggtttttaacacatcaccacatgcttttcagagaaaagtccttttataaataccaataactaaacatgataaattgcttcactcctttgagatctttgtctgattccacgtgctctgcatagactattcagaaattctaaagacggatgcagattcctaattctgctgttgagtttgttcctgagagcaacgctgaaagacttttaaaaaattaaaatcagctttatgttgaaatgtaattgtacataaatagccatatgaatgtggggtacagttattttaaacatagaaaataagatgaattgttttggaaattcccctttaaacatgctaaaatgattttcaatcattgacgggaattttaacttttagaaaactggaaaggatacagacaaaagtagtgataacttaaatttgtaaactattttatttgttgaaatgctttaatgcatgattttgttttatcctggaatggccacatgtggtaggcaaagtggacattatcagccacattttaaagataaggaaaatgcagctcagagaaaataaatgtattcattccctcagcaaacactgactgggtggccacagaagtgcggtgcacaaccctggctgcacatcagtcacctggggagcttttcacaaatcccaatgcctgttccccatcccagaggattcctggtgtgcatcaggattgtgaagcaatggggactgagtttatagcaccttactctaaagtatgcagagactagcattatgaagtggaaaatgcatatatttcagattcagttatttttttcccactattccttcctctcaatgaaaattttggagtaaaacatataattccagttctttattctgaactgtcttactattttctatcaccctttaaatataatgcagaagtctggaaggatatgtaatttgcatacctgttggtgaaatccctgctactaaatacactttgctttttcttgttccacattccccttttcgacagggaataaatcatccccaaggctgctagagccaattaaatattttttcacactccgttgacatgaatgagaagaactgtgacagagccacacggctcatgccaggactttatcacgctatctttataatgatgtgagccaggcaccagggaggaatggtgtggggaaccatcaggaagctttaataaccaaggataatttgtttcatcagtttctccttgatggccatttgccatttcacctgtcaggaagcaaaactagttgtcttgtgagatctcaggttaactcaagaagagaacagctcagacaacaatggaagcatatttagcatggagcttttatactcagttctctgaagtcagccttcttggaagaaaatacattgtcttgggattggaattataaatttcccttgtgctaatgcaaccgaaaagagtatttcaaaaccaagagccgaactgggcattcataaaagacttaaaatatgtgtagaattaatttttaaaagcactttaggtttgcccatgccccccttctaaccgcacagtggagacagaatctggtcagctgtctgtggtctgggtgactccaccatgttctcagcaacgctcctcatctatgtattatactagtttctgaaaacttaagaataaaaaggatcaacctcacattttgatgaaatagcagttacaacacaaacatcccatgcctattggcagaactggtccacagagcacagaagcacattcatcgtgtaaagctgaaaacagcgtcttctgcaagttgagataccgaggttccagcagaagataaaaagcatttaaaaatatttaattattcactgaactcctttgaaagacacaggatgacaaagcagatcaataatattcagccatttccaaagggtccatccacagccaaagtatggcctttgaatttactagaaatttccacagagggagagtaaaaggaatcccttcatccttgcttgagtcctaaaataacatgcgcctaagtattctcacaaatgatgaagcgcatctcttgagtagacttaaggtgataaaatgttattttcactgagctcccaagccatacatcatggaagtccaaagcccttactgataattgcataatgcccaggggatgtgtttctctgcagaagtctgaagacaatagatccagggtctcctgaagactttcatcttatgaattgtgcgaatccctgaccactgcctaagaggaaaggtgaaatacatcagagaatgtccttaaaaatatccctttttgacttactataattggttgctttcctcttttaactatcataattttctcagccaccctctccctagaaactggggctatttctatgactcagcaaacaaccaattcttgctaatactgctttgctaataaggaaaccacaagttctcttagctgagactcctgtatagcaggtgtgttcacaaaacttggtgagcacccatatctgagacacagcattccataaagccagaggcagtcaccgaggctgtctgacataccataatatgcccgtatggcttcaggctttccaccctgatctggctgtatcccgcattgcacccatgcagcagcagaaccagcagtaagaatgttttgtcaaaaaacaaatccataaacttcaaaaaaatccacggtacagtatttttaaaaatacgtctagccaggcgcagtggcacgtgcctatagtcccagctacatgagtccaggagttcaagatcagcctgagcaacatagcaagaccctgtctctaaaaagaaaattttaaaatgcatctgttctctctcatatatgcctttaaacgcatccatagcatcaagaacctaaatgccaacatcccaatatttttcctccctgataaacttgctttagagattcaacttgtatttttgctttgaaccaggaaaggtatccaaggtcatactaagataaccatttattaaactctttggctgttttttcctaaactgtaataaactccccctctccaacattcaaaataatagtaaataattctctctgaaattaacacagtgttcctattattgctttcacaacactaaaaagaaatagaactaacggagtcgaactgtggggcattctggcaggcaaatcattaaattcacacaaatgattcggccaagggaaaaaggacaaggttctcagaaggaattatttcagctccctctcagacactgctttaaattaaaacacacacacacacgagcagctgaagacctgagtcaccaatggtctacattaaatttctgcaactgaaagtcaggcaggtattcaagcactctgggagcctgttagaaatacagatgcccaggtcccccacccgagaccaactcaggcagaagcagcatttttaccaaagctcagggcatccgtatgccccttaatgtttgaaaggtctgaatcagagtgctctcccccaaaggcatctcagactgagatagaaattgaagaaaaagcctaaggaggttcagcaactttttcaaggccgaagaacccaccagttacacaagtgcagagccctttgtccctgacattcagagccctgcatgcataggaagtgacagccccttccggggcaccctgctgccgccacgcgcattctggaaactgtgcagcaggagaaacagcgttttccttcagaccggggtttaaatggcacttcccgaatttatattcccctagatttggggcttcttccttcttgcactcctgttaacatcagcatgaattcataaactccctgcagcggaaaggaaaagaagccgcgacaaacctcaacgaagagccgtacggcactgttaaccaagtgctccagtcctgccccagtgtttacaggaaattggttccaggacccccaaagacacccaaatccacagatcctcaagtttctgatagcaaatagtgtggtaaatacctacatataacctacacacaccctcccatatactttaaattgtctcttgtagattacttgtaatacctaatacaacataaatgctatgtaaagagttgttggccaggcacagtggctcacgcctgtaatccaagcactttgggaggctgaggcaagcagatcacgaggtcaggagttcgagaccagcctaaccaacatggtgaaacccaatctctactaaaaatacaaaaattagccgggcatggtggcgcatgcctgtaatttcagctactcaggaggctgaggcaggagaatcacttgaacccaggaagcagaggttgcagtgagctgagattgtgccactacactccagcctgggcgacagagtgagactccgcctcaaaaaaaaaaaaaagatttgttatgctggattgtttagggaacaatgacaagaaaaaaatatctgtacgtgttcagtacagctgaaactttttttcccgaatatttttgatctgagtttggttgaatccacagttggggaacccgtggatgtggagggccagctggatagctgctcctggcagtgaggctctctgatccagactttcaaggttcaccctgagaactacagtaagatacatgagagagtcctgaatgaggagtcgaaagacctcgtcctcgtagcagcgactctggcacccaccaaccatgtggctttcacctaattatcatccattctgcatttttgcctccttaactgtagagaggttgtggaactacagaatctataaaggccagctgtcacaatcaatactttacaagtgcccacaatattttacaataactttgaccattgatttataaacaattataaccaaacattaggactggaacaatttgcccacctgagaaataacaagacatttatctcacatgaaaatggacaccaaataccttaccttcgtgtttattttatgaaatacaaaatctgagcatatattaataatgagctatttttttcttttttcttttttttttgagatggagtcttgctcttttgcccaggctggagtgcagtggcacaatctcggctcactgcaatctccgcttcccgggttcatgctattctcctgcctcagcctcccgagtagctaggactacaggcacccaccaccacacccagctacttttttgtatttttagtagagacggggtttcaccgtgttaaccaggatggtctcgatctcccgacctcatgatctgtctgcctcagcctcccaaagtgctaggattacaggcgtgagccactgtgcccggcctaatgagctattttcaattaaaatacctctttatcgttaatcagacaaaagagtacaatgtcagcctactctgagagcattaagaaatctttttcctgaaaggcaattgagacaattcagaagttaactaagtaactgatggaaagagggagtacaatggaatcaattgcccactcagtcctttcatataaaagttggtttaaacaatcataacatatagccgatgacgacaaatttgtttattctgtttctcttcactcgacctcttttggtcactggatcttggacaatcatgaaagcagctgccactttctcattcctttaagaagctggaaatgtaaagcttgtttaacttttcaagtcaggagccaaaaagtcacaatcaccttcccctgtttgaaattggaaatgctggctggctactttttttttagaaactaggaagtgaagggtagagagagaaatgtgaaactcaggatcatgtcagtacatgccacataatgctctgcctacggaaaaacctgctgacttagagaaatcgctccctcccaaaaatgtgattagcagggatcctctcttaaaataaaacaatgtcccttatatcttcagcatcttagtcgataaccatttgttttcatatctgtttcagaaatatcaatagtgaatggctaaaaacattatttaagaaaaacaatcattttctgctatataactcagatttgaaaacagaataaaatgtaataaaacaaagaagctaagaacaaaggcagagatacctcatctcgcccggacccactgtaaaaataatgttgcaatttaaattaaattataattaatagcagcagttttgttgaagtgtctcaaattattactttagatgctgaaactccagtggtttccatggagatattttctctaggagatgtcagatatgatctaatttttttgtctctgatatatgacaacctgaagcttccagagcctttcattttggggggttttatgttagatatttcaatttatttttatatgcacttcaatatgttttgtttgcaattggtttctgagcctaaatattttgaaacttagtaaataagaaccacaaccaccaaatttatcttctgtagttaaaaaaaaaaaaaaactttactctctccttattcactaggacagacaaacatacttctccttgggtgaggagcatagtagtgcatatgtgtgtgggcgctaaagccttagccaggatgtttactaagtacgttcctgggagaagactctcccatcatcaattcctccagcaatatgtcctgcctggcctgtgcttggtggaggaggggaggagagctaatctctgagtggtgcaatggaaacatggtctacaaatataggaacacggatgactacacacaagggcacgtgcaagggaaatatgcagaaatatgtgggcttttataagactctaaatcagactggaatggcaccatgctttggtggttaacatggagtgtcatttggggatccgcaagagaagtatgttgaatagagtctgtgcttatttgatgaaagactggtcttgagaatgttatagctagtctgttttaaattaacacgccaaatttggacctactcactgtttcccaaagtataggttccttgatactccaacaccactaaaattgttcagctctcccagcaagctgggtgaggggaacgtggatgttagcagtagaataggtgagctttattatccatgtctcagtcatgtttcttggtctccgtttttctctgtgcgcatttccaagaggatgtttgttcccaggggaaaggtcagtggcaataaaatgtatctatcaaaatagcaattgtgttgatcgccagaataaaatggctttgcctcaagggggtaagcactcacatgcattaggacaaccaggcttacagcataaataaatccaggaaaataggagtgctcacactaaacaaacaaaagattttgcccttgaaatgtataaggattcctgacctgaggattttctacaagttattttctaacaataaccaaagtccagcggactaggagtcactaatatattttctatattcaatatgtccatctcctttgttaggaagaataagaaacctgcctcactgtaaggatttagttgagactaggcatctgactttcaaaattctacctgcatagaaggttttgttatcagaagaagctaccgatgtttacatacctcttaatcaactgattttaattatgccagccaatgaacatccatttagcccttgctactgcattgttagtcactggaactgcaaacatgattaagattggtctctgacttgaagaggatgactgtcatgtaagaagtcacaagaattaagattattcccattgagaaaagggacacacagtctgaggtcgctgaggatactttcaggaaagtggtaagatctgatggacaaagaaaaggatagtaaaccagatgtccagacagagtgccatatggcagagaaaaggtgtgtcaactggaggcatcaggaactcctatgagacgggagagttccctagaccccttcactggacttgcaacagggtacagctcactcaaaccttttgcgggacggcgagcacacaggcaagtgggtgccaccgctggggtgaacgcttttggtctccagccccacagcagcatctaggggtatgttacaattaatgctgttttaacagttactgtctggggatggctaagtgttaaccagctcattggagacagggtgacagacttttaccccctgccctcttggtacccaggtccttgtctggcatccaggaagaatcaggtcacacagttttattgagtgatggaggtggctctcagtgggatggggagctggaaagggatgaaatgggaagataattctcttcagtcatcctcagcgaaactgctttccaactgtccagttacctcttcaacattcagatgctgcttctcctcttgatgttcagccgcttgttctcttctctcctctgccacactgctctgctcctctgccagtggagcttggggtttttatggttacaggactggggggcatggcaggccaggctggttttggaaaaagcagcatttgggtgggaaaacagggctgtgaatttctcatttagggctgtgggctcaggtttgtgtgtggaacccttgccagggactccaccctcttctacccagtatttccctgcctcctgtccatatcacctatacctagaatgttgagttggaaaagtgaccccaggaaggaaggggcaggagagaaatccagctcaagggagtctttcttccctatgccaaggagttcagatttacacccaaaacaatcgtggaatatttttaaatgttcctccctagctcttgtcattctccttgcgtcatctcaggtaactccttccactatctccgtatgttctgctactgtttttatccgtaacctcaagggaaccagattaccattgtaattttttttttttttttttttttttttgagacggagtctcgctctgtcgccagggtggagtgcagtggtgcaatctcggctcgctacaacctccgcctcccaggttcaagcggttcaagcaattctcctgcttcagcctcctgagtagctgggactacaggcacgtgccaccatgcacagctaatttttttttttttttttttttttttttttttttgagacagtctcgctctgtcaccaggctggagtgcagtggcacgatctcagctcactgcaacctctgcctcccaggttcaagtgattctcctgcctcagcctcccgagtagctgggactacaggcgcacgccatcatgcccagctaatttttgtatttttagtagagacggggtttcaccatgttggccaggatggtctcgatctcttgacctcatgatccacttgccttggactcaccgtgcctggcctaccattgtaattttttatcactatatttaatatatttcgaaggtacatattatttaaagaaggtcggccgggcgcggtggctcacgcctgtaatcccagcactttaagaggccaagaccggcagatcacgaggtcaggagatcgagaccatcttggataacacggtgaaaccccgtttctactaaaaatacaaaaaattagccgggcatgttggcgggcgcctgtagtcccagctactcgggaggctgaggcaggagaatggcgtgaacccaggaggcagagcttgcagtgagctgagatcgcgccactgcactccaacctgggggacacagcgagactccatctcaaaaaataaagaaagaaagaaggtcatgacggggcaggggataagggaagacaaagaaaaaggaggtcaggaaatttctgcgtttatcaaaaggagacaggaaatatcactcactcacaaagtatccaaatatctagtaaatatctccacctgggtgccccattagcacctccaactcaatatgtccaatacaaaactaattaattcctcatcacctaaaagggctcctcctcccatagtcccaacccaagccaaactgtctgcaagctgggacttcctcaacccttcaactccttgtccctttctagccttcaaaaggcagggtagagaagattgttgactttggaacgaaccctacacctgggttctaattttaactagactattcacaagcttggtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataactgaaaccacatccatgcttcagtatataatctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccacactacctaccccagaaaatcctgaagggaaatgggaaagtgagctgatgagaaagtagctgactacactgtactacatgttggctctccccatttccctgcctagctaactggatttaggattggaccaattggccgggcatggtggctcacacctgtaatcccagcactttgaaaggccaaggtgggaggatcgtttgagcccaggaattcaagaccagcttgggcaacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccactgcactccagcctggtcaacacagcaagaccaaatcttaaaaaaaaaaaaaaaaaaaaaaggattgagccagttaaaacaagcaaaaaccatcagtggtctcttttgcatcccccagttaaagacttggggaatatgaaatccttgaatacccaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcatggtggcaggtgcctgtaatcccagctacttgggaggctgaggcaggagaaacacctgagcctgcaaggcagcagttgcagcaagccaagatcacaccactgcactcactccagcctggacaacagagtgagaccctttccccacactgcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacgtttataatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactagagcaggccagctcaggtagctctaggattctctaatattgctccaagtgggaagtcgtgtttacctaggccttgtgcaaagagaaacagcaggaacagggatggaggctgttgtgattcttgtgggagacaatggcaagacgggtccatctgaaatggagatttcatttgggaaaacaggaagtgttgaagagttgcatgaagaaataggtatcaaattatttgggatcaatagtatacttgactctgacacttgactctttctttctctacagccagtgcggattttccatataatccaggacaaggccaagctataagaaatggagtcaacagaaactcggctatcattggaggtaggtgatgtctagaggaggcttatatggggctactcaactatggaaagtaatagttgtcaataacatagtagtctaggaaaaaaagttttctaggtttttacattattcattttgctgtttaaagattatgacatatgatgtgaagaaatatagtaaatatagccgggcacagtggctcacctctgttatcctagcactttgggaggccgaggtgggcagatcacctgaggtcaggaattcgagaccagcctagccaacatggcaaaaccccatatctactaaaaatacaaaaattagctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcagtggcgggcgcctgtagtcccagctactcaggaggctgaggcaggagaatggcgtgaacctgggaggcggagcttgcagtgagccaagattgtgccactgcaatccggcctgggctaaagagcgggactccgtctcaaaaaaaaaaaaaaaaaagaaagaaagaaagaatatagtaaatgtaacctggctactttttaatgctggcttgtaaaaaacaaatagcagtggaaagctggacagactcagaataattaagtaggtagtagtgaccatagccaggacatttctttatccccctcggatatttttcagtcttatcctttcgcatccaaaatggtccaggatagcgtactataaaaaaatgaaaaggaatgctgggtgcagtgacttacgcctgtaatcccagcacttcgggaggccgaggcaggtggatcatttgaggtcaggagttcaagaccagcctggccaacatggtgaaaccccatctctaaaaatacaaaagttagccaggcgtggtggcgcattcctgtaatcccagctactcgggagcctgagacaagagaattgcttgagcctgggaggtagaggttgcagtgagctgagatcacaccactgtactccagtctaggtgacagattgagacctttctcaaaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttccgggtttgctagcagggtaggatgactatatctaacaaaaatgtactgtacttggttgatgaacccctaaatactatgacttgaccactattccttatatacgtgtaacaaattttctcatgtaccccgtaaatttgcacaatgaaaataataaaaactaaaaatgtatcagaagatttaacaagctgtagcatctaaaatattccagtgttttcttctcaccatggacagctacataataatttgactctcctcggatagccactgagcctcatgcgtagatcgatattgacatccctgttaccattaagatcccaatcctcactgtcttttgcttttttaaatgaacttaattgaagtataatacgcatctataagtgtaacaagtccgtaacttttatttattattattttttgagacagagtctcactttctgttgcccaggctggagtgcagtggcgtgatctcagttcactgcaatctctgcctcccgggttcaagcgattctcctgcttcagcctcctgagtagctggaactacaggcacgcatcaccatgcctggctaatttttgtatttttagtagagacaggattgtaccatgttggccaggctggtctccaactcctgacctcaagtgatccactcgcctcagcctcccaaagtgctgggattataggtgtgagccaccgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacatggtgtatctatacgtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgttgtttcattgcaccgggtaggattttcagtacaaaagtgaataaatattgagatttgacaattttgcattgttccctatgttaggggaatgtgtttgatctttcactatgaaataggatattggccgtaggtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccaggcgtagcagctcacgcctataatcccagcactttgggaggccgaggcaggtggattacctgaggtcaggagttcaggaccagcctagccaacacagtgaaaccccgtctctactaaaaatataaaaatcagctgggcgtactggtgggcgcctgtaagcccagctactcgggaggctgagacaggagaattgcttgaacctgggaggctgaggttacagtaagcccagatcgtgccattgcactccagcctgggcaacaagagtgaaactccgtctcaaaaaaaaaatatatatatatatatatatatatatatatatatatatatatatattgctccatagttttcttgtaacatttttctggttttagtgtcaggataatgctggtctcataaaatgaattgagtagtgttttctcctcctatattttaagaaagatgtgtaggattggtctaatatcattaggtaatgcttgttagtagtattgttcgagtcttttaaatttttgctgattttctgttcaattgttctatcagttactgacagaacagtgttaaaaaatctccaactataattgcaaattggtctaattgtcctaccagttctgcccgtttttgcttcatttattttgtacttaggttagatttatacacattaggaacattatgtcttcctgatgaattcacccttttgtcattatgaaatgttcttcatttctactaacaaccttgtcctttgtctcatattaacgtagctattccagcttatgattattgtttgcatatcttttcccacccttttactgttgacctgtatttaaagttcatgtcttgtagatatcatatagtaggcatcttttttatccactgtctctactttttaattggagtgtttagatcagttatatttacttctgttttatctaatctgtattatttcatccagtatttttttctttttccattttttttttttagacagagtcccccccccccccctcacacaagctggagtgcagtggcacgatcttggctcactgcagcctccgcctcccaggttcaagcgattctcacgcctcagcatcttggctagctgggatcacaggagcgtgccaccatgcctggctgatttttgtacttttagtataaaagaccgggtttcaccatgttgcccaggctggtcttaaactcctgacctcaagtaatccgcccgcctcagcctcccaaagtgctgggattacaggcgcgagccactgctcatttcagacattgtgtgtttcacctctacaagttccacgttgtctcattttttttcccctcattttgatcatgttttcctttaaacccctgtgcaggtttctaatagctattgtactgtcctcatctgctcattccatgctctgtcctttctgtttctaatagctattgtactgtcctcatctgctcattccatgctctgtcctttctggctctccttctaattgactgatgtttcttctggtcaagtgacattttgctacattttttttctctgaattatttttctctgcagcttgacgttatttagatgtgttttaaagctttttcaggacagagctagagtagtctttattctaggcctattttagcaaacaccttcagcatgaccattctatcaactgtattaaatgctctgattgttcaatgaggtctcttcagtgtggttgttggactataaacatctcccagccctccgtgagctctggttttttgcctggcctgtggacttttattctgtacatgcacatgttagtattattcggccacaaattcagagagacttatgtgcagattattagggttctttctatacatagctctctcgcgcgcccactctatctcccctctccattcagggaaaccactgtgctttcttgtgctgcccctccctacactgctgtccaaaaatcgctgccagccagaaaactaggaaaaatgtaggattcctcctttttgtttctctgttctcagacatcatggttcctttctgcctgttttctaatgtctgtagactgtcatttcatagactgtgtccagtattttagttacttttggctggaagacaagttactcctgtttttcctgttactccttcatggacaaaaacagacatcttacttcatttttgttatctttgttgttttggaggttgtgttttatatgggagagggctgtgtctgacggagctgtagtgaagtggggacagtgttggagggactcccaagccctgtctaacctctcgtgcttctcctttctccgtcaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggaggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaatttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatgtcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcctaa

SEQ ID NO: 2005 - DNA, 417244 bp, Homo sapiens
ctggtttttgcaaatagtatactagaattcatcctgtaagtattaaattttataaatatccaaaatgcctgtattttgccaaaaagtaaagccaccctatttcaaattttttaatctcagtacctacttttaggtaagcccattgtaaccacaaagaaaatacatacagagcagtgttccccagcctttttagcaccaagggacagttttatggaagacaatttttctatggaccagggttggtgggggatggtttggggacaaaactgttccacctcagatcatcaggcattagttagagtctcataaggagcacacaacctagatcccttgcacacgcagttcacaatggggctcaagcttccatgagaatctaatgccgtcactgatctgacaagaggcggagctcaggcgggaatgctcactcgcccgcctcacctcctgctgcatggcctggttcctaacaggccacagactggtaccggtccatagcctgggagttgggaacccctgtatagagcacatacaaaagaaaaacagaaagaaaaaaaaacaggaaaggagaaatgggacaaaataaatacaagacaaacaaacaaacaaaaaaggttaacaaaatggcaatagtaagtcaataattaccttaaatgaaaatagactagactccccaatcaaaagacagagtgactgaatggatttgaaaacaacaacgacaaaagatccaattaaatactgtctacaggagactcactttaagtttaaagacacacataggctgaatgtgataggatgaacaaatgataatctatgcaaatggcaaccaaaagagagcaggagtggctatacttagaatagattttaagtcaaaaactgtcataagagacaaaaaaggacactatataataataatatcagcagaaggaaggctaattcaccaagatgtaacaattttatatgcacccagcatcagtacctctaaatatatgaagcaaacactgatggaactgaagaaagaaatacaatattagaagacttgcatatcccactaaatagcagatagacattcagacagacaaatcaataagaaactatagaccaagtggacctaacggacatacacagaacatcccacccaacagtgacagaattcacatccttctcaaacacacacagaacattctccaggatagatctcatgttacgtcacaaaacaagtttcaataaacctaagattaaaatcataccaggtatcttttctgatcacaatggaatgaaatcaaaaataaataacagaaagaaaactgaaacatttacaaatgtatgaaaattaaatgaaatactcttgaacaatgaataggtcaaataaataaatcaaaagggaaattagaaaatgtctcacgacaaataaaaatgaaaacacaacataccaaaatgaatgcaatacagcaaaagcaattttgaaagagaaatgtatagtaataaacagctgcataagaaaagaagaacgcaaatcaacaacctaacatacctcaagaaactagaaaaaggaaaacaaacttagcccaaagttagcagaaggaagaaataatgtagattagagcagaaataaacagagtaaaaaaaaaatagaaaaacttgaagaaatattttctaaaaagataaacaaaattgacaaactaaaaaaaaaagagaaaaaaactcaaataaataaaataaaaaatggaaaaggagacattacaacctgatggcttcaatgctgaattccaccaaaaatttaaagaacttatgctaatccttgtcaagatcttccaaaaaattaaagaaaaggggatactttcaaactcattttataaggccagcatttccctgacaccaaagccagacaagaatattacaagaaaagaatactacaggccaatatccctgctgaacatagatgcaaaattccttaataaaatactagcaaaccaaattcaacagcatatcaaaaagatcatacaccacaaccaggtaggaagaaggatgtttcaacataaataaatcaattaatgtgctgcactacattgccagaatgcctaggaataaacttaagaaggtgaaagacttgtatgctgaaaactatgaaacattgatgaaaaaaattaaagatgaaaataagtggaaagacgtcccacgtttatgacaggaaaacttaatatcattaaaatgtccatactacccaaaggaatttagagtttcaatgcaatccctatcaaaattccaataacattcttttttctttattttattttatttatttatttatttattttgagacagggtctcattatatcacccaggctggagtgcagtggtgcgatctcagctcactgcaacctccgcctcccgtgctcaggcgatcctcctgcctcagcctcacaagtaactggaactacaggtgcatgctaccaggcccagctaatttttttattgtttgtagagatgaggtctcactatattgcccaggctgatctcaaactcctgggctcaagtgatccacccaccttggccttccaaactgcgaaacttacaggcatgagccactgtgcccgccccagcattttttacagaaatagaaaaaacaattccaaaactcatatggaaacacaaaggatcccaaatagctaaaacaatcttgagaaaaagaacaaagctggaggcatcacacttcttgatttcaaaatatattctgaagcttcagtaattaaaacactaaggtactgtcataaagacagctttatagaccagtggaaagagggcccagaaataaacctgtgcatatatgaccaactgatcttcaatagagatgccaagaacagacaatggggagaggatgatttcttcaataaatagtgttggggcattgtatatccacatacaaaaagaacaaaattaaacccttactgtacaccatacataaaaatcaactcaaaattaattaaagacttaaacgtaagacctgaaactgtaaatccttagaagaaaacgtaggggaaaatcttcatgacattggtctttgcaatgatttcttggatatgacaccaaaagcacaaacaacaaaagcaaaaacagagcaagaggtatactatgtcaaactaaaaaacttctgtacagcaaaggaacaatcaatacagtgaaaaggcaacctgtagaatgagacaaaatatttgcaaaccacatatctgataaggcattaatttccaaaatatataaggaactcctccaacttaagagtaaaaaagcaaacaaactgatttttaaatgagtaaaaaatttgaatagacatttatccaaagaagatatacaactgggcaatagatacataaaaagattgttcaacatcactaatcatagggaaatgagaatgaaaaccataatgagatatctcacacctcttagggtggctattggtttttatttgagggggtttgtttgtttgtttgtttgtttgtttgtttgtttgttttgagacagaatcttgctctgtctcccaggctggatggctattgttttaaaaaaaaaagttacttggtgttattaaggctgtggagaaattggaacccttgtacattgttggtgaaaataaaaaatggtgcagctgtgtatatatatgtatggaaaactgtatagaatgttctcaaaaaaattaaaagtagagttgccatatgatttaataagtccacttctggccatttactcccccaaaattaaaattagaatcttaaagagatatatggaccccatgttcactgcagcaatattcacagtagccaagatgtggaaataacctaaatgtctatcaaaagatgaatggatacagaaaatatggtatatatgtatatatgaatggatacagaaaatgtgagatagatagatagatagatagatagatagatagatagatagatagatataacagaatatcattcagccttaagaaaaaggaagtcctggctgggcgtggtggctcacacctgtaatcccagcactttgggaggccaaggcaggcagatcacttgaggtcaggtgttcgggaccagcctgaccaacatggtaaaaccctgtctctactaaaatacaaaattaaccaggcatggtggtgggtgcctgtaatcccagctactggagaggctgaggtgggagaatcgattgaatccaggaggcagaggttgcagtgagccaagatcgcaccattgcactccagcctgggcaacagagtgagactctatctcaaaaaacaaaaagaaagaaaaagaaaaaggagtcctgccataagtgacaatatagatgaatcttgagaacattatgctaagtgaaataagtcaaccacagaaggcaaatactgcatgattccatttatgtgaggtatcaacaataatcaaactcatagaagcaaagagtagaatgctggttgccaggggctggcaagaggggaatacggggacttgctattcaatgggtataaagttttagtcatgcaagatgggtatacaacgtagtgcttacggttaacaatactgtacacttaaaaatttgagagagtagatctcatgttacctgttcatactacagttagagtattagtcctttttcacactgctgataaagatatacccaagactgggtaatttaaaaaagaaagaggtttaattgggcttacagttccaagtggcttgggaagcctcacagtcatggcagaaggcaaggaagagcaagtcaagtcttacttggatggcagcaggcaaagagagagaacttgtgcaggggaactcctccttttaataccatcaaatctcattagacttattcactatcatgagaacagcatgggaaagacctgcccccatgattgaattactgcccaccaagtccctcccacaacatatgggaattcaagatgagatgtgggtggggacacagcaaaaccagatcaaatagaaatagaaatcaaaatagacaaacaaaaaactagaaagaatctgagagcctatacttcaaggtgttttacctaagagatctgaggaaattacaaacatgatcaccagcactgaaatcttgaacttggatcaaagtaaccctacataaccacaaaatgacagggatataagtctcagagactttaaatgaatataacaggttcttgtagataactcatatacagagatccaaaaatgaaaaacttgttttacatcctattcacaatatgtgtagtacccttttcccaaatacttgactgataaaaatacatacagatttttaacttatccagtctattacagtttatttgccaactcttagttccctcttgtgctacgtttaaatttataagatgagtacagagactttttgaataactaatttaattaatgaattttaaagttaacttttgtagagttttagatacgtcctttggtcatacagtttagaaattacattgaaaagtaatctaatgcaaagttttttgtttttttttttaatttaaaaggtttgagtaaatctttctttctttttttttgaggtggagtctcattctgtcgccaggctgcagtgcagtggtgcgatctcggctcactgcaatctgtgcctcccggggtcaagcgactctcctgcctcagcctccagagtagctgggattacaggcacacgtcaccacacctggctaatttttgcatttttagtagagacggggtttcaccatgttggccagaatggtcttgatctcttgacctcatgatctgcccgcctcagcctcccgaagtgctgggattacaggcgtgagccactgcgcccagccgagtaaatctttctttaaaaattactgaagctgagtttaatatactgtatttatttgcatcaactcaaaattgaattttatgccacctttttggtcagttgtgaattgaaattttataactgaaattgtttacaagattatgttaaagtagggctgagagaatgaattttaaagtatgattcaaggttatagattaaattatgttcttatatattttagtcactttttgaactattacaaatatctagtaaattttttaatgctctgcccctttaattctggtcatgtaatttaggactgaaaggtgagctttatcttggaacaatattatctttcatttatatgatagcaaaaaaattaactatactgcctttattcaaaagtgcttaaaaacaactatatgtttactctctccacttcattattttcttcctcagtgcaaatatgtttatctggaaataatgtatgcattgtagcatgcagaatgtcaagctattttaagagatgcaacataatgcttgctataaactcttatattcagtcctcatttcataaaactctcatgtttaacttgaacatgctttcatgtaaaagctcaacttaaaagtgtgcctgtttggatgataagaaaaaaaagcaaacaaataaaataactacacctatcttgtactctttaaaatatatatgttggtttttaaaaataattgcactaagctaaacatgagaacctctatattagcaacttacattaaaagcaagtcttttttgggaaagcaaaataaaattaaaagacacatgattttagatcactgatctgagtacacagatctaatctctttgccagggttgtgtatactgtacacgacatttattttatttttttttttttgcactcacttattttgatccagtggatcttgacctattatcaagagtgagtgaatattgctagaagtggtcacttcagtatgacttaatctgaagacagagaaaaactggttataaaagaggaaatatattagaaaggagagtatttttgtatctagcaacctggaatatgaatgtaaaagagaataaacagttcaacacagaatgataaagggtgccattgagagggtcttctggagttggttttgcttcattcaactatgaaatgactacatgtattcatttatccctcccctccctcattttgagggtataataaatgtgtttctcctttttctcctctttcttcaactctatctccttgaaagagaataaacaactaaaaacaatgctgcacccccactcaccttgataagcagcatgagtctattaaattaagcatgcttgacactcaaacaccaattttagggacagagtgctcaaaatagaaagcacaatggtgacatcctgttaccgtctctttgtgcccttggactcataaataaagttctgcaggtttctgtgctcccttgatacaaaataaagaaaagtgaatgagttagaacaagctctggcagccatcagtaatgttgcaccccattgctgcaggacaggagacatccaattatggagcaaggtcagcctcagtctctaccagtattttctctggtggtcaagagaccctcaccccctcaccaccaccaccaccaccaccacgattcccttctacctgatggtgctccgggactttatttttggatccttcactgcttgacttaagaggaggaagacatgataggccagtcagtcttggctgggttgtgggaaaagtgagaggacagaaccagattggtcagtttgtgaatcttgtgatcagctacttttagaatttatttgttgttaagtttgaccaacaaatttccatatccttcatgttttctcacaaagatctttaaattgcctttcccagcttcccacctaaatacattcaaccatcataacacattccaaaatacagtggttgcccatggtttgcccaatactgggcaataggcactcagatcccagttagtgaccaatatacctatgggacacaaatcatatcaatgaggcacagctgcagggtgcatgtctactaaggatactgctcatctgaaccctcagactatacattctggtaccttagttctgtctcttggtgccctttcctgcgggtaacccacattcttattctctctccatgcggcatgggcactctctctcctgcctgagtcatagttcctggagcagactccacccccatgtttcagatcctgcctgagtccactgaatgaaagcaacaactcctgcgtgtcactcacaattccctggatgatactaaaaagcaatctttctctcattttcgaaacccctttgagatattaatgacttcctagatttttttcaggacttagagattatttcagaaataatcatataataagaagcattttgaattggagactcaaattgctctttagatcatactatataatcttaatgatgatgacgatgataatagtagctaccattgaacaaatgcctactatgctaggtgccttctatcttaaccatggttaattctcaggggcagtcctcaaaagttaggatattgttcctatttctcaggtgggggaaatgactttcagcaggagtaactatttttattcatcttatagctttaaattggcagctagattttgaccccatgtctgactcgaatttcattttatttccacaacaccattcactgcgtagagataagaactgtgagctggtctaataattttttcttcctgcaatagaagtccttttctaaaatttgggtcaactctcagcactcgtaaaaatatgcatataaaaagggaaagaaatggaggaaaatattttcccattaaatactaagacctactatacactaagctacagtatttaaagcacacaatactaggaccaattggatggattatgataaagagactagacactgacccatacataaaagaacttggaatattatagaggaaacacgaagaattaatgaaaaaaggaaaataaatgatgttgcattaattgaatttcaatatttgaaaaagtaaaatagctttccctcctgaaacaaacaaaaaattcagggagatattggatctcaatgaaaagaacatttaaatatattaaaaaacaaaactttaaatatattacaggaatatgaagataatacctttatgatatctgggtaacaaaaggcaaaccacgtaaattaagtaaagcaggattttttttaagtaactaaactggtacaatttataaagtacacatactcctttgaaaaagtaggtctcatgtgaatctgctcaaattccagggctgtattcactttcaccaaacactaatgacctgaggctattgtatttttctagttttcctgttaaaaagagacatgagagtgttgactctcaggtgtgagatcttgactgatcccacacctagcccaactggaggcttaaggctactcatcacagagtccttctggagccaagataaatgcctatgaatctcaacttttattcacagctttcaatattagattttttaatattagattttaatatttttcaatattagatttcatcatttcctgtgcccatttccctagctcaagggttcacttatctttgataagtttattggctagatgtatgtacgatgactcactctccatcacataaaacatacaattttgacagttgataaaaagatgttcgcataaactataatcatataattaaatatgtaccagaaacctaaaaaatagggaagagggaagctgatagtattttactcacatttaactaaaaagccatacattttaaatctatgaggtaagaagaaaaatcaggaaatctgcctgaacccattagtgactattcatgtaggatttttttttttaattttattttttttgagacaggctgtggcccaggctggagtgcagtggcacgatctcagctcactgcaacctctgcctcccgggttcaagcgattcttctgcctcagcctcctgagtagctgggattagaggcacctgccaccacacctggctaatttttgtatttttagtagagatggggtttcaccatgttggccaagctggtctcgaattcctgaccttgtgacccacccatctctgcctcccaaagtgctgggattacaggcgtgagccaccacgcctggcctcatgtagaattttatggtcacaagcctgtagttctagcagggaaactcaacacataaaaaggaggcctttaaatgcattgtcaagaatgacgaaaggagctaagtatcattatattctgatcaaaagaaaaggcaagtgtccatttccaatctctctttctctctctctctctctcacacacacaccccccagcagatttgtaaagaaaggtaaataaatcccccatacaaaaagtttccttttttccccacttgggtctgagagttgttcagtttaacctgagttgccattagtgtccttcgaagctataaattttgcttttccatgcaattgtttcaaaacaaagaaaatctgtgactttaaaattactttagagccaagcatggtggcgggtgcctggggtcacagctactttggacactgaggcaggagcattgttttgagcccaggagttctgcgtggtagtgcactgtgctgatagggtagtcgcactaagtttggcgtcaatatggttaattcctgggagcgggaatcatcagtttgcctaaggaggggtgaaccaagccaagtgagaaacggagcaggtcaaaatttccattctgatcggcagtgggttccacctgtgaatagccactgcactccagtctggataccatagcaagaccctgtctctttaaaaaaaaaaaaaaaaaaaaatggctttagaagcaattttacaccctaacttaccaatataggtagcggtccgactttatcgccacaggaggaaaaaataaaaagcagagtaaaacttacagagcaatggtagatacaatacgatcaatacaatcttcaaacccaacttcactgagcatgagtttctacacataaaagagattctttcattatttcttttttaattatttatttatttatttatttttgagacacagtctaactctgatgccctggctttgagtgcagtggcgtgaacacaactctctgcagccttaaccttctgggctcaagggattctcccacctcagcctcctgagtagctgggaccacagacaagcgccatcacacctggctaattttttaaattttatgtagagacaagatctccctgttgcccaggatggttggtctagaattcctgggctcaagcgatcctcccacctcgggcaccaaaagtgctggaattacaaggcataagccatcataaccggtccaagaaaatcttttagaaaaccccatcaaacaaatcaccatactatttaactgtaagtccaaacaatagtttcaatcgtaatatttgaagcaactagtataaaaagagaaactcataagctagcttacatttctgttgtcaaagagtaatttatccttgctggagttggtttggaggtattaatagccggaattatcccaacaatattctggcaagaaactatacacgtactttctgatgtgctctgatgtggccacagtctggcgctgagagtagctccaacatgagggactgaagcaaaagggtttcccaaagaagcactgtgccccggagactggaaggagaatttgaggaagacattaggatgaggcatctcaggggtgtaagagagagaccctggaaggcatttggggccatgacttaattataagctaggaattgcgtgtgtagaatttacaaagtaaacaaaatggcagccgagggtggggatagttcacacccttagtaaaggctcgacattatagaatctgcctcatactaggattcccagtagcttttctggaaataggtctccttcctctcctgccagccctaaaataatattggtaacacacacaccaacttctagagagcactcacaaaaaaagttgtcaccgccaagtgacctcactgcttctccctggagagctttgcagacagaaaatagctctgtgtctttataaacaaatcactctgtgaatggcagtgggtacacaaacatgtcgattctcttccagagttcttactcgctcaattgccaggtttgcttctattttggttacagaattaaaatgtaattagttgtgtttttaatgagtccaaatgtgacacattaagattcagtaattactctaaaatgataagctgtgattgaatgtccccataaacaagggacatttaaaggcagtaccatttcttgctcagttgttactgcttttaaaaccgtcactctttcctgggtgaatacagttttaggatttaaatgattacgctggattattgcacatatttacagtcagagccagctataccgacatatttaaagtgtgtacgttctttgatcatgtggccatgtctacctaagaacctaataactgactttactgaatgttggctgtccaggttagtacctcattatgacttactggcttttaagacacgtttattttatgtggcatcagtttttctcttcaacctgatgcaagacctcactgctatttctgaggttctttatgtccttagtgtttggcagggctcacatcaggtctagaaaagtggtgctagaggttcaagatccaatacaacaatggcagcagtaattgatgcacttgccccatacggaaatctgatctcttaacccacctgtttcctaggctaactgaatcagcagcatgtcagtagctgccaatgctgatcaatttcctagtgacattggtaacttaaaaaacattgaaatagttaagttcgttgtagaagtaagcctttcatcctacagcaaatcaaaaacaaacaaaatggataaatgttttctgataacttttaaaacagtttacctaagaggaggaattgtaaaaacttaaacataaattgagatcatcccacctgattttttaatattcgtaggaagcctgttcatgatattccagtcaactactctagaatcctattttggtatctcagtatctcgtgcagcagtgaatagcactgctcaatattttagaggcttcatatttccttagagtcacaattgtcaccctaaaatttagatctaataatcctactactgtcctgtgtaggaaaaaatacagaaagcatatacttcttatttcccagccttcaagtatgtgaagactgctatcaagaccactgtgtcttactggccaggcgcagtggctcacgcccgtaatcccagcactttgggaggccgaggtgggcggatcacgaggtcaggagatcgagaccatcctggctaacacggtgaaaccccatttctactaaaaataaaaaaacttatctgggtgtggtggcgggtgcctgtagtcccagctactcgggaggctgaggcaggagaatggcatgaacccgggaggcggagcttgcagtgagctgagatcaggccactgcacaccagcctgggcgacaaagcgagactccatctcaaaaaaaaaaaaatccccgcttccaacagcagttctcctggaaccctaccttcccctgaattttgtcatatttatcaatgcctttcttatggcaaccagaagtatatagagcagttcagttcacaaagggctgtaaatacagtaggacaatacctatctcactttactttggacaaccagatgcttcaaaacttgctgatggtagattaacttttcatgtaactttatttattttactgttggcacacacggcatttttgtgtaaagttttctaatgatttttacatgaaatgatgtccagttataaatctctattctataccttgaatttaaaccaacaatttttttcacttaatcctattgtattatgtggtgttgtttttattattctaatctatttaaagcatattaatctcactctgaaagctgtataaaaacctctaaatctgggccgggcgaagtcgctcacgcttgtaaatcccagtactttgggaagctgaggtgggcagatcactagaggccaggagttcaagaccagcctggccaacatggtgaagccccgtctctactaaaaatagaaacattatctgggcgtggtggcacaggcttgtaatcccaactacttgggaggctgagccaggagaatcgcccaggagacagaggttgcagtgagctgagataatgtcactcactgcactccagcctgagcaacaaagtgagaccccgtctcaaaaaaaaaaaaaaaaaaaaaaaaaaaaaaaagcctctaagtttggttcatctgaaaatttcatgagtctgcttactcttacaagtccttgctcataatattgaacaaaaatcaccaagaatagacatgtgacacatacaccaacagaagtctctccccagcagttcaataagtggaaggtactctagctagcatctccatcgttcaactgtaccccagtatatcaacaaacacattatgagtggttcaaatgaatgcttttctgaaatgatgccatcctcaatggggaagtttcccagtctatcaatctccatgcagcataatttgtagaagtcctacctttcatttctagatgctaatcgatcttctattcaatggaagatctagcctactggtgtctcattttttattcttcctacaatttagaaaatcagatcagcataagaactttatttttaacaaatattaatataaaagtattacgtgtttttctactgcccatatctgttctgtccaagccatgtacattcatgttaaataaataccgtcttttaaaacataaatagcatggttactccacattgactcctgatgtcccaagatgttcaagatgcagtaaggagaaatattattttaaaacaattcaaagggagtgaaaatggtagcacacaaaggaggcagcatttcctgcttctcacaagaccatctgcctgtattgtgggcaagattttttaaaaatcctaactgaaaagaaaataatgttaagagacatatgcccatgtttacaagctgagggaaattgacaagtgtgtctgtttcgccagtatttttacagtcaactgttatacataatggggaaaattaaaatcggtaattacttttctagtctgccattgttttaaatgtgcttggaattttccttaagcatccattccaagtaattatttgtaataggccagaacacttaaagggttgtagggatggatacacagctattttacaaagtgaaatactttgacaataacaaattatttttcctcctttctctccccaatgttggctgagttatgtttatacctcactttgtagataatccttctagctacactttttttaggcacagccattataaaaatcttctgtttgggcttggcactgcttagaactagaaattgctatttgctgcctgccaattacagaataatttaaggtttgatgctcccaggcacagtttcttgaaatacacagaaaaaaatatattaaggtggatgcataatattttttctgcattgcatagcttcaattgcctgtatagaattatatccaaattgctaaacaaatcaattggagaaaaattatgtcttctaggaaagtgttttgtaatggttttactactctttcttttgataagatcatagcaaatattttacaaaaattttatattatttgcaactgaatgatttcaatctatgaaatgtgatgggtataaatattgatataattttaacataaaatttaaacttctaggaaataatagaggaagatgtgatttttttaaaatcaatttggaataattaagaagaaaagaaaaaagagagttaattaagtttcccggatcttttcaagtctaaaatgcaataatttttcatctttgtatattcgtatctgaattatccatcatttgcagtacgaagcaggaaagcggtaaagcaaagtaaatttgtgatttaaaaggatcaagtatatggttgaagactcaaaaagctttttatttgggacagtagaaggaaatgtgctgattatcatgagaacaacaaaaaagagaaatgagttatttatgtaaccctgtcatcatgcctacaacacctcgaagggcagtcaggcatagtctgttatcaggaaaagcaagcaaacaaaagcctttatatatatatatatataactaatcacaaacatgctcagactccagaagatggtaaaataaaataaaataaaataattttattgacttctttcacctaggtgccttggttgcactccctggaaaccattcttcgcattccccacttacttctcttttcttttctttttttttctttttcttttttttttttttttgagacagagtcttactctgtcgccccaggctggagtgcggtggtgccatctcggctcatggcaacctccgcctcccaggttcaagctattctcctgcctcagcctcctaagtagctgggattacagatgcgcgccaccatgctcggctgatttttgtatttttagtagagatggggtttcaccatgttggtcaggctggtctccccacttttcttaattcacccctgaaatacactacccaaacacgtagcaactgaggtctggaaacttcattcttgacttcttctaaggaaggccactttcttcaaaatacagcaagacaaacacatctagctcctagcatgacttcagtgtgaaaaggctgggcttgggagagcagcaggtagacatgcctattaacattgtgctgccatgtttactttttttttgtttacttaaatcatggacagaaagccaagtgtataagtgaaaacccaagggacaatgacatggggtagactgcagaccaagaataagcaggaagttaaataccaagatattcccccaaaataaaccagatagcttggtttatatggaagaaaataaaccagagtaccactaacataagcatgacagaaggttttacacaaaactttagcagaagtgggtccaaatttcagctagtttcaggaatagttggtcgaggatggttctccaaagagggtggaattgtgctgttgatcagctgccctcacatgagcgatttgcattttcttggcgagaaatagtcgctgaagtcaagcagaagagtacgtgagaaggaatagctgtgagaccaggacaagccaaggccacagtgggatattctcagtccgtctgggtctctagatttacaaagaagcatgttgaatctgtagaggcaaatgggaagctcccccttcaccctctaaaggttagctgaaaatgagtaaatgacaagagggggattaataggaggaaaggacatagagaaggtaattaacatgcttagggacaggggaatcacaggaggagaatgacccaataatccagtgaggtcctgacacttatttgtatacccttcttcacagggacagggttgatgaggagtgtagggataaatgacttacaggggaaatgaataagcccaaagcacggtggtctgggacaaagttcctctgagctctaggacaggtggagggaaggtgagtggttgagcttcactgtaatcaaaggttatcttattatgcagataaagcctcccaggtaatctcttggagctgtcttgagaagaatagatgaaaagtctttctgggtgcagtggagactcccagtgtctcctcttctccagtggttaatctttcctggttgtttgatgagattcctagggaggaggtcttaagacaattgcatttccttttaaagggttttcctagtcagataaggaaattccggttctggtacagtggctcacacctgtaatcccagcactttgggaggctgaggcgggaggattgcttgagcccaggagttcaagaccaccctggccaacatagggagaccctgtctctacaaaaaaaaaaaaaaaaaaaaaaaattagttgggcattgtagtgcatgcctgtggtcccaggttctcaggaggctgaggtgggaagaattgcttaagccagggaggtagagaggctgcagtgagctatgatcgctcaactgcactccagcctgggtgacagagaaagaccctgtctctaaaaaaacaaaaaataaaattccagcaagagtagctcccaatgcttcaggaaagaaaagagatcagagtggggcttgggagggaacactggagagaccttggttctgaggcttatttctgatgcctttaatttcctttaattcaaagcatgccaaagagccatatttttggaggagtattttctgagccccaagaactcctcacaatgcaaaatggatgcctggctttcatttttttaaaatgatttatttaccttaaaaataaacttggattcatttgatcttcataatccctgtagataatttaggcttccaaaggaaacatggtctctattggcctaattaccaataaccaagttaaattccatttctgtacagaatttttttaaaatttacctcacaatctagaaagaggagaaaaaaataccttaaaaattaattattttcaaagccatgtatatgcagatttggtcatggcttattcagaacacattagaattattttaaattctaagtatcctcaatggtgaacttaaaatttcattctagggggaggggggcatggttaatgagtagaaaaaaatagaaagaatgaataagacctactatttgatagcacaacagagtgactatagtcaataatgactgaattgtacattttaagataactgaaagagtgtgattggattgtttgtaacacaaaggataaatacttgaggggatggattccccattctccatgatgtgcttatttcacattgcatgcctgcatcaaaacatctcatgtacccccataagtatatatacctattgtatacccagaaaattattttaataaaataaaaataaaataaatgaaataaaattttattctagccattccaggaaaaaaaaaaagccccattttgcaaagatgattataaccatatatatcatatgattatcaccttgttttcatacacacaagcatatatgtatgtatatatacatatatatttacacacacacacacatatacacacacacacatatatatatgtgtgtgtgtgtatatatatacagttgacccttggacaatgcaggggttagggctatgtcctgcacagtcaaaaatctgcatataacattggactccccaaaattttaaccactaatagcctaccgttgactggaaaccttacccataacataaacaatcgactaccacatattttgtatgttatgtatattatatattgtaatcttacagtaagctacacaaaagaaaatgttattaagaaaatcataatggccaagcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaagaggcggaggttgcagtgagccgagaagaaccattgcactccagcctgggcaataagagcgaaactccgtctaaaaaaaaagaaaagaaaaaagaaagaaaatcataatgaaaagaaaaatatatttactagtcattaagtagaaatggatcatcatgaaagtcttcatccttcctgtcttcacaatgagtaggctgaggaagaagagacgaggttggtcttgctgtcccaggggtgaaagaggcagaagaaaatccatgtataagtggactcacacagttcaaacctgtgttgttcaaggatcaactgtgtgtatatatatatatatatattttttttttttaggtttattgcaggaacaaaatcctctctccaaagctataatcctgactggctcaagatgtcttaagaaacttagaaacacagctaggaataaattacagcccaggctagttggttgttctcccggaatgagcgaattcaaaaggaacctggttatttagcaagaaatagactcagtgacctcagcagcattctaatgcatggaaaggtcagagaggtttcgtaccactctgctgggtcagatggaagccagagaagctgttggggtctccttgaaggttgaccctgggctgcaggtcaggaaacccaagtaggattccaggaatggattgctaagaagcttcgaggagaatggcttccacccatgactgagaattgaattgaggtccaggtagaatgggtagtacctggtcacagcccataagaaataagaagaggctatgatttgaattggtattaataacaaagaagaaaagcagcatttacttcgggcacaaggccagccagcctgctctcagaagctaaatgcaagtgacattttcttgtcaaatcccaacttttacccatcaaaggcttggggagaaagggaatccattgcaatgagttggttctgtagatagccctgcagaatcctggggggtgtttcacacgccagagaccaggatgggttgcggaaagcagttaactaccaagtatagtaagggaggcacagtaactcacctggaattgactttgcaagctgaagactgttttcaactgtgactgtgccattaggattaatgcaattcatacagttggctagcacatcagataaatatgatgaattgtccttatatccttagtccagtgagaactggcttttccatcacagcttaagctatacacatagagaggcaaaaaaaaaaaaaaaaaaaaaaaaaaaaagaccttacagttttgtttattgtgcttatcacaagtgctggaaactcacattttcattgctaatagccctctttgaaagtttgttgacatttcagctgatctttaatgtgctctactgttataatacccttgggcaaagtcagtttccaataggaaaatagacagcttctgggtacccctgtggaagctgcacaaacacaaacagactggcaccccagcctgcaatacctggtgagctctgctctgtccgaatcacagaagggtggcagaatatataacctcaaagcatgccactttggcataaggattatgttgaagtaaaggctcttgaaaaatagcagatacaagaagagcactttgaccttcctttttcttcctaaaagcaggagataaatctccaggggaaagttgttgtccctgtattgggaggaagaaacattcttatcaccagagatagggagtgaaggtcaagagaaatccgtaccaaaaaactttgttaaattaaccttatctgtctcttcacttttctacaattaactgctctggcccaagcctctttgtcttgccatgttttcacaaggtgctcctcttcatccaacttaggatataagcatctgactctaactgcttctttgggtcttcattttcctatgtgaattcccatgtccatttaaaatctgtatactcctatcttggtaattatctgatagcgatttaattctcaggcccagccgaggactctcagagggcagagagaaagttgtgccttccaggatcactgtatttgggagcctggaagacgaagaatggagcccagtaaatagagagggaaggaaagacatttaaacaggttcctaaagagaatgtgaggacacgtaagaacaacagtaagaaaaagtacagaaagaaaaatttacaatctattctacagagcaaattgaggtatttcttctgtaatagggaaagaggaaagagaagattcatgactgaccatcagtaggctttatagtggagagagaattgtccaaacctccgtataatcaagcacatatcctgattcttagaatatatgttccaaactaaattaagaaagggtgatgctggacagaagcagttattaattctggggtcaacaggataaaaatagtcagaaatgaacgttgtggtttgggaatataagcagctgaattcaaaataagaattctaatagaaagtgttaaatcaaagagcagttcataaagtcagagctagaccttgggtggggggaagagcaattcaaaaatttagagcagcatgtatcttaaaaataaattttattgaaaaatgagaacacatggacacagggaggggaacaacatacaaggggggcctgtccgggggtagagggcaaagagaggaagagcattaggacaaatacctaatgcatgcggggcttaaaacctagatgatgggttgataggtgcagcaaaccaccatggcacatgtatagctatataacaaacctgcacattctgcacatgtatcccggaacttaaagtaaaattaattaaataaaaaaaaatgaaaatgaaaataaatgttgttatgagaactcatagtggcatggccccaattttagaaactgagcttaatacagttaataggtaaatgttagatgaatacctcaaactgaatgttaatgccaaaattaagatcattctttggttcaaaatatagagcatgtttatatcttaattaaaagcagtcatacttaaatctctccttttcggccaggcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaggaggcagaggttgtagtgagccaaggccacgccattgcactccaggcagggcgagaagagtgaaactctgtctcaaataataataacaataataaaataaatctctccttttcattatttatagaaaatcatagtattttggcacattaaattgaacatatttctttaagtaattaaatgtacgcctatcataatgtattcctcctggtacttaactatcatagattattagcagtttagtgtttaaagggaactcaggactgagagttttaaaaacttagactcacagtaagaaagtcatctcatgttgatgaagtataaatatgcacatacacacacagacacgtcacatgcaggtacataactaaaatgaaagcttcctgaaataatacttatttacactttgtacagaatcgaatgcactttatttcctagtctttgcattttaaaaatatacttattttttttaatgctgctcctggttccccaaattgaaattactatctaccaatgtatctcaatttacagtttggaaaacactgccttagggaatagctagtctaattttgcacctgagaaacgtagagatttagggaatattcccaaggtcacgtagtatgtggcaaagcaagcctgtgctgtcttctaagttctggcgtaatgagttttccccaatcttacattgttacattgttttcaagatgaatggtcatgtatagtgtactctttgcctctcaaatttgatgaagtaagcattattccgttgctacgtgtcttgctcactttgcgttttcttagtttcataggaagcatcagttgtgctaagttttatttgtgtgttccattgtctcttccccctaaactgaaagcttcctgagaatagtgtgtattcttatcaatatcccctaaaccaagctgagtagtgtgaatgattgaatccttagaaagacaagctcatgtagtcaaatagtctaaattacatgagtgggacaaaaatatcagcatccaggtagccacagatgctcttctttccttctaagaaatacgattctcattccatacctagatgatgggttgataaggtgcagcagaccaccatggcacacgttcacctatgtcacaaacctgcatgtcctgcacatgtatcctgaaactttaaattttaaaaaaggaaatatcaattctattggttatgctgattagagtaataagtggagagggaattgagaagttctaagacaagctgtgttagtatcctagggctgcagcaacaaagtaccataaacagagtagcctaaagcaacaaaaatttactctctcaaggttctagaggccagaagcctgaaatcaaggtatcagcagggccatgatctctctcgtagcttctggtggttgccggaaacccttggtgttcttggcttgtagacacatcgctccaacctcagcctctcttgtcacgtggcattctctctgtgttttctgtgtccaaatttcccccttcctattaggacactagccattggattagggcccatcttaatcaagtatgacttgattacatctgcaaaggtcatatcgagaagtaccaggggttagaacttgaaaatatctttttggaagacacagttctacccaccacagaagctacaccaatttacatgaaaaagaacctaagtagatctagaagagttggagagagaaatgggatagaagggagatgagcaggaagacatgaaagcaaacaaatgagttatcttcaggggagaaaagtgcttgtccagtgtactatggagagacgcataaatgaagatgactttaatacattctgctttgcatcatgcaacataactttttttcttttggtgcctctcacagagacctctgtaaatcctaaattatcttttaagactttgttcaagtcagattttttagagttatttcagatgttatgttattgcaggaagcagctcacaagtgacctagcattaaagataataaaagctaatgtttttatgtgagtagaagatatagcattgcatttaaactatagtttcaccattatacagaaggaaaagaagacagcaagcagaagagacaataatgatatattgaccttactgaaagatgatgacataaagcagtaggatttatcattttttgtaagttactgaacattgattcagtgttatgcatcttgttcttctatatattaagcaattatgtttatttctagcactgaaaagcatagttattttcagccaataattgctatttgaatgctatagttaatgtttttataatttttagatgacaattttattttaattaactctcttagaaacaatcatttatttatttgctcagcaatatgtgttcagtatccaaagtgtgttagacacaattcagtatatccgtcccctatatcgagagtctagttagagtgagttaacaaaagcttttattcatgggaatttatagtataaaagtgtacaatagtataaaaaggctgaaagatttctatagtgatttcactatgaagagatctctctgatatttttcttccctttcaccttatccagtctccaacgtttctgtaaaaaacagctacacccacttttttcttcctgtcaggtgaatccagatagtgcagcaaagttgagccaccgacactgaatttcccaccacaagtgaaacagcagaaaaggctttccaagttcactgtagggaaaataaaagccatgtgatatttattgcacatccaagtatatggattaagattaattcctctggagcaataatgatcacactttttaaatcttacaactcgttgatagtcatcaaaattgaagatccaaaaagcttttatttttatgagttttacatatcagaatttcatgtattagaaattaaaactgacaaactttaaatatttattttaagacaaatgatatactttaaatattaatttaagacaacattaaaaaccctctacttattagcataacatgcttttattttttaaaaaaactacattattccaaaacaaaaaaagattaatgagaagagtagtgttgttccattacacacccatgagtgaatgagagtgaaaaaggaaattgatgtcttaatattattatgaaaattatttggtccaatagttaatggatcccctgaaaggtattcagaacccccagttgtctcctggccacatttagagaatttcagccctagaatgttctgatatgtagtggaggaaattgattctatagtacagaatcagagggcaactcactggcctgctccccacctcagctatcatatgatgcacagtccctgaccaagtggatcggaaatgtctcctgttgtaggtcaaggtatccctgagaaccacaaactgagatatggacaaaagagcaaaagcgccgtgcacatatcttgagatgcaggttaaagaacaaaacaagaatgcatgtattttatctcaggacactaagtctccaaagaatggcttgtgatgggggtacagacttgacccaagaattactgactataatcaaaccacagtttaacagaggtgctatttatagtgaaaaattttcccccaagcaagaattccatagtaaagtaagatcacagttgcacactgcaaatctttaaaagaaaattccagaatttatagcttacttagcctacttagctacttgctttgctcatatataccagttctttcaactaccacaaaaataataactatttgaatatactcaataaacaggcattgtgaaatttgaattttacaacatagaatttggttactgttcctgttaaaacacaaaatacatgagtgaatatttatgtgtatatttttcaataatgttttccaaatgacctttggagaatatctcaagatgattatttctttggcagggggcaaaaaaaaaaaaaagctatcagtgagataagcacatcaatcgaactgttttcatttgagccatgtttaaatgagctaggatgcaaaatagaaattctggaaatatccaaaagaaagatgtacatgtcctctgatttctcctaagtctggacagaattggcagcagaggctctaatgaaatcttgcaattagtctgagaagcccattcagagagcttcactgtgttcagccttctgccgctgacacccttgcctgaagacacatgcccatatcgaagcacatgcagatgcctttcctcatacctagaccctgaaatgaccatggaccgcaggattctcatgtgagatttcagtttactgcttaatttttcatcttgattggacttttcatccatcatatcaggaaaagctgaatatacagacccagacatagataggtttggggacaggaagaagatttaattctacttagattgatcccattttttcttttcttttctagaaatgagtgagatcatttgctgatcctgaggtgtggagggaaaaagtcttggctagaggtgtaagagaatgtgtggaagatggaattgactaaagaaagtgatagggttgtcctgcaggtctgaggacccaggtgatattcatggtctccatgtaacgcataactggtcagcaccttttgtttgcttgtttttctccaagttttactgcttagatgcggtaaaataacatctggcattcccagagttggttttccaagtaatgtcacttactgaggcaggaaggagaaaaggtgtttgaggtttgaagagacaggggaaaaagtctgttaagagaaaaggagtgaaagtgaccagaaataagttagtaggattgacaggaactaaatgggttagcatgggttagcagagaatgagatgtaaactctgttggggttttgctgacaaatacgatggagagagctgaagttgtttgtttgtttgtttgtttctcaaagatgtgataattacagtgaaccttggaatctaaactaatgaagaaaaggagtgaggacaagagagtgaaaaagtgatagtcaatgaattgaaggtcccaggagaagaaatactgtatttgagaaccagagtaaatgaaatggaaaattaaaggcagtggtcagaagtcagcataactagaataaaagtttgaaaagataatgactaagtcaagggtatcaccaggggagtaggtggctgaagtgcaatcggatgaaaaaacagtgggaaacgagatgctcaaagaaatgggaggttcgtaggtcactgtggtccagaattgcaatgattatgtattcagttccggttaaccaagaaattaagcattttgcaattctaaaatcatcagttgatatactaaaattaaagtctaaaatgccatgaacattatgttagatacatatatattaaatggaaatcaaattgtatacgtaaaaaaagatataaagaagaaatatagggctagacatagtgtcttatgcctataatctcagcactttgggaagccgaggtgggaggattgcttgaactcaggagttggagaccagtctggacaacatgaggagactctgtctctaaaagaaaattaaaaattagccaggtgtggtgtcatgcacctgtggtcccagctgcttggaaggctgagatggaaggattgcttgagccttggaggttgaggctgcagtgacagatgtttgcaccactgtactttagcctaagtgatagagtgagactgtctcaaataaataaaccaataggacatattaataaatactgtgatcttaagcaaagacgctttaactttctagagcttagttttctcatctgtatcacgagtaatttgaattaaattatctagaagttaattctttgcctgaaatggtttgtttcctttatccaatattactcattgattataatgatcaccaaaaaatgaatacttacgtgaatactagagaaaaaatattgcttaattttgaaaatacaaattgcttatttgtagaagctattttggttttatttgtatgtttatttaaagtttgcgagggaaccagggttatcaggatcactctgatctgaaatctgagatttgggtaatctcacttctatccaaaaatctctaggacatcaagctcatcaaggtcttcagatgctcatgatgcattaattgccctttgagaataactgcctaagagatggatgtttatattgattttatggtagatattttcttcttcatgggagtggaattccttttacaggttgattcacaaacctagagccaaaaatataactgaactattacagatttaaagtatagattgcataattttgtaaaaatattatcatacaaattctaacatatcgtgagctgaattatactaccacaactaaaactcaattacttataggagtcagacgtatattctaataagacagacactgaaattgctatttttgtctgctggccaaattaactcccaactcatcagtttgcctcccattccctaaagccttgtgcatatgaattacctggcactattgctaaatacagatttttttgcagtaagtgtagggtggaatctgtaattccacatttctaacaaggtcccaggtgtgtcagtgcaacacatctaaggaccacactgaacataactctatacaaaaaggctccactttttattaaactgtgattctgaaaacccaagtagaaatcaggtttttaaaaacttatcattcctttctttggctgttgagacttgtatttctccatgccatatcagacaaattgcatttacctggttccctctgaattagcaatcttaggaacttcagctactctcagattctattccgttatttcagagttcccagtggttggctcaagtgtgagtgcacattcaggttttccagttgcctcatagcgtctttccatgaccttctcccttattccagctcctgcttgggtgtctctggcaccttcttaggacagatgtgggttgtccaatgctcaggacactgaatccagctcaagtacccaccatgagtttgatgcaaggcaagcgagccccaaagtggggcttagcccatgagggttcttggcttctcccaggaaagaatttaagggcaagccaatggtagggtagaagaaaacagctcttatggaagtggccgtgttacagttctgtgattgctcccacagagcagggctaccccacaggcagtgtgctgagagtagcaactcggggcagttctgcagtcatgtttataccgaccttgaattacatgtagattaaggagcagcttatgcagacatttctagaaaaggggtagtaactttggggtcatcaggtcattgccatgggaaggggtggtaacccccaggtgttgccatggcgatggtaaactgacagggcatgctggtgggtgtgtcttatggaaagctactcctgccccagtcctgttttagctagtcctcaacttggttcaggatctgagccccacctctggagtcgagtcccagttggtacctcaacttcaagtgaagaaagtcacttaattcagttttttgttgcccccttaccaataacttgaaaccatttgagtggcctctcatcctattcaaaactactcctttcccttaagcctaaaacattatccttggaataagcctcagcacctcgactctctccttcctttaggctcagagaactgatgactacttcatgccaatacatccttggcaagccacctagtaggctgccattcccacagcaagcccagcagaaccatcagagtcatggagtggttatagtttaggctcttaagttggaattcccaaggacactataacatagtgttcctgcatgggtgagggaaaaataataactggtttttatggagggctaggagaggtagatgaattacctggtgcaaagccggagtcagcatctgtaactgatgagtgagcaggacaagttagagttctatgaggaagctttatgccgtcactggcaaaatttgaggcagcaaaatgcaaaggaactcaataaatggtgagatgattaaccaatgaggtggtactgactccagcagtggtgttattgaaagttcaggtatattcaattataacacattttaaatcttggattgcctgaaatcagcctgccaaatatgagaataatccaggcagacaaggacaaagaacattacacaataatgatactaataggcagtgtcctgtacattgtaattgtacaatagtgacagtaataggcagtgttttccagcatcaactggagtatcatttcctatcccaagtaagttaaacacaggatgagctcaacatcctaaggtccagaggagagtggacggtagtgagttatgctgtctccctgtggtgcccagggactctctctctgtcaaagatgctgtatctaattacctaggctctttctttctcctttcctcctcctttcctccctctctccctccttctctctctctgtctctctctttctttctttatgccctagaaataagtctttttcttctttcccagaaatcatggtgataagtagaagcctgcatgcaggaaattattgaatataacaaaaaaacatagttggtgaagttaactcaagacaaaaattatatacaaagaggtaattgcatatagattagagaagtccagtgtattccctttttgtaaaacgccttctgaatcgagtatcttttgattccatacaattctgtctcccctcacatctgacctattcatgtcagagatctcctacctggctcctttttcatctagtaattaatttatatccctgtcctaacttctatctcctgctcccctcaacattatatctctttttataactaggatatactcaaatgaaaaaatccatgtatcttactatcttctgccttcttctaaatagttgtgcttccttttgatctatttatttgctacaccaggaatatttgacatttcctggagaagtaggaatctcttgtatgctcatttgaaatgagctagtgtggttatttaacaaatatgcagagcaacaatgcacaagatgatcaaaagatatacgtggagaaggaagttctctatttcacaccactgagttacattttaagcatggggcttgtgaactaataccactgttcaccttctcaaaagggcatggtatttaggaatggcattattacagttttctacagttttccaatagaagacattaaataaatgagagaacatttctattgggcaatattaaaacctttacttccacatccactgctttcgccagcttgaacagattagttattcccagtagattattctcattggtaattctgtaataaaagattctagatattgtgcattttcatcactggcattacaatttttatttcagaatcttggtcatcgaatattcattatctaattataataaaaatgcatgattcccttaggaatgcctataactaaatgaatatgaactttattaaaggaattaaattaggagattaaaattattcaaagggggtaacaactttattcttaaagaactgtaggattgcaatactaggaaagaaagagaataggaaaggcaacagaaaagtagtaaaaagaaacagaaacaaaacagatagatccctgatgtgctatgatggggaatagagtattaatttaattattcagttataaataaactaaagcctaagcctagtaaattatgtgctccttgaagattagagttaggactgattaatctttgcattccccaccagaccaggcagtgcctggaatgtagtggacactcaataaatttttgttgaattaataaggaagcaaattctatatgaaaatgataacaagtttatgagtactttttcaagtcagtttgcagatacaagtttaaggaaattcatactcggatatagttagaatgtgtatactgaattagaatgttagtctatgtgctttgggaattaattttgaagctcaggaagctatgcaagaggcagccaagctcagaggaagggtgagagacttgatcagctgcccctccctgtcttgaactatttcctgttatagatggaaatcatccttcattacctgggaaaaagtatgagcccaaagcagaattagccttctttatacatgtgttgaatttgtgttcccatcatattaagtattaaaggaaatgattatgagctgtttgttggacagtaaagggaagtgataatgataattttaatatagttaacattagcttgaaacacatgaaactgatatttttgtgtgtaaacacctaagtgaatattgacaatttcacatggtttaatttaatattgatcaaatgctacgtggtaggcactgtgctaagtaatgtatagtccattaatttgtttaaatttcatccaaaaagctttgtaatagatgaggaaattaacaataagttagggaacttgcccaacatacaaagaggacatagaaggtaaacagtttaacatcagagtcccttttcttaaacagaatactatcctgccagggaaaatatggatgtcataaattatgttatcaaaatcttgccttccaatcacttatttatgtcaacaaaaatgtgacaataagatataccatggttaattcacagtgcgaagtgtctgcttctagaaaggtgaaatttgcttataatacagttattattataccactgcaatatcgaggtcaagttctatggctacaaaatgacataatctttactcaagaaggtcacattgcagtaaagaggacataattataaagagtattacatcactagagttagatttttttttgttggtcaaatgactcaatccaaaaagtaggatacatagtaagaatgtgctatagagacaaagagataaatatctgaaaccaaggccccagaaaattaacaatctatgtcaaccataactgtattatccatgtgagtcaatttctatgggaaatacagttctgttatctatggataatacagttcttcctagaggaagaagcaattaattgatcttggaggggtcagggagagtttcatagaagatataacaactttacaaggcttgagggatgagtgggattgcattaggcagagaaaagaagaaagacatcctagaaaagggcgcaacatgtacaaacagaggaatgtgtgacagtaaacagtcacgttgaggaacagtaaatggtttatgtggctaggaggcaagtttgataccacattatattctgtattcctaaaacacccagacacgcgaaatgctgaaacagtaacttggactcttttgtgaagatcccaggactggaaatttctactgtgtcctagaaagcaatgataagccaacgatgctgtttccttctcgagctataactttcatagagggaagtgcacacatcttaaatggacagcttaggcattgttacatattagtatacccatgaaattatcacccagatcccttgcttggaagaccaaatgtcttttttcccccctcagaaatttattaccatttttcagaattaatattttctaaaacccaatataaaacattatatataaccattatggactgaactgtgtcctctgaaaaactcatctattaagccctaactcccaacatgattgtatttggagacagggtcattaaggaaattatttaggtaaaatgaggccacaagaatggggccttaatgcgatgggggtggtgcccttataagtagaggaagaaacacaggagaggttcctttctccactttagttcatggaaaggccatatgaggacacggtgggaaggtggccctccacaagccaaggagagaggcatcaccagaaaccaactctaccaacatgttgatcttggacttcaagctttcaaaactaccagaatataaatgtcgtctaagccacccgatccatggtgtctcaatacggcagcctgagcagactaatccaacagtctcgaagaattaaatttagaattggtcatcaagattttgttcacctcaaggaaataaaatgactcaatcctccacggatttgtttccatcattttcctttcctattttcagattatttgcaacctggagactgccctgcaaaagcacgtggcaatttccccttctggatcctcacaggagaaaaataaattcacattaacaaatattcagatgctttatttattctgaaaaaaataaaaaagtgaaattgctaaattgctaaattgagtttttcactggtcaaaatttacatagcccaataggtgtaggctccttactccttttgaggcattttctctctcttgattaacagtgatggatttttattgccccacttctgagaggaggatttatatgtcttttaatctgtgtaagttggactgaatcataaatggttcaccctctaaattacagagtaagtttgccaatagagatgaccttgtttattaaaatctaattaactgaagttttagaatgtccctgagtgggttgctgaatttctgattttctccaaaccaatatagatcaaatatccagctggctggagttaaccacaaagctctgaacctcactgtgaaattatctagttaattcctctttcagacattttttccaaaggtacaagcccaagaatcctttaatatgttggccatcctatttcagaaaagccatgtgcccaattatgagttggagaaagaagcccaggtgctccttgttcactgcaactgaaatgagaggaccctggagtgtaactttcattccccagcaatggtcagtcagaatgtctctgatcatgtgccacttttcatcttctggacaaagttctatgctgcctatacacataaggcagtaatattcatgactttttactgccaaccttggaaagcaatgttggcaaattgattacagacatatgggataaaacataattaattgattcagttcctagtctatatacaaaattgcttaatgctaaaactcctctagtttctgccctattgcttcttccatttctcattccaactttaagagtttaaggtttgtctcttctctctcatctcccatttaattatcagctattgaactttttcttcatgacattactagatccctttgtgtcccgtccaccgatgatctccatattgatatagctgatgtacatgctttaattttttgataacggacatttttgcaatatttaacataatataccacctcactcccaccccaccctccagaagctctctgttcccttggcttatagtacatataattcttttggttccttcagaattttagatcctgtattttcaacttctttggttcattcttcttctttcatgctgacactgacagtgctctcaaggctctttccatggctgcattctgacttgcatttagtcccagtcactgagagatattttgaagttctgtttttatttgggccacctcaccctgaagagtaagtacttttcattgttgtagctgaggtggtgtgcctttttcaaacgtctacgtcccacagcatcttcgagatattgataacataaaaacaaatatcgatcatcctaagggccttacagacttcagagatgggtaaaagaaaccacttccaccttcaaatcagtcttttgtatccactaggggagcaaaatgacctgctgagttgaagtgggaataacaaagtatctcaaagatgatgtgatgtttgtagagaaaagtttgtggcagtaatcgatacaggaatcacttatatggatctgtgttacttggagggggctttagaaatggcatcaagaagaaaaaaagcaatgcttcttggtttaaaaaataatgcttttatcattgaaaaatagtaccttttaagatggccaaatccccaaaataaaaattcaaagcatattgtacttccttctgaggccaaatgcatcagaactaatgctcttttgagaaaaccatgctatttaagcaaaaatttagggagtggagagtccgattattgtttttcatgagtgttgaagtctatggaaacaatgaaggaatgtacagaaagtaaattagataaagatttgatttataaaaattgtccaggtttagaaatttttatatatccaaacagaagtcatgaattaggtttccccaggctgtgaactagactaaggtggcatgtaccctcacattccaaagctgagtgccctctctgtccgtgtcacccagttaccctccttgggtgacataagagaagcccaacaattcctgggggtgtctcagagtccagcaggaaagatttatttgcagagttgagatgtcagcatattccgtctgcccacaaccatcatcaccatcatgggagtggactatcgctgtttagtttcaagggaaagaaacatggatgtgtggaatgaagccagccatgagcaacctttaaaggcacccacccaggggccatcaaggcaagagtgaggaggagtgtgaactgtgcagaaacagaggggagttgtcagtggctgggtgcacatggcattccagtttctgcacttatttattggttataaataacgcttcagaaacaccgagaagtcctagactattcactctaattttaaaagaatactgggccattataagggaagattttccccttgactacttttgagatgccaggagttggccattaattgctagatatgaaaacacatggaaatggcaaagaggctacacatcaagcattccctctactaatcatgcaaatgagtcatgatgtacaaaatgtaaggaactcctgtttagggaaaatatgaatgtagatgcacaaagtaaaatgtatgtagtccaaattagtcttctagccagtaaggcaattttcctatatgataaaaagaatggatttttatatcatttaaaggaaatacattgaaattattttagaatttaaaaaatgtaaacatgcatctttccttcttaaactctagagtatcggagatttgatctgtttttttctagctcagctattaactggttgaataccttagtctaggcattgttttattcctagtctattacctctgaaaaatgagggtagtaattagattatctcccaaaatattactgttctaattgcatgtggggaaattgcgtagaactacaaagtcttgtcatacaacctacattaactggttgagtaccttagtctagacactgttttattcctagtctattacctctgaaaaatgagggtaataattagattatctcccagaaatttactgttctaattgcatgtggggagactgtgtaggactacaaagtcttgtcctcaaagggctcacactgcatatctacgtgaagaaatattggcccagataaactaaccaacttacttttacatagagacagagccaaggtagggtttgcctttgcaaatctaagtcttgtacccctttcaccacgttaatgagatatggatcttctaattaaatattaatttctaaagaaataataagccccaattacagaaaaaaaaagatactaaaaatatttcaagagcattcaaggagcttcaatacaagaaaggcttgttgttgggtttttttcatctctctccattgatagttaagtacatacgggtagctattttagagctgcgcctagttaacgtctatgtttattcatgtatttattcaatcatgaaacacgtggagccggccacttttatttgaatccactttaaataaacacttttgtgttgattgtacaaagttccatgaaacaatatatctgccctcagggaacttgctttccagaaaggcaaatcaaagaaaaacgttttgcaaagaatcccgaaatggttacaagggctttctaagagaagtctaaattgaacagataattgtctcacattttgtaaaaggcctagactattctcactgaaaagcagtaattgaatctgtaattactttcatttcactggggacataggcatggattctaaagatctcattgtcatggttgttttcttaatcactctcattgcttcctagcaacactagcttccttccttccatgcaggaaagctcaacagtcaatggtgggcaaggacactatgagaaacatttaatggcacccacccaaggcccatcaaggcaagagtgaggaggggtgtgaacagagggacctgccgcttatttgcctttctgatgatccagcccctgtttgttttatgaacaaaggctttaacttctgacatagaagcgatttttgaaaatgaacgtaaaggaactggcaaactcagcccatgggtttcccttttaagaacatgaaatcacctcctcataatcatttcagtgatgccaggaacgttcctctctctctcccattcaccctccaccattcacagagatttgatttctagaattttgtcaaaagacaaaattgcacaaaaaattaaagatctaattggcttttattagcaattctcaaattgggcaacaccccactctataaactggaatagctgtcccagtgccctgagtagaggagattggctttataggcagaaaaggtctgaagaaagcagaaacaaggaataaaaagtggattggtcatttcaaagttactttccttgtagggttaaaacagggggatctcttatcatgccagctcaggcaaactggtctccttctctctttttggttttgacaaaatgtcttgctctatatggtggtatgatctcagctcactgaagcctcgacttcctaggctcaagcaatcctcccacctcagcctcttgagtagctgggacgacaggcatgtgccaccatgcccagctaatttttagtatttttggtagagacagggtttcgccatattgcccaggctggtcttgaactcctgagctcaagtgatcctcccatcttgatctcccaaagtgctgggattaagggatgagcccccacgcccagccaaactgggccccttctgattgatgactatgactctcctgttatttggaaaactggtggctttcaaagttcacgttagttatgtggcacctagcacaagtgattgcatgttggtttggtctgagttgttgggacctactgcagggcctactccaaaacaatggcctcccataaaccctgtatgacagtctcattaaggcattgcttctacttaactggtttgttaagtgggaggtttaaggtttgtcacctttttctctgagagcaggttttagtagagacttggacagagggcatgtagcagagaggatacagaaagatggagctgagaacaaaataaatacaataaactaaaaattcgccatacttttaaaaatatttaacaaaaactaactttggcttgagttataggtttcctctcctgttttatgtgcattagatacacacttttaacaattagatagtttttggtattaaccatgaagtagcatcttatttctgggtaaagtctgtctatttttttaagttgttttaaacttttaaaacattttttagttatgaatttattttattttattttattttatttattttattttatttttgagacagggttctgtcacccaggctggagtgcggtggtgtaaccttggcttgctgcagcctcaacctcctgggctcaagcaatcctcccacctcagcctcccaagtagctgggagtattgatgtacaccaccatgcctggctaattttaaaattttttatagagacagggtctcaccattttgcccaagatagtcttgaattcccacctcagcctcccaaagtgctgggattacaagcatgagacaccatgcctggatgtgaatttttatttaagagatagaaagaataagaacaacccaaagattatttaatagaaataactagacattaatcaaaaatctttagtgtaagccattagtaaaataactttccaggaaaattcttataggtttttaccttttgacctactttttctaaacacttgctatggaaaaagtacagtgtatttgaggatgattgttaggaggcagaaaaggtggagaaaagagaggctgggctcagtggctcatgcctataatcccagcactttgggaggtcaaggtgcgcagatcacttaagtcaggagttcaagatcaacctggccaacatggtgaaaccccatttaaaaacaaaaaaagatggagaaaagagatacaaagatttagaggtaaagtgaacttaattgtctgaacaagaaatcaaacaaaagactccaaaaagtttagaagccatccttgagatgcagatttaatgctaaaaatgttggcattttcagaatattacaatgatgaatgttgacagtcaaacagaattttattgttaagcttgtcctggaaaaaccaagaatgtttgattgtctgtgattgagacacagtccctaaatctagtttggaaaagtgacagatgtttcaggttgggatacaaaagacaaattctaaataaggaatgaaggagagaaggaaacatggaggaaattggtgggacattctgtgccatttaaatatcttgactcttgttaatgaatgtctatatagaggtcaaaggtgaggaaaacagacaaatcatgggtatctaagaaaggtgtgttttctatccaggaagaaaggtcaatggaatacataaatatagtgatataaactttaaaggtaggaaaagcccttaaaaacagagtcagtaaagattttgtagtccctggttcatagtcacaaagtagaagacaccaaagccaggaaatacaccactttgtagttcattaccctgctacttctagtgagatgtgtgcaaaacacttgtcagaccttattgccaattggcatttgagactatctacagttcttttttttaataacctcattgaagtataatttaaataccataatattcatcgattttaactgtacattaactgtacaagtgtacaggtttttttagtaaatttttagaaaattcattgagttgtgcaacaaatcaacacaatcccaacttaggacatcaacattatccctatacgattcccggttaccatgaatttctgtttctactcccagcccgacaaccactaatctcctttctgtcctggtagatttcctttttcatatcagtaaaattagaatatgtgatttttttgtgtgtctggcttctttcacttagcataaggtttttgaggtttgttcatgttgcaacatgtattcagatttcattcctctttattgtctaataatatttcattgtatgtattaccatacttttatccattcactagttgatgggcacttgcgtgatttccactttgggcctcttatgactaaatctgctataaacatctacctaaaaggctttgtgtgaacatatgctttcatgtctcttgtatagatatccagaagtagaattcttgagtcatatggtgtgtctatgtttaactttttaagaaactgccaaactgttttcaaaaatgactgggcacagtgtcactttagtgtaatccaagctacttgggagctgagacaggagaatcatgactttacagcccaccccccgagcaatgtgtgatgattccagtttctccaaatccttgtcaacacatgttattgcctctccttttgattatagctatcttggtagtgtgaagtagcatctcaatgtagttttagttacatttgcctaaggaatgatagtattaggcttcttctcatgtgtttatgttgtatttgtacttatatctatgagatatcttctgtagctataactttgacttcctgaattctgtccagaaatttctagtttgggtgatgctgtgatggaaatgcatgaaagtatgcagagtaaacattttttaagggttactaaataatcctgaaacttcacaaaagagaagtccatctactctgctagaattactgtataggaaaactcagtgtaatcattttcataatatttggtagaagagcaggcttattgtaaaaactggggatgtttatttttctttagggcttcatttttctactttttcattaagctaaggataagattaaactgcctggaggcttctttgctttctcagcacaataaaaaagtcaaggaaagacagcaaagcaagacagaattcttcagaaaaacaatactgaagggaaataacagtaacaccaggttagagaaacaaaatccatagaatcaagctttacttgagtaacaatgctgatggaaatagcatgtaagagtcttagttcagggcctattggaaatggatgatagaatttttccaatgtacaagcccactaacagatataattagcttattatgctaacatgataaatagttactgaatatctccctaaattagattgacctcaatctgtaaggatcgtaactttcaacaaaggctcgttttgcttgcaaaaagattcacacaagatgctcagatggacaacataaaggtatttcagaggacccctctccagaaaccaaattggttgtggaggctaggcacagtggttcacaccgtgaagccaggagtttgggaccactctgggcacaaaagcaaaagcaagacctgtctctacaaaaaaaacatttaaaacagtgggcgtggtggcatgcacctgtactcccaactactcaggaggctgaggcaggaggatcacttgaatccaggttgagcctacagtgagctatgattgcaccactgcactctggcctgggcaacagagcaagaccctgtctctaaaattaaaaaaaaaaaaaaaaaaaaagtaggttgtgctgtaggatcacaaaaactttgtgctggttaaaccactttactgcctttcatgaattagtttccacaactaatgtagagtccgcttctttgagagtttcacatgccattgcttgtggctttccattctctggatccctgtttagatctttggtcaaaagtgaccaaggaggcatctttatactattttctccttttattattttctcagctgacaattctttccctcttttgttgattgggtaaggaatatctgagtgttattactactagctatacggcaaccttttataaacttcaatatagcattacaaacattggttgatttgggcatgaggtagttctagaattcttttttgcttagtatggtatattgatagattaggggtaaatgtgaataaaacattgcagatatctttgaatttatgacttacaagtaacctcaatatttcagcctagctaaagacatctttaaaaggtaattttcacctcatctataaatgagagttaaaaggaaaattcttttaatttacatagtggtgttttggcttatattctgttttggtttttcccctttttaagacgaaaagtccaaggaggggatccagatagtgtgaatctgaatccagactgccactggtaaactttgtctagctaaattctctgattctcattcttctcatcagtaaaatgagaataatgtacattatctcacttaatgattattattctcacttaatgaatcatgatattaaattttcagtatcattgaccaataatgcaaacattttcataaaacgtggcttataaatttctatcatccctgatgttaatcagtttttcttgcaaaataattaagtaatgcctgcttttagtattaaaaatttttttaagttcaaaacctactaaaagtctacatttataaaattattacaaacacttaaaaattatatttccaaattatgagagtgtgtagatatgtgaattcctataaggttatacacatatcaatttgggcaatacaattacataataattggaatatttccaaacacttgttttaaaaatgctttctcctagcactagtttcataagaaggtagtacactgtcactcatcatatataaaccaacattactggctgggtgtagtggctcacacctgtaatcccagcactttgggaggctgaggtgggcagatcccctgaggtcaggagggcagatcatctgaggccagcaccagcctggccaacatggtaaaaccctgtctctactaaaaatacaaaaattagtcaggtgtggtggtgggcacctgtaatcccagctactagggaagctgaggcaggagaattgcttgaacccaggaggtggaggttgcagtgagtcgagatcgtgccattgcactccagcctgggcaacaagagcaaaactccatctcaaaaagaaaataataataataataaaataaaccaacattaccaagtgctgacaatgatcttgagcaacctgaattttcatacatccctggtagaaatgtaaattggtacatgcttttgggaaaactgcttgaaattatccactaaaattaaacatgtgtactttatgacccagcatttctacttttaggtaaatgcttgacataaatgaaggctaataagtaacacatctataagaacattcatagcagctttattcataatagccaaacactggaaacatccaaatgacaatagaatattcattcttattgttgtattatattttatttatataatacaatcttttgtattatataatacaaatacatgcaacatgtattatacaattttttgtattacatataatacaattttttgtattacgtataatacaattttttgtattatgtataatacaattttttgtattacgtataatacaatttttttgtattatgtataatattttttgtattatatatactattttttgtatcatctaaataaatatttaaagttgggtagaaggagctaggcacaaaggaatgcatagtgattccatgcacataaaggtcaagaacaggcaaagctcatctatgatgacagtagacaaatttatggttacttctgatggagtgtactgattgggaagggcatggggggtgcttctagggtgctggagctgttctaaatcattatgtgggtcatggttgtacaggggtgtgtgtgtgtgtgtaaaattcattgaactgtacctttcagattttcatgatcattattcatttcattacagaatgtcatagagattccaccatttaaagaccttgtttttataaaattacccatactatcttatagatgctggaagggttaaacaatgagagtagccacaagtagcagagcaccttctcttcctacaggatagatctcacttgtaccaaagctgacatatgactgcctgctatgtaatgcacagtaaatttaaaaatttattattaattaaatttatttctcactgttacaataaataaattgaagtgtagatggtttctgtcctcttgcatgtttctttgcatttattctcagtacatatttttgccccctctttggtcccttcccaaaccccttgctcaactttggaaacttgattgagttacacaacagttgcctaccatgatagtcagtgggatatttgctcaataaatttctaaagcaaaaatggacaattatgccccattatgagttagaattggcaaactctataaaggaccacataatatacattttagactttgggggggtcttatgtctctgccatagcttcttacctctgtagttgcatcatacatagacaatacatttttttaaatggctgtatttcaataaaacttttttatgaacactgaattttatagcatcacaaaatattttttcatcttttttaaaaccatttaaattgtgaaaattattcttagctagcttttgagccatacaaaaagaagtgatgggcagaatttgggtctcaggacttagtttgcagagctctgatttagagtcatgtaattttaagtaataacttgaatctcaaccttcagttccatcatttctagtaggttatcaaattaccatatgctgttagagagtgcttttatttattgttcctttaagaagcactaaatattaagtttaatatcaaaggctttgtttcctctttggcatgattgtaattcataagacttctaataaaagagggtgggtttgtaaaaaattccacagatatttgaggcctagtcattagtagctacagtgtcaataagaatcacagtacttttctgcattatcttaattctgatttgataaataattattttttaaaaacccttcattttgaaaacaatgaaataactaaggcagtatataatgcatttatttgaggccaactggccaagttctgtgactccttcctgggtttctatgggtcctgacacatgaggaaacaaatattcactgacattcaagaaggtcagaggtacaagtaactgctccacactgcatagcattttcaagacaggcctccaagttggttcctctccattccctgcactatttgctaagagacatgaatgataaatctttacatcattgaactgtctgtctcattctcctgtcatccaaaaatcagggtgggatttttctgatgagttctatgtgcaatttcaaaattgttatttctattcagactgaatagtaaaaaatcatctgaaagggtaaatttgaggaatgacatcacactgctttgtgcctcccacccattcactcccaaatgagggatccctcagccacagcagcagaaaaagaggacaaaaggccactgattttccatgaaggtgaaatctgtgctgcacgggctccaaaactcactgcacataactcatcttaagcccatctccaggaacccctcctgggtttctatgctccattctagagtcagtactttgcaactagccttgtctttcctcctttaggatggatacagggtagacttgggagacctgaaacaagataaatatagagtcaacagaagaacaaactcaggaggaaagccaactgggctcaaatctcggctccactcttcattgtagatggaaatagacacttattgaatacctgttctgtgctggaaacttcacataaactgttccagttgttaaactaaacaagaagagaggaaggaacaaaaggtgtcccttatttaactcatgtacaatagggaagaaaacttctgaaggaactgcttcaaatagggttttgtttcacatattattcaagcgaccaggttgactttgttgaacttctgattccatgacaacagcaaactctgcatgtgtgctcagggtttgacatgctgtggtgtactctctacctaaaagagtacgcagcataatggttgtgaatctctggaaatcagggtgtcgcttctgttttccagaagatgaagatgccagaagggcttctgagcaatgtgctatgagaccacctatggaagagagagaacaactctttaactgtggctttacttagtaaacttccaaacgattactgaaatgtcatcattagacaacgtaagcaactagcagaaaattcatatgtctaatgcagcctcctcattctttttctgtctttccctgtgatccaggaggaaggatgctggtttcttatcatacaaagatcacctgccagtgagccaagtggtggttggagatactgaccgtcaaggctcagaagccaaattgagcgtaggtcctctgcgctgccaaggagacagtaagtttgcatagcagctatggcttgcactttcttatcccatttaaatattgtttccaggctcctcagaagatgcctgcaatcagacttgctctcctgtagctcctacagaaacatcacacaacccaagcagagataacttagaggaggggaacagccataaagcctccagtacaggagccgagatttgggcataaagtggggatatccatctttcctctatattcatatgtaacaagtttgactacctaagtttatgatgatattaatagcaatgctaatagcataaatgcagtactcaacagctgtgattccacggagtgctgctgttaatgccattaggatgactatttatatcaccataaaccgagtttatggtgatataaatagtagcattatggcttaatgtatcattgtaaacttggattatggccatataaagtttgacattattgctatcaaacttcatcatcatcagagcttgatggtcccttgtaagccaaagattgtttctgttaactatgtcttgctttcaagattagtcaccccagagaggaatttggggctgctagcttggacagtgggaggtaagggagttggagtgatggtccctcctaattaagggcaccattaggattttatgttgtttgatacccttcggtgtgctttatgtgcagtcagagggaaacagtgacatggttgcactgtggggattctgcagcgagcatcctgggcatcgttttctctcttctttctgggacacgtggtttaggcaactctcctgagagttctatgcttttgtgattgtgtgctaggcatccggagacctagattctgctccccaaatagctgacttgccaggagacctcaggcaaacccctccattgtcttagctgtggtaatgagaataccacacacatcccaattcctcctggggaggctgtgaatattttagtgcctggatttggattcctcctagcaaagcattatgtgagatggaatattattaccactttgtaaatcaagggagaattagacctacttgataataaattatagcgtccactcaaagagatgtcctaaggaacgtaatgatgcatgcttaacagtttcctacttagtaaattgaggttgtcagcaattaagcaatgccatgttcctaatacaaaagggagatggactttgtactgatttttctctacttacattgaaaatgctacctgtaaaattgagactggtcaagatctttatcacgcacttattgaacaataatacttcatttgtttagtcaggcttagtaaaactgtgcagaagaaatttaatttcaactgcctaagaaaaggatattcacctaaagcaatagtatatatgcattttaaacaaatattataagaaatgaaatacagtgttgctctaaaattaggaagactgtcatgtgttgtctaatgaaaatcatttttgttatggaataattactcattagcatataaaggtaaaatatttctggcttaccgattctaattctgaagttagctttgaatttgagaaagtgttcccattaaataattgattaacttaatatatttataaaaattccacttctgcaaactttttttcttgtctgttttgttttgctttattttctttttttgagacggagtcttgctctgtcgcccaggctggagtacagcggtacgatctcagctcactgcaacctccgcctcccaggttcaagtgattctccagcctcagcctcccaagtagctgggattacaagcacacgccaccatgcccgactgatttttgcacttttagtagagacggggtttcaccatgttggacagactggtctcgaactcctgaccccgggtgatccacacgcctcggcctcccaaagtgctgggattacaggtgtgagccactgtgcccagccttctgcaaacttttattaccattcttaaaaaaaagattctaggaacattaaatagtagatgctgcagtatatgagcactttataattaatattagcttatttgttcttaataaatcagcctcaggaagaatttattgtgaggctgtcattcatctagaactttcctaggtgctctggaaagtaagaaaaagaagttcaaaccatgttatgtgaaatgaacatgaaaaaatattggaaaacacaaattggcttataatttaattttaggctttgtaatataaaattattgcaactgataatcaagaaaggagccatagaaggtgtatttcaggcagactttctttttaaaaaagagaaaatgagaaaagtatagtggtcattgttcatttgcatttctattctagggctgttgttcttagaaacatttttagaacctattatcaaaataaacttatttattcacattacatgatctcagtatacttataattactgtaacttcagagaaactcttttaaataatattttacctgatatttcatgaaagcaaaagcagtcaacagttaatggcaattatgtagaatacttttgtgtctgtgtgagagagagaaatctcattgttttccaggcaaccgagaataagtatcctacctggtactcgaattgcctggtagcagtcagcagttgtgaagcccatgttccctttaagaatgttctcacggccgggcgcggtggctcacacctgtaatcccagcactttgggaggccgaggcgggcggatcacgaggtcaggagatcgagaccatcctggctaacgcggtgaaaccccgtctctactaaaaatacaaaaaaaaaaaaattagccgggcgtggtggcgggcacctgtagtcccagctactcgggaggctgaggcaggagaatggtgtgaacctgggaggcggagcttgcagtgagcagagattgtgccactgcactccggcctgggtgacagagcaagactccatcttaacaaaaaaaaaaaaaaaaaaaaaaagaatgttctcacatggacacagtagtgatagagtgttccgtatcaactgcattttccagtttttatacatatgtgatctccctggttacacacagcctcctgtgaattgggcagggcaaatattagtctttctgccttacaaatgaagaaaatacttctttgaaaatggcatttacacagcaaatttctgagcatactttcagcctctgagaggcttcaggacaaaagatggaacagagaatagaaatagctgtgtctgtacaaggtcagagttgttttcccaactgtactctcatccctgagccaattgttgattaaattaaaatgccttaaaatgtttcatttgggttttatcccaccactagcctcagccacacatgtcagttaccaacatagtacaaacattatagggattacatttatgtaatttaaaaagtggcatagtgcatttttcctgctgtttatagagatgaacttactttgtgtcatttactgaagtctgttcaaacctacagcttataaagactaaacctattgttgaaaaatatctttcagtttgaggagttgagtgatgacagccctcagaacctgcctcttgaattaggccccagttccatcctctagtctcagagaatgaaaccatttttgtgggctctgcccaaccatttcagcagttttggttgatttcatcatgcctgctgagtttcatttttgctttgattcgtctgaactcagacccatataatcaaaatgctaaagaaaatcagtgcatgccactcagatctgctgcatttcccatatagttctgtgaaatgcttatgtccttacaggtgtgtgtgtgtgtgtgtgtgtgtgtgtgtggttttttttttctttcattctttcttttttgcaaagcctatccaaatggaaacttcaaatcaaatgacactgaaagtatgagtggtgacggatggttcgctgaaataaaaagtgctgtgaaaatacaaatccccctcttaaactacacgtacgcacctagaaagaaacaaaagaaccatttggaagattaaaaatcaatgatcaggtagacattgtttcaaattgaaatatgtaatcatctttgcagatggctgccaaactttcatactttcatgaaattagttaaaaaaataaaagacttccactttttggaggtagaaatctcatactatatatgacgaatataattaattgtaggaatatagtatttgctagacaattgctttattttcagccatatgatgtaaaactttactgtactcctctagggatacggggactgtaaataaatactttggagcaagtttgtcagaaccataggaaaggtttaaaaaaaaatcaaatgttttcagtaaacctgggtagaaacaattccagaaaatgtcttattcaagggcttcttccaaggccatgccagaaacactggctgtgaagctggcagacagagcactggagtcacactgcaggattaagatgcaaattcagtttctcagagctacggaggtgacccagagagacaaggaaggaaaggcaaggcagtagtgacacatctagttctggaacactcagaggacagacaaagctgtgtgtaaacaaataaagatactgatggagattcatcaagatgatggtgaatatttgttctttgggaaagttattttatgtgccagactaataggaaggccattatcttttttttgcaagaattttacaaaccaggatcataacctgccattcccttgacaggagagataagatggccaggcatggtggctcacacctgtaatcccagcactttgggaagccgaggcaggcagatcacttgaggtcaggagttcgaggacagcctggccaacatggtgaagccctgtctctaataaaaacacaaaaattagcagggtgtgctggtggccgcctgtaatcccagctactcaggaggctgaggcaggagaatcatttgaatccgggaggtggaagttgcagtgagccaacatcgtgctgttgcacttcagcttgggtgacagtgtgagactccacctcaaaaaaaaaaaaaaaaaaagcaaaaacagacaaggcaataaggcaatgcctcggtctccacgttgtttctgtaccaatgaaacatttccaacaggggcgcacatggcagtaactctctttcagaagataatacccacgagcatacataggccacatactctgtgcagtgaatagggactgaaggagaaaccacttctcatctgggttcaggaagcaattctccttattgagaggaagcagctctccaggctccagagaagagttcaaaatttatttatctcctttttctttgctgcttcaggcttggaaaaggcaagaaaggaaaagggactagcatgcaggttctaaaccaatcactttcgattcattttctctcttgattctctcaacatcccttaataggtgatactgttgacaaaaaaaaaataaaaataaaaataaataaataaaaaagtaccctgtaaaatatttaaagaggtttatttaagccaaagatgagtggccatggcccaaggtacaggctcaagaggtcctcagaacatgtgtccaagggctacaatttggtttttatatgttttagaaagacataagacatcaatcaatatatgtgaggtatacattggtttagtctagaagcaatgtgagagtgtggcttacaagtcataggtggatttaaaaatgttctggttggagattggttaaaagagttaagttattatctgaaggtctggaattgatagaaaggagcatctgggttaagataaggggttgtggaggtcaaggtacttattatgtagatgaagtctcctaggtggctgcccttagagacaatagatggcaaatgtttccatttagacctttaaaaggtgcttagactctcagtaaatttcttctggattttgagggcctggaaggggaaagatctagttatgttgatagagattattcatagatgtgaattttcccccacaaaaaaactgcttagcagggtcatttcaaaatatggcaaagaaacatgtttgggtgtgaaatctttttatttcttcctttttctgtcatgtgatgttatgctagagtcaggttaaaatttggtatcttattgctacagtctgtaaactgtcatggccctggtggaagtatggcagtgaggacaaccagaggtcactcttgtcgccatcttggttgtggtgggttttagccggcttctttactgcaacctgttttatcagcaaggtctttgtaacctgtatcttgtgccaacttcctatctaatcctgtgacttagaacttctaaccacctgggaatgaagtccagcaggtcttagccttatttcgagatggagttggtgcttagatttttagttttggttcacagtacctttgactccagtgtactgatgaggaaacagaaacaatgttattaggtgctttgccaataagtttcagagttcagactggaatctacctagttccaaagtcctcctttctactctattcaatcagagctgatgttaggataaaaatgggaagaaaaaaaaatctcttatgctctcggggagtggctgggtctagctgtttgctaatgagggggtctagggaaacatccctattgccctgtgaagggtcactgaaaaaccaactcacaaggcaggttaatagaagaaaaggcatgcaaattttactacagggagaatcacagaatgatttctcaccccccaaaggagttcagaagcttatatatcatcctggaaaaacaggttttgggagcaggggaggagaggaacttcactttcactgtcaaaaggactatttactggctgggcgcagtggttcatgcctgtaatcccaacactttgggaggctgaggcggatggatcacttgaggtcaggagtttgagaccagcctggccaacatggtgaaaccccatctctactaaaaacacaaaaatcagctgcgcatgttggtgcgcacctgtaatcccagctgctcaggagactgaggcatgagaatcgcttgaacccaggaggcagaggttgcagtgagccgaaatcacgccattgtactccagcctgggtgacagagcaagactctgtcaaaaaataaataaataaataaataaataaataaataactatttacaagttcatctctgttcctagatccatttattctctctggtaatcccctcaacagaattcctcttctctccactcccataatctatttttccaggatggtaaataagcttctgaacccccactgggggtggggggtggggagtggtaatccctctggggctctccttggttctccacatgtacatgttaaatcaatatgtatgccttttctccatttaatctgactcttgggagttgatttatgtttttactttttttttttttttttttgcgaatcttcagagggcaaaggggaagattccattggctcttacactggcaagctgtgtcttctaacttactcttacatgaagggctggttctgaaagcagagataaaaaaaggataggtgacaaaaactgctcccagtcccatgcttagtggagaaaagatcccccttgattttgcacccctctttttgacaagtcatcaaacaactgatctttttccacttactgcatctattttggctcccctaacagtgtacttcttaaaagtaaaaacaaaatctaattcacttgtatattctcagtagtatcacatgcctaacacctagaaaggattcaacaaatgtttgttgaatgaggaagaaaaataatacatcagagcagagggagagtgataatgccaggtttggcctgaaactcagcttctgcccttagggcactcatcaccccaagcagagaaatctcagggcgctggggctttggagttctctaatggagccacaggtgctgggccaactgacttcctacatgaaatctggattttagaccctgttttcctagacccctcatttcctgcttgggtacagctcttgcctctgccttttcttttttaaagttttcattacactgtgtactgatttctggctcactttgcttccctactattgttctgaaagcttatctctgattcagccccacccagaaaagagaggttgcctcaggcaatctatgtaggatgataataggtgtattaccagcatagaggaccactttctctctgtctctccattcctgccctggccattaattataatacattcgatttacttgggtttggtcttcagccctcatgcttttgcaacatcatgatgggctcatacatgatttttaaaaagagcattaacatcacaaatctcagaatgggtaacgtttgatcattcccagtaactatttcctgagaagatgctctaaattgtttttctttccccattttttcccacaaaatgtggctgtatatttttgcctcacgtatagctcaaaacaagaccaagaatcacagtgtcctaacagtggaagcgtcttagagatcaaccagtgcagaacctctcattttacagatcaggggtctgggtctagagaggttaagtgactggcccaaggtctcagagctggtatacagcagagcacatcgagaaacagtttaatacagccttcatccttagtaattccccagggccaagatgaatgttgacacccaaagaggaaactttgacctggaacaatgaccttgggtctctgcctatcaacagctgagtgggtatcagaactcttaatcttactccatcatgagatcaatcatctggaaatcttgatagaaaacctacagccacagaagtgagggtcagtggcagaaagttgatgacttctgtttttttgttatgttttttgtttgtgtgtgtgtgtgtgtgtgtgtgtgtggttggttttttttaactttttagggttgataatagaaggcatgaaaaaaaaaacaaaagcaaaaacgccctggagtgatgtgtagaaatcattaagctctattttttcttaatgtcccagccttcactgctattgccatgggctactaacaactgagaagcagtagtgggtctaagaacaagcagaaatagtgaaattttcaggatcacaacctaggctgactcccattaatggattgagcccaccgggcatttctgaggtcaggtccaattacaaatgctgtagcttttacaagtagatggaagccttcccttttatcttccagattccagagtgactttaaacaattagaagaaatggacaattcctgcgaaggaaatcagctctttaagattactcagttactcaacttcagctgcaaactcactgttgaaatgggacgtaaaattggttacagtttggaaaaaagtctttctgttttacaattgacatgatatttgtgtgcgtgtgactgattttcttacctgtcctttcaaataccatttgtatttggaggaatcgtcacatgccacagaggaattaacgtgaatgagctgatgccagacttggttctgcaggtctgtgttgtcaacaaagagtcaaattctgtaaaatatttgaagacatttattctgagccaaatatgagtgaccatggcccatgacacagccctcaagaagtcctgagaatgtgtgcccaaggtggttgggacacagcttggttttatacattttatctattttatgttattttattttatattttattttttgagacagagtcttgctctgttgcccaggctagagtgcagtggcatgaccttggctcactgcaacctctgcctcccaggttcaagtgattctcctgcctcagcctcccaagtagctgggactacaggtacatgccaccacaccccgctaatttttttatttttagtagagacagggtttcaccatgttggccaggctggcctcgaactcttgaccttagatgatccacccctctcggcctcccaaagtgctgggattacatgcatgagccaccacgcctggcaggttttatacattttagagaggtatgagacatcaatcaaatacatttaagaaatacgttggtttggtccagaaaggcgggacaactcaaagcggagggtggtgggggtaggggttccaggctataggtgaatttaaatattttgtgattgacaatttgttgagtttgtctaaagacctgagactgatagaaatggaatgttcatgttaagataaaagattgtggataccaaagttcttttgaagtcttatagtggatgcccttagagacaatagatgacaaagtttcctattcagatcttaatctctttaggattgggagggtctagaagaaagagatctagctatgttaatagagattctttacagatgcaaaatttcccccacaaagaacagctttggaggcccatttcaaaatatggctaagaaacatgctttggggtaaaatattttgattttcttccttgtctcataatgttatatgagtcaggttggaaaataagtcacaatatataggttaaataaaacccatctgatgaaaatttattatttgtagggcatgactccccacacctcttagataggaatttgggcaagacttaaaaaaaaacaatcagagtttagtcctcagtgtggctggatgggttctgcctcctccatgtcctctctctgggtgcctctcccttcctgaacttgttactctctgcagaagaaacagcatccccagatgcaggcgggagatttctctgcaaattgaatccccgtaatttggtttctctgctgaactctctgaccaatctctcaccatttgaagagaattagtcttggcctattggatctaaacatccacagtgtggagcatactttggaagtgacagaaacacggagtgaaatagagtctaacctattccaggatcagctcctgaaaacaaattcaacctaagagactttattgagaaaaacgagacatggctctgatcctggatcagtttatgtttcagtgagggtgaaaattttaacaaagtggaggagattaggatggaagtttggattcctagtgggactttgagtggaaagctgagaggcctcatgtagttgtgctttacaaacattaatgtacttagaaaccacctgagatcttgttaaaatgcagattctgattcaggaagtctggagcaggacctgagatgctacaaggtgtggctgctgctagccaacaggccacgcttaggccagcaaccttacatagcagcatggtgaacagcacagactttggaatcacacccacctgggtccaaatcccaactttctccctcactaaccatgtgcctttggacaagttccttaacctctctgggcttctacttctcacccagatccttacctcagctgcaaatgagaataattgtaacatcactgagtttgctccagtaaagcctgattgtccccagtccttgcacatagtcagagctctctaagtgttagccaacatcatcattcttatatccatttgctgtggaaaaagtggcaggcttgatatcagaaaagctctgcccatcttcctgctccatgttcctgtccctgtacccttgacttcatgccttttcttggagaagacaggcctagtctcaggtgacagtgtagcatccagccatttagcttctcctaatttggaggtgctggccacaatacctgattagagctcaactgcattttctgagtccccagggacaatgtccttccacataagcaatctctcatttccttctcatcatgtggatctcagcttcgatgttaattcttctaagaggacttctttgtccactcagctgacatagccactcacacctccctacagcccttcttaattttcttcatagaatgtgccactccctggaattatctctgcaatgcacaactcaattctgacaccaactgccctgagttagcacagccttcacaagttaaaagcacagtccccaacaaaacagccttctcttcacacaccagctgcaaacttgggtggctctcaagccactcacatttctgaccaactgactacaaatttggggttgctactattctttcagggtcaataattcactagaatgactcacagaactcaggtaagtgctatacttataatcagagttttgttataaaggatacaaatcaagtctagccaaatgaagagatgcacagggtgaggtcgggggaagcttcagagacaagagcttgcatgtcctctccctgtgaagtgagaattgtaggagttaaagaaagaggaaagaaacacaaaaggcagctcaacagtcaaagacaggtttattttggagaacaaacctaagaggggcttctggctgatttcagtcaagagcactctctcttacagactaagagtatttaagggttttagggtgagagagcttatcacaggcttggactgtttctgtgtggaagagaagtttattgcagggttgaaatgtctctggttggaggggggttatcttggggctgacatctctccggcctctctggccagaggggagattatcttggggctggcatgtctctggctggggaggggtttatcttggggttggaatgtttctgattggagatatcatttgtggtttatggtcatgctgaccttagcctgatgccctttggacttaggcgatttttttatcaaggggaactttaaaatggcggtgcttgtccaagatggtgatgctcctgctctgtcaagaattccctactcttctggtacaccagtgtgcatcaccaaccagtgacgctcacccaggctttgggtgttcaatgatttattgggatctcattctgtaatcatgattgattaaatcattggccacatgattaaatataatgtttagcccccttttcccctcctccctggagatcaggctgatatcaggaagctcaaagcctcaaccctctatcaggtggctggtcttcctggcacacccagcccccatcctgaaaccacctaggggcccaccatgagtcaccttattggcatggacccaggcatggtccctggcgctcactatgaataacaaacactcctatcacttgagaaagtcctagggtttagaaacttggtcccaggaacctgggacaaagaccaaattaatgacctgttatgagtcaatctcttttctctatttatttgctttattgtcaccattgtccctaacagtagacgggaatctcaggcagaagtctgtatcatggtgccaaggacaatgcctgccacattgaggcactcagacatgtgttcattaaattaatatgaatggttaaataaccacaaaagatgatttaaattagcatttccaagtaacaatggaggcagtgcatgaggcacttcatgataaattgcagaaaacttgcacagacaataattgttataaaggtccaagagaagcactatcacttgatttatatgcacaactatttttaacctcaacagggttttgcacatttattcatcttaactaaatgaaaacttttattcctttgtaccttgaaaatcccttgaatctgatgattatctttaaattaaggattaaaaaaaaactcttttgctaagtttttatacattctttggcaattctaaattaagatgcacatgaagtattaaatttatataactcattgtttaatctaaattagattaacccccttggcccttcagagatccaagtagaggcttccatacttttgtttatccatgtctcaaggttattactgacaaaattacaattagtcagtacttcatgtccattgttagggtgctaagctgtgagctataaactacctcactctggcataattaaaaccgtgttccagttcacctattttatgatacctacttggctttccataaagcttcttttcacactcctaactatgtgcaggtctgggaaacttgggaactttactgaagaaaactttaaacataagcttcttcttgaagtttgctgatagttctgttatagcagtcttactatcatcaggataaaaaaattgtactaaactattgtaaaaacataagatttgtattactacctctttttttttttttttttttttttttgagacagagtctcgctctgtcacctaggctggagtgcagtggcgtgatctcggctcactgcaacctccgcctcctgggctcaagcaattctcctgcctcagcctcccaagtagatgggataacaggagcatgccaccacacccagttaatttccacgcccagttaatttttgtatttttagtataggtgaagtttcaccacattggccaggctgatctcaaactcctgaccttaagtgatctgcccacctcggcctctcaaagtgctgggattacaggtgtgagccaccatgcccagcctctattactacctgtaaaataaatcctaattcaaaagtcgccatgtgtatgtacataggaaatagtgcatttgaactggcatttacctactggcataacaaattgctctttggaatagatgcctagtcccaagttaagaagaaaaggggactcctgtgtcccatccatagtttctcattaagtccaagagccaattgtgctaaagtaaatgaatatcttcaagctaacctataaggggtggtgggaatattagttgctagaccaacacttaatcaagaatctctcacactgtctaagggtgaatagaacaactagacttgtagaggattgcttaatctttttatgaaaaagtcatgtgccaattaagattctagccatacctccttcagggttttcttgacttactcaagctttagacaatgaagtggctcaataatcttttctgtaatccctatgtctaatgtattaagtattccttaattcaatttggtagattaccctaatcgattttgttttctggtatttaaacctttagaatttaattatattatactgaataggatacaaagtaggacttgagcttaaaagatggcctttcatttcacagaaaagaaatttatatgtcaagtattttgctgtggtattctcattgacatagctgagatgataatgtaaccagttcacgacgtcaggattgctatgagagaaccccgttactgggtgcttgatttgctcttttggtttatccaaagatactgagtttgctctgactgcctcggttttctccattttaacaaaggcaaaaaccaacactttgtattaaataacctaaaccttggcattgaacttgtcaaaagagaaaatgacctgaacattagagccaagaagatactctgttgtattttactttgttacttaggtatctttatttattctttacttatatatttcaaaaagacatagccttcctttatggaaaaattcatttgttattatttaagtacaacagatagatagatgctccaaaattaagtctgagtgttttctttgcctgcagaactgacagtttgcttggcttatgctgataatccccaaaaaagtcgcttgtgtcttgaacatccataggaaataaaactgtagttccgggcagtgtcgataagaaagcaaactttacaccttcacttaggggttgagaaagagaatgagctattgattccactctgaactttagatggccatatcacatctgaaaccagtcatttcgtggtgggcagtattaaacccgactttgtcttatgactttacaaattagcgaattatgttgttatgataagagaacccaacaaaagtatctgagtttggaacatcaattttcaggatgttatatatttgagaacacttctccactgctcctctaactcctctagcctacctaactttaatagccaggcctccttcctacctgtttccttcccccttcacaagaagcacctattaaggaatcaagaaaaaaaaaaggatgacacttactttcggaataaagtaatatagtctctactatttctgctttcacacagatttgccctcctttctggcacaattacacatacacacacacacacatgcagatatacttacgtatgcacacatgcaggtatgcttagaatttagcattaggctgggtgcattggctcacacctgtaaccccagcactttgggaggccgaggtgggaggattgcttgagccccaggagtttgagaccagcctgggcaacatagcaagaccctgtatttacaaaaaaataaaataattaaccaggtttggtggcacatgcccgtggcccaactacttgggaggctgaggcaggaggatcactggagcccaggaattcaagactgcagtgagctatgattgtgccactgcactacagcttgagtgacaaagtaagacctgtctcaaaaaaaaaaaaaaaggaacttggcatttgcaatcctgaacctactttaacccaaggtaatatggtttggctctgtgtttccacccatatttcatcttttagcttccataattcccatgtgttataggagggacccagtgggagatgattgaatcatggggacaggtctttccagcactgttctcatgatagtgaatggctgtcagaagatctgatggttttaaaaatgggagtttctctccagaagctctctttttgcctgctgctatccatataagatgtgactttctccccttgccttccaccatgattgtgaagcctccccagccatatggaactctaagtccaataaacctctttcttttgtaaattgcccagtcttgggtatgtctttatcagccatatgaaaatggactaacacacaaggtaaccacaactcagggcttaaaacttctggacaccagtgtagttggaagatatagagaggaagctgaagagaaatgagaggcagccttggaactcgttcctctcagataagggggaactgctatagttgtactcatgggtatgactacagcaaaaggatacaaagcaaagtcagcaaaaggaaacgtgcatgagatgaagtccagaggaaaccaaacacaagcttccaagagactcccactggagtccacagaacacacttaattcccccagctattagttgtggcatcatgtgtgaaatgctgtctacaacagaggctcactagagactcagcacccaaggttttattgggtactggtcacaaaggcagcccctaccaggcatgcacccaaaacccagactcccagaagaaaggcagttgtttagcacaaaccacattgtttgtaccaacagttcagcatagtggggcattcttattaatcagttaaccctcctgaaatctaacttggtgggccagccatgggaagcacttctccagcacaaggatgctgcctctctccttcccctgctccccaaacccttctccacactcttttccctctcccttccatagaagtattaagaagatgtgggaacatccagatcttcaacctcacaccaccctgcatcacactcctgacaccatcatactccacttccacctggctttgtcctgcctcttctaattcttttgttgtttttttttttttgagatggaatcttgctctgtcacccaggctgcagtgcagtggtgcaacctcagctcactgcaagctcctgccattctcctgcctcagcatcccaggtagctgggactacaggcgcccgccaccatgcccagctaattttttgtatttttagtagagatagggtttcaccatgttagccaggatggtcacaatctcctgacctcgtgatctgcccacctcggcctcccaaagtgctgggattacaggcatgagccactgtgcccggcctccctgtccgaattcttagagaaggaaaagaaaaaagactgtgctcttttcccttgagctgatcctttgtatctcatggcctgcagtttctgctgcatccattccccgggcagcaccagctacataatttgcaaagtccagtgaaaatgcaaatgcaggaccatttgtattgtgaattttaaaagagagacaataaaccaggtgccaggcccttctgaggctgtgagggtcacacacctatgtttctacgtgctagcgaaagcacaaggtcaaccctagattctgaatatcactggggcatggcagaccttgcagatgtggatctgcaagcttggtttctctaatagctttgaaccacaagaaacatttatgtgatgaaaaccaaactatatatggcaaaaatatttaacacaggggcttcttatatgtactggcaaaccatatcatattattgagttttccctaaacttgattacagaaattacctggggttcttatcaacatgcagattcccacacagctcccctagagattttgatttggattctccagagtggagcccagtaacctgtttttaagaagttttctagaatatttttctgacagggaaagtgtagaaacttaggctcagaatatttgggggcagacaggcctatgctgaaattctccatttatcagcagtgtgacattgggaaagttatttaatttcactaagcttcaatttcctcatctgtaaaatagaaataattgtgctagtacaaaaggttgctatgggaataaaatgagacaaatgtctgtaaagaacttagaacagtgactgctacagtaagctgtcagtaatcgtagttataaatattacagaaaaagagtagaactcatttaaaaccctcagttttgtaatactagatgaattaagcttaaatgcaaattgctaaaggcaacagttatttctgtcaaattaaactcattcagaaataataaattacaatctgaagtgaacaaaaggctcaatcagtcatcaatggtaaacattttgagcactgctatggtctgtttttgtctttccaaaatttatatgttgaaacctaatcacccacatgacaatatcaggaggtggggctctgggaggcaattaggtcatgaggccactcccattaatgggattagtacccttgtaaaagagaccccagagagcttattggccctttctgccatgagagacttcagctggaaggcacgatccataagccaaaaagtagaccttcatcagatatcaaatctgccttaatcttggacttcccagcctccaggactgtaagaaataaatttctgtttttcataagctacccagtttacgatattttgttataggtagcccagacacactaagacaagcaccttgtgttggcagtgtcacgatgcctccgttcttgtcttcttagtttaaaagaatttaaacagctgggtgtggtggctcaggcctgtaatcccagcactttgggaggccgaggcgggtggatgacctgaggttgggagttcaagaccagcctgaccaacatggagaaaccccgtctctatttaaaaaaaatactgaattagctgggcgtggtggcacatgcctgtaatcccagctgcttgggaggctgaggcaggagaatcgcttgaaccgggaggcggaggttgtggtgagccgagatcacgccattgcactccagcctgggcaacaagagcaaaactctgtctcaaaaaaaaaaaaaaaaatttaaacaagagacgcacagtgaagcgggtgcagcataatttattgcaaaagaaaaagaatactttgaaagttaagtgcagaatagacaggatgctctgagagagagaggagtcagggtgggctgccggggaggatgagacagaaaagattggcgggagggagactccccttatgggagtcttacctgattattcctaaggaggtgaaaagaggtgttaccagtaagcatgttctgggtggttctctgggtgcacatgcgcagtagccgcacatgcgtgttcatacgtctcatgtctcattaacatcttaaatctccacctaggggtgtattttataccattataatgaacaaagggtcagtctgaggacggatgaaatcaaagtgcgcatactctctacagggggagtccctaatgaagatagctttgcttgaacgagctcaattaccaagcgaatgctggggcttattgtattgactgtgtggtcaccacggttgctgcgtcctaagaacatggtcatttcttttttcttttttttttttttttttttttttttgagacggagtctcaccctgctgcccaggctggagtgcagtggcacaaactccgctccctgcaacctctgcctcccgggttcaagtgattctcctgcctcagcctctcgagtagctgggattacaggcgcccgccaccacgtctggctaattttttgtatttttagtagagacggggtttcaccgtgttggccaggctggtctcgatctcctgacctggtgatccgcccaccttggcctcccaaagtgctgggattacaggcgagagccacggcgcccggcccatggtcacttttttgactacctatcctgcctcattgatagcaggctgcagatacagaggcgtgaccgatgatttttgcaatcaaggaattgatcatctatttcaggataagttagagaggtgagaagatgcatctctttaaaaggaaacacataaaggttaaagggcaaagcaaagagaatgagtaaagaccattttccgtggggattggtggagtgggtagaaggcttgagctggagaatattagacaatgattagccaaacgtaaagaagcaaaagtttcctgtagaaaaatatgcaaacatacacagtaagcattcagtaaatacttgaatgagaaaatgagacctgagttggaaccagaaaaaccgacaaatgccaataatcccagagctgaagatagtctgtagacagtggggagtttgttagccagaaataggaggggtgagtgggaaatctttaattaaaataaaacctttaatctttaattaaaatattaaactcttcacttgtgcttagttgcagagatctatgcctatgtagttttttaaacaaataaaacaaacattgccaataaaatgatgtaattcaataaagggcttacagtaggttccacatccaacaacgctatactgaaaatacacaattaaaacttattgttatattctcattatagaagtctttttttttgagacagagtgttactctgtcacccaggttggagtgcagtggtgcagtctttgctcactgcagcctctgcctcccgggttccagtgattctcctgcctcagcctcctgagtagctggaattacaggcacgcaccaccacacacagctaattgttgtatttttagtagagacggggtttcaccatgttggccagatggtctcctgacctcaggtgatccgcccacctcggcctcccaaagtgctaggattacaggcatgagccaccatgcccggccagtagaaatcttttttaagaagacttttaaaagctactcattttagacaagcctttcttaattgtgtaagaatgcttggaaaaaagtagtattttactatttttaataaatctgtaaaattattgatgactgctagcttttctgttttgcttcatttataagtgaatgaacagtgattgttgtgggttgaataacattccccaaaagagatgttgaagtcgtatcccctcatgcctgtgaatatgatcttgtaggaaatagggtctttatagatataatcaagtcaagatgaggccatactgaattggggtgggccctaaccctatatgaccggtgccttataagaagagaaagcgcacacacacacactctcacacacggggagaacactatgaaaaaatggaggtagaagttgcaattttgcagttgccctgccttaagccaaggaacatgaaggattgccggctactgccagagcctgggagagaggcacgggtgaacattctccctcagaatctgcagaagaaatgagccctgccaacttggactgtggatttctacccccagtactgtgggagaataaatttctgttgatttgagccacccagtttttggtactttgttaaagtagcctgaggagcctaatacagtgacttcctaatcaaagaatgtggaggcgcaattcaagtggtcttttcaactccaagaggattgggctgtgtttgttatggttaaaggaccattagcagttgttgaaaggataaagggaaggtacttcagtctgatgcggagtcagtgaggacacccaccgctcccctgcagagcagtgtcttgagagagaaagggttctcctctctgtaggagaagcaagctccattcctggtgctcctctgtatgatgggcatggctacctatgcctgccctccagaggggaagaagcctttgtgtttaggaccccgggatgatgttgacagctatgatcacataataataattgtatgataatgattgcagataacatctgttgcgtatctaccatgtgtcagatctagttaagcacttcacaaatcaactcatttaatcctcgcaagtatatagtccatgaaggtcatattattacccttattttacagacgtgaaaaccatgatagagattcagtaatttgctccaagtgacacagtgaatgacagagctggaatctaacccaggcaaattggctccaaagcccatactttcagcctttacagtttagcaaggctgcaccagaccccaacaaaaactagttcttttgtataacaagagaaagattccctggctgaattctagcagactagattcctcagtgccattacgggctgaggacttacaaacatgaggaaaagataatggctagtttggttttctaggtctgccttagcaaattaccacaaacttggtggcttaaactagagcgacttctctcaacagttctggagccagaagttcaaagtcaagcatcagcagggccacatccctctgaaggatctgggggaggatccccttcttgacttttccagattctgggggctcacggcagcccttggcttatggcagcaaaactcccaactctgcctgtctccacaaggatttcattgtgtgttcaagtgtcctttctgtctcatgtcaggaaagtctcattggatttaggacccacgctaatttagtgtgatctcaagtgatccttagcttaattacatctgcaaatacccagtttccaaattaggtcacactctgaggttctgggtggacatgaatttgggaatggggaatgatattcaacctgctacaatggccaagaaacatctacctagttcaaaagagaacaggatctactggaaagcttctcagctcttggagccccacaactgtgtctcctgggtcctagccttcagcctggctctcagcacagctctttgcggataacatggctctacactgcgtcgaacagatttggtggcagtgactcacctagcagagttctcagcagcccacctggaaggtcccatcacattgttgttattgcagatagcactttcactgttactcaattttttttctagtatcttgtgaacaatgtgtttcaaagtataggacgacttggtggttaatgtcacaaaagcaatcattggagttgtcaatcacagaatgacattacataaaagaattaggactcttcttgctcaagatgctttatacatgagcataaattgagagttatgtatatttggatagtagaaaagctatacattaatgtgcatcttaatgaggatgattttcttcttttgataaccaatgtgtctatgaagccatctagctaggtactggtgagaaaaatgtttcaaataaagtatttttattggagcatataaaagagttacaaaaatatttctgtaaaattttctggtctatttttttcaggttggtactttttaatggtttagctgttaaataagcttcatctattaacttgtattcagaaataagcttaattattcatcaattcatgctcaccttatattttatggttttccaaatggatgatatcttctatgtctgtacattttttattaaacataagtcattttatgcccataaagcttattcctgaaaaaattattttgctactaaaaaagatcattaagttcacaaattttctctccatggcttgatgctgctatctttctgcaccataattagttgcatgtatagttaattattatgagaaaagcagaacatctcccaatttctacaagatacttagagtttgatggtttaactatgttttctccttcatttctcccatccaccctccagccacgtgtattttcatggtaggaagatgataagcatacgctttttcaaaatgacagcaaaatgttcatcaggaacttcataaagctttgatagactgaatatatatttagaaccagcatttcaatggctctttaccttttcttaagaatttccttatctatgaccctcattgctagaaaaaaaatgcgcacttttatataaacacaacatttttcatataattttaaagagatttgaaaccctctgaaggctatatgtagtccccatgccaagaatgccagatttgggaaccaacatttcttatccatttataatgctaattaattatttctcttaaaaaatactctagttagcctgtaaaattcatttagatgacacatttaattttgcccaaaaccttgatttttttggaggaaaaaataatgtaagaaaatacattattttaggttaggatctttaaattctcacagtcaaccaccatggtttctttgtacgacctaagctcattcactggtgggcaagtgttttggggaccaggagtggatctgattcatctctgtatctgccacagagcctagcatgatggtttagacatggagggagctcaagtaatactgttaccggtacacttgttatttaattttaaaaattaggaatggctactgtgtaagtacataaacatttaagttcataaatttgtttacagttgaacacaaaaaggccatttgtgttcagatatgtgacctggggaagaaagatgaaatgggtattttgatcagcacggggagcagtcagtgggcctacagagaaggcgattagaaaagccttgtgctgacagtgcaggttctatgatatggaaagaactagtgaggaagatgcacatgcttagtagctcctaggaagagttctcaaggagcatcaacctctatgtgtccttcccaaggaagcagtgggccctagattggaggaattcaggataaaacacacagtcctgctaaccatttcttatcccagtcacctgaagggatgagatcagaattactagggaaagactttgcagtgggatagatatgcttccaaggtacttctcccagcccctaatacttcctgtttgctaatgcttaaaatctctctaacctaaaatctccctaacctaacctttcattttaacattagaggaaaaaaaatttgctaaatattgactgaaatttattcaccctaaatttaatcacaaaagtacaagagcaagcatacttcctctctgattccgtgaatgagaagtattgaggagccaaggttggagaaggggttaccattgagaatcggagagggcaccagaggtcaagactggggaaaaagacaaattgaaaagacattctatctttccctaggattgttccaattatcaatcctattagataagcatatgtagaaacctggtataaaagaaattattttgtatggctaaccactctccttcaaaaaacttcacaatttgttaagtttagataaagatttatcctcttgtttgattagtttccttagaaataaatttcattcttaggggtttcactaattaagataaatagacaattagcctcttggcagcagaagctacttcttatttatctctgtattcccaatgcctaggccagtgcctagcataaatattgtgcttaatcaggattataatatgtatatttcttgaatgaagataacaaaaatatctattacaactctaagtgatttattaattgatttgagaaaggatttatgttaacttacaaaagttcattcaataagaggttacatcaaatatttaaatcattgcaagaggaaattagaagtaaagccaatgaaatgaagttatatagctaataaatcaatttttcttagttgtaataagtatacaaaatctttctgcatgtaatgtgtatgctatcagcttaatataggcatgttttaaaccatgataaagaaaatattccaatatctcaaattctttcagaattatgccaaccctagaacacagtttctagtatgtgattaagccttctattttttaaaaaagtatttctcaattgactgctttacataaatcatataggtgtaaatttgaattattactacataaatttttcttagatttatgacagaattaaaatagccttttaagtcttaaaaatattaataagaaaagctcaattatgtgaacacagctaataatacattcattctggcaggcattgtgcaaagttttcaatgaatatgaatatctttatgaaatatgagaagctttgttcatttacatacaagttccttagtctcctacattaattattttttctcattttttcatgtggaaccttttccagtaagttctcataagacaacaaatgacccagtggagtacctatttaaaacattataaacaaagaaagcttctttcttcagccctgttctttaatatgtaatgaaaatgcttcatctttcattacagaaatgttttatgttctaacctcttaacctcattattatagtttggttagatttttaaatagaactcgagtttttctcagtgtttcagacaggaagaaaggtggagtacctgacaacctgttccaggaaagaatgttcaataatcaagcatctatctcctcttcctgagttaatccagttagcttatgaggcaagcatgggggagttgcaaagtaaatcaaggtgctgaattctactctcatcctgatcctaaatggattgagttttgttctttcttatgtactatccccatattcacagttacagactttgcaggtcacttgctgtctttgtcatattgggatgctctaacataccatagactgggtggcttataaacaactgaaatttgtatctcccaggtctggagaccagaagcctgagcccaggctggcaacaaggtcaggctctggtgagggcactcgtctcggtagcagtctgccaacttctccttatatcctcccaagtgggaagaaccagagagctcgttagggcccctttttataagggcattaatcccactcatgagggctccatcctaaagacctaataatccccaaaggccccccttctcatgccattacattggtgattagggttttagcataggaatttgtgggggacacagacattcagttcatagcagtggaagataaggggtgctgtgcagacatcatgggctctatgtgtcacataatgtagcatctcatacagggtaaacaatcgccactgttatctcttcccaaagccctgctgtggggtctgctcaccggccctgcatccagtcaaggaaggggaggtggagaagggcacttgaatgctgagtggcaccaagaggaatgtgcagatgtcataaactggaaaattggggctaaaggtgaaacagcatcatacaaatgtcttccctccaaaagctcaatcttattttagaaatatatgatccatgaggactttatcataaattggcccaaaacagccagtcagctactgagggtcctcattttccaatgagtgcatgttttgctgcttcagtggtccagcacgatttggaagtattattgctttgttactgaagagacctttgttttgattcagttgccaatattctctaagatggtttaatgtgagccatggtacttaggtgtaatcctgtaaggtttcttttcctgggattcacagtccctgctttcaatagagtctcacgagggtctatgacccttccagacagcactgatttcaagtctgtatcactttataaaatcctacacatagtcgtgatcttagaaaaaaaatggacacaatatagaacacaaaaagatgaacccattactaacaaatctccatatatccattgtatctaagtcatactctatgagcccaaaggctaataaaaaaacaggatcagacccaggtacaggggcaacagtgccaacttctgaaagcagggatattggtgtagcgaaatagagaatatgaaagaaaaaacaatactctgtgagaaatagcctagtagcctatactttatgccaataagctttataggaagttctttttttttttttttttttttgaaacagagtcttgctctgttgccctggatggagtacagtggtacaatctctgctcactgcaacctctgcctcccaggttcaagtgattctcctgcctcagcctcctgagtagttgggattacaagcatgcgccaccacgcctggctatttttgtatttttagtggagacaggatttcaccatgttggccaggctggtctcaaactcctgacctcaagtgatctgcctgcctcggccttccaaagtgctgggattacaggcataagccaccgtgcccggccataatagtaacttttatatcccagacaaaaaaaaaaaaaaaactgagttaggcttacagacttgactctgaggggctcatgataataattttcttttttttttctttagttcgtttgttttagcatgtgctcagaggaaaaagaaaaagaatttatggaagaaatctctaaatcatattccgttctttcatgaaagtgggcaattcaaataatttcactcaattttcaagtgagatattcacagtaatttgtatcttcaggttgaggctaagcttcattgcacttcatgggaatatatagaacattctagcaaatctttcttagactattacatctttgacttacatgtttatgaagaatcatctgtgcctctgattggccttatataaatacaagggtcatttcagagagcagttcttaactgacttggaaaagcctaagagccaaacaattcagcagctcttccacattgatggcaccagccacatgcagtacatgtgctttacgcatttcattattgcatctctttgtcttatgagtttattgatggaaaattgtgccttgtcttttatcaagtaaacatatttcagaagacatctacatgctatcaacaaaacagagcaaattcagaaaatgtaggacttcgttgtacttgggggattacttcaattgccttaatagtctaccagagtagaaatattacattctttaaagttcagataaataatttgtgctgcttatgtaggaagtaagctattctccactgtaagcagtcttttatgttgacaatatagaaataatctgtcttataagctacactgcatctaaagccctgacactacagatttatgcatacttctggctgaaaataatattgaaatgtgaaaatgaaatctttcaccaaatctctgggaacataggtttgaggctggctttggaatcactaaaaattcattgattcccaaacgtagactaagtaccataagaactgactagggtacttgattgagcttgtgctgtatggtttattacactggtggtaggaatgtgtcaatagtgattatactgctctaagtattttgttttagggtatgattctagcttcccttgtatcattactcaaaactccaaatgaagtgtgtaagagtatttttcaaccctggatttacttgcattccatactcattaaatatatgacacaataaaatgtctaggtcttatgcaaggaacttcaactcttctatggctcctggcctaaaaaggtatctgtgagaggcagaataatgtccgccaccaaagatgtccacatcctaatcttcagaacctgtgaatatgcgaccttacatggcaaaggggatttagcacttatgactaaattaaggatctataaatgcggagattttcctgcaattcgctgggtaggtagaatctaatcacatggatccttaaaaatagtaggaggaggccgggcacagtggctcatgcctgtagtctcagcactttgggaggccgaggtgggtagatcacgaggtcaggagttcaagaccagcctggccaaaatgatgaaaccctatgtctactaaaaatacaaaaaaaaaaaaaaattagctgggcatggtggcggttgcctgtaatcccagctactcgggaagctgaggcaggagaattgcttgaacctgggaggcagaggttgcagtgagtggagatcacgccactacactccagcctgggtgacagagcaagactccatctcaaacaaacaaacaaacaagcaaaaaacatttgaagcattgagattaaagtgttttctttgattaaaaatctgtcaagagtaattagaacctgcttcctttcctcttctcattgtacagcttacaatatggatcaagaaattgtttctattgacatacttctttccatgtttagatcggcttccaagatcttatcctttccactttcaatgtcatgaaaaatcattgagagttcctttaatgcgaaatgttatgccagtgtcacttcctgtgagacagcttcatcctttttggggtcacaaccaccttccttatttgtgtagttcaattcatttaacctgagttcctctggctacaaatctggagtctctgaaacaatgacacattcagctattgcttctataactccatttacattcatttcacatttcactttcagcatcatcactctctgtttcttgatgcacttttatcttagttagccaattctcccttctcgtgtccagttttgtaaagtgttatatgggcttatcactgggaaacaaggaggcaacataaccacatgctttgctgtgtgtggaaagaataacattatgtggagtaacaaacccttaatagattttgaaagaagtgacatggttggtcactgatcatgatgcacatctgttatttctgtatagatacttctgaatgcacaatgaggttatgtcccaataaatccatagaaaacacatagttgaaaatatatcaaaagttgaaaattcgtttaatacacctaacctaccaaacatgatagcttaacctagcctaccttaaacatgctaagaacacttacagtagcctagagttggaccaaatcacctaacacaaagcctattttgtaataaaatattgaatatctcatgtgatttatagaatactgcactgaaagtgaaaaacaaaatggttgtacaggtactcaaagtacagcgtctactgaatgcatatggcttttgcaccttcctaaagtacaacaattttaaggcaaactgtcataagtcagggttcatctgtagtgtttttggacaggagagctagtaacaaaacttgaacactatacatatgcataattaaatttgtatattatgcaattactcaaacttagtatagcacagtaactaaaatttgaaccatgttgggagactggtatatttacctatactatagtaactgaaatttatgcatattaaagtgtgtgcaaagcaaggactgcctctttgtgtgtgtatgtgtatgtgtgtgctctgtatgttttgcatattttcaaactttaaataaatgccatcatataatatttatccttttatgaacttgctatttacattcaaacaatgtttctgattattcttattaatgtatgcagtcaccgtttatttctttttctgttttatgatattccattcacatgactatactacacttcaagttatttatgtattctttattgaaaatatatattgctttcagttttttatttttgcaaatatgactcctctgagaattaatttattgcttccatgtagtcatgtgcaagaatttctctaaggtaactatatctaggtgtggagttattcagttttaaaccttattagatatttccaaattgttttcccaatttacactttcaagtaagttttaattttattttgactcaacttgctccataacagttagtattggcaaattccattttaccaatctgatcacataaatgaatgaggctaaactaatttaatttgggttttcttgattaagggtgagactgagcatattttcaagtttcctcaaatatgagttatctgtatcttttgataattatattaatatatattatttacataaaccaaatattaatgtttataatttgtatatactgcagctgtcatctcctaatctttgtcttgtctttttatttgaattatgatatattttgatgtgcagaagttttaatttgaatatagtagaattcatccattttcctttttggtttatgttttgtgtcttatgtcataaaaatattatcttttgtgcttcatgccttttttcttttatgatgtcttttttcttttaaaagttttaaccgttttctatgtttgggtcattaaaatacatggaactcaatttttttaatggtataatctaagggttcagtttcttatttttgacacatatacaaccaaattttccatcatcaaacatgggaaaaattctttctccactgaactgtaaagccacctctgtcatacatcaaggtttttttttttttattagactttattttttagagtcaatttaggttcacagcaaaactgaatagaaagtacagagatttcacattcaccctctgcccccacatatgcacagtctcccctactgtcaacatccatcaagtttttatacatgcaagggtctcttttgggctctatatttttttcctttgttcacattgtcaatgctgcacaaatttcatactgtgctagtgatacatcttcataatagaacttggtttctgatagagtttagtctacagtgttgatttttaataaagttcttaaaatttctaactaaaattcatgcaaattttgctactgcaaatagtatcttttaataaattactttttctaatgattgctgatagatagaaatgtaattttttgataatgtgagacagaattcacattacatataattcatccatttacaatgtaaaagtcaatagcttctgttttttgaaattatatgtatatatataatcatatagtgtgaattctttgtgtctgacctctttcagtcaacgttatgtttctgatattcaagtttttgtgtgtagttatgtccatttatttttatcactgtagagtatcccatcatataaatatatcagtatttgtgtatcctgttttcagtttgggctattgctgattatacatcattattctagaatttccttttggtacattttaaacctgcccactctctagagagtattttattattttctcacggttttcatttcttttggtctgtcttacaagtgtcttaagtatatttgttttgtatcttttttataattattacattaccttgagggtttagagggtttttctggcactttttcacagtggcttatttcctcatctgttttggtatttttgttatctttctgcttatcccttgcaccttgcaatgtgtgagactcattttgtcttaggttgatgttgctctgtctcaacaggatttggatttgcttatacacgtgctttgatacataatctaggttgggtttatgttcatttattggcttggcttttcttggactctcaagtagtgtatactcaaactgtagacctctgtgagggcaggcctgtggttatgaactctcaggagaatagctcttccttattcagtattctggccaagacagatgacagacatttcctatggccagtagtcagctgtgtttcctagaacatcctatcattgaagatgtagccttcaggggcctcagccctgtgcatcctctagattcccaccacaggggagcccagggcactttcctgtccctggaatgctgtgcaattcaatcctctcgctttccaagataaaggaatgtccccagttaagggccagctcaccactctgatgttcttccccatttttttggtttttgcctttttgtttatttctttgtttaagaggggatgttgctttgttgcccaggctggcctcaaactcctggcctcaagtgatcttcccccctcagtctcccaaagtgtcgggattacactggcatgagccatcatacccaacccttccccttctttttctaccattgggatttatcttgctctttcgagtccccagctataccttaaaaaagacacttgttaatttttatgcagcatttgtgggaattattttagagattttcagaacccctagtctgtcataataccaggatagaaagtagaatggtgctggccagggcctggggagatggagaaatggaacattgctgtccaaccactgtgaaatttcagttatgcaacaggcataagttctagggatctgctgatccaccttgtgcctgtaggtaacaatactgtatggtgctcttcaaaatttgttaagagggtagatctcatgttaagtgtttttaccacaataaaaaaattgttttttaagagttgaagactattttctgaataaaaacaaaatgaaacctcataagtaaattcagagttgcctagtaaaatgtgtcacacgcataataaaagtgtaaaacattcacactcctcactctcatttaattatcaagaattaattaagcttttatttttcttccataaattccaagttcccgatagctaacttccaaagctaaaagtaatgttacttttgactcttttgctacaacaaataatactacactaataccctggcatgtattgtgtggctatgtagagtatatctgtaggaaatgttggtggaggtggagctgctggttaagggtgagagaaattttaattttctagctttcaaattataccattcagcctcccttttgtaaactgttagtttaaatttgcttttctgtaattgtacgtgagtgacaattattaaccccagttaaatgaacaaggagttgatcatctgggggtgttcacagtgctgaaattatgaggaaaagatgtggttcaggagaagcttattaaatgtactttcctttttctccacccccacaccaacatgctgacaatagaaactcattctcaaactgaccttattcaaggtaagaaggtattgttccagtgtgttggtttcaaggactttcttccatgcagaataaatagtagaactaaaatatcactaaacctctaagtaagcagattatgtgctgtcaacggtgaatgcccaatatatccacagcgcaagaacttaagtagacagaggtattaactgtcattttatttgaaggaagccaaaaaatcttgtgctcacatcatattccttaaaacctcattcttccagaatggctaccacagtcccaggcatcacctggagacagagacataatacccagcagaagaaaagagtttattattttatgatctctctgtttgaagaagaaaaaatacaacactttcttaaaaatttctaagtggacttcctcttgtgtattattggccaaaattgaattactgaatcatatgccaaccccaggaaaatcaattattggtgtgaggaatagaattcccctgatcaccttagcctaatcaatttgtatccatgacttacacaccctgcaacaaaggaaaatgtaggacttgctattgattacgtacacaagtgtgcctgatgtggacagcaaataagtttgatggtattgtttgtcataaagttaagtaacagcatgagtaatatggccctctgtggaatttcttggtggcagttgagcaaaatttaaattgctctgaaatggaggactgtgatcacggaaacaaggtagagttagctgatataatttggtacaaggaaattaaccatggttgggtttttgagccatagatatgataatactcagaaatatatgtaataatgcagcattcccaaatgattccaatgttgagttctccacacaaatcatttcattttctttcagttggtgttaaagatattggagtcctcatttggaagtcactcactatagcatttatgggaaaccgagctctgaattacaaacatcgagttgacaaacgaaaatctggaacagaacccactcaccagctggcgaccacccagtattatttgactttaaacttgatacttgaacatgattttttaaaagaaacttaagcaagtaaacataaaaaaaaaaaaaaaaaccacctctctttgacttggtcttgcaatgggctttttaccgctttgaaatggaatacagttttatttccaataaacagcagccgtaacaaaacttcacacagacacctggagaaggggcatttgatgaatgcaatactatcattgtttattatagaattatttactagaatctggcagagatcctaaacaccatttaccataactttggccaattttcctaaatccatacttcaaactctactgatataatgggctgctttagccaagaatgatagctctgttactccccaaatattaccaaaacaaaggcgtggtcacttcccacaaatccacctggagtatgagtcaccagctgccccttgttgatataaagagctcgaagaatgaacagttttgaaatccattagtgaatcactgagaatccactcagtacagcttggagatctcaacagaagccaataataattaaagaaagaaaagctctgggttaaaggaaagcaagcaatccagcggaaccaactagaaaacatcagccaactgcagcgccttgctggaattagggcagaccacagtctagtgcctgctagagcaattgaaggaagcccagctgagagagaaggcttcagtaaagaaaattagggaaggttttatttttatgtgaagttcttgtgagaaggatgttaagagaaagcattatctgttattatttatgattgttgagccccacaagcaagcctttgagtttttataagcccacatagcatgtttttttgtttttgtttttcctgagggtaaacacttttatttgtaacagcattgtccatggctgtcaatgtatctgatggaaaatacctgtccataagcatgaaggaaatccatgatcttcccctttaatttgcagaacattacatagtatttttttaaaaaagatgcaaatagcagcctacttctttgctgctaaagagctttaatggaatttttagtgaatcagatgtgtaagggctgatgtcctccaagctgagctggatctccccagttcttcctaaggttccttttgtgtcacattcaactcaacagacaggaagcaactctcctgcagtgaaggccgcacagtgggctctgctcctaaatccaaggacacagaggagcgcctgtgtccccaaatcaggaaggcgggcatcggcgagacccagtgtcacagagaacgagcatttttgctgctactgttctgtgcaagtgatcacagcccagatgtacagtatgatttggaacctccacactatttagcatcccttaatttgtatccagtgtgctaactgacctggaaacattagaaccccatttccaagtttctcttaaaaatccccaggtcccaacacacaccaaccactttcatcctcaacagggcatgttacgccagagacagatccttctgcatgcattttgccttaatgccagtaagaaaattgattttttgtttcaggatttttcaatccagaagacaaagagattagtcagcagcttttaaaatgaaagtttccaggtgagagatttcaacactattttgtagatctggtgaattaagatacatattttcagtattttaggaattcaaattctaatcctttccaattcaccaactccctttatccaaatccatggaatcagagtctaatgaaaggggtacttagcatttgattccaagctttcccttacaactacatttacaagaaagtattttgaagctgagaaaactgacaggtcctgtggttgatctgcacagttctatttcctttgggctccaaatgttaaagcacatgccctggcaattcgggcaccagttttgaatgaagacacccagcatcttgcacctgcctgccaatctccacgtcctttgtagaggaccggggtggacatgcccatcccctcctggggaagtctgtttacactgcaaactcctgacttctgcatggcggtagagctgattgtgatacctctgtccacctatgccagcccaggtgcctgacttgtgttgggttaactattctgatagctttgatatggccttcccacatgtgccttctcctactgtggccgctgtcactctgtctccactcccatgacacttggatgctccagtgacaccagctcctgcacagtaccactcttcagcagcgttcatatcaaactgtgcatgtctagcttatctgggggaagacactgaagagaggcagaggtggagacgtgaaagaagacagcaaaatcacagagcttcgcaagagaaactgcttgcttaaagataatttcttcttctgattacaaaagttacacatgctcattgtcaaaatgctggaaaatacagagaagtttaaagaaggaagaagttaccataatcatactacccagctaacatttcggtgtattggtagtagggaaatttctggttgtcaaggaggaaggtatatatccctaatcacagaggttttttcatgctcttaggtcctaagttatagcattttaatgggagatttctaagacggaaggtatttctggaatagcattccttccctttcttctgcagatctgtcaaattgttcagctttcttgactaatagatgctatggatagagcatccctctctctctaaaaatctcaaaaaaagcaagtcttatttattcaggatttgaagagaaatattcaggaaggatatttcatcaaacctgattcatatattatgcactgtaatgatgctagacacaaaacacaagatttcttgatagatggtcagaataaattacaccaactgcattagctcagcagcagtcctgcccggatctcagcacctgagcttctcatctgcgtatggttgctcagcttggtcactgagacatgcaaaagggaaatgggcattttccctgaacacctaaatcctttccaaaatctgtcaaaatgtttactaaaatgtagcttctttgtttatcagacgaactgtggtaacagcagttatgaaacttatcacagttcatctgataaactacattttagtaaacatttcaaagtgaagcagatatgagagagaacaaaattatttgtgtttacatgagacttggaattgttaaaatttttatatctagcatacaaaaaggctgcttatgttaaaaattgatagtaactaaatatataagaccaaaagaatactaataatgtgaattaaaatgaaatcttagcttggtttataaactatgaaatttgactaaaatctattctgtatatatgttctagttttagaatataaactagaactagaatctaagtagtagccaattggtaagtagtgtctgactgggatctaaaccagttcagattaaaccattgcaacactactcagaaaagcgtatggtcaagatcttccgctatggagattaacaagaaatgcccatctatgtaacagtaatttaaaaactgatagtggtatattacattccagtgaatgacgtaaataatagcctttttaaccctcttgcgaatatacatggtatttgagaaaaacgttgcttcagaacaggtgaaagaatatgcctggccaaaataagttcggctacccaaaatggtaatggcttaagccttttggtttttatctttgttaaaggcagcgagtgacattttaatcttcttgtgcaggtttttctaaaacacaaaacgctttctgttaaaactcgccacaaaggcagaaagggaaaagcattcacagatgcacacagattccaagaactctctcacactatctcaggaactcttactgctccctagaaactgtttttcatcagaatggggaaaataacacgactggtacctgcaatttctgacaccaatttcacatctaacctctgtaggtatttaacggactcagggcctaactgaaactgctgctaactattgatttgttgaggtgttcatcccaggtggtttatggggactctgtaaatatgggctgataatagtaatggtcaagctcccataatttcttaatttcagtttatttatttataatatttatggttgtaagatcgaatctggtgattatctgtgctgggggcagaaatttcatttctaaaggatggcggtaaatataagcatgttgttggttgaatgttcaaaaacatatttcaaaaaccaagtactaacagctaaggggaaaaactcacacaatgaaccagaagtgtatgaaacaaggaataaaatggaaaaggagaaggcatgaatgttggagggatttaagttatggatgaaactacagtgaacattcagggtatgttgggagatgaaaactgaagcatccttttactcggtagcaaaagtgaccgggatcaagggtcactcccggatacaggtatcccggagcacctccacaatggcttccagcccagacctttgtcgtgggaaggagtcccatgctctcatttttggcacaaacagagtttgactctcaccacaaaacagcatcaaacaatgtcacaggctgtgcttctcacaaggttttttgtttgttaagttcattttcctgaactcaaacattgtgggaagaagtaggtcataatatccatttccctctaaattgatccagagcttccagaaatctgaagaccagtgaagccaaggtttcttccaaacatagagttgtgtgaaatcactatgtaaaactgtcagcattattttggtggcaagttctgtccccatcttggctctcctccctgcctctcccacagcctggtacagtcagctatagagttcagccctgaatacctgctggatttacacctagcaatgcatctgttgatctcactgatgtgaaaatcattttacaaagaattcccactgcattttctttagcatggcattcacattcccccatagtgtggtcccaaatcactcctggtcttcatcttctaggttcctcagaggggacctcctagcatcagtctgggaattctctgtctcctatgggatccaggacctggaccacccagtgtccttccaacaggcctgaaaccttcctatgtgcaggtgtggaatgctgctttcgcttcttgcctcccaatatcttattgattcttcagttccttgttgtaatctccctcattcagagttgttttgtgtttgtgttttgttttgttttgttttttgagacagagtctagctctgtcacccaggctgtagtgcagttgtgatatcttggctcaatgcaaccaccccccaggtccaagagattcttgtgcctcgggctcctgagtagctggacttacaggtgcatgccaccatacctggctattttttatatttttagtagagacagtgtttcactatgttgcccatgctggtctcgaactcctggcctcaagtgatccgcctgccttgccctcccaaagtgctggggttacaggtgtgagccatcgtgcccattctcagggtattctttttttggggggaggggtgtgaggggagggtgaggagaatggagtttcactcttgtcactcaggctggagtgtaatggcgtgatctcagctcactgcaacctccacctcctggatgaacgattctcctccctcagcctcccaagtagctgggattacaggtgcctgccaccacgcccagctaatttctgtatttttagtagagacagggtttcaccatgttggtcagtctgtttttgaactcctgacctcaggagtggtccatcagccttggccttccaaagtgctgggattacagacatgagccaccacacctggccagagtattatttaattctctgagtaaccagaagccaaaggatattgcttcacctttagttgccatgtaattgaggcatacctcatcatcagcagtacacttggttttctatactggattacacaccttttggaggcaggggctacttttattcttctttaaatcttcacctgcactagcatgctaaaacaaggaaaagaaagttttatcttctatactggaaacaaagaaaaacaagggtaattcatcttacttttatcactagtctccgattaactacatgttcaagtttactgtatagtatatctatgtgatctaggcaggcatatttcccctcaaatatataatatggcaaaataaagtgcaagttgtgattggtgaagataaatgactgaacttttactatcatattctcactctgctgataaatcatctttgagaattcgtattaattttggtcaagaaatacacaagttaaatccattttattcttttttttaacattgggaggactaagtgaataaagaaggagtgaattatatgattgtctaccccacagtttcagtaaaacgatattttttcctgcaatatatttatgatctgccttaaaaccatagaatctggcttaagccaaagcaactgtatcttcctttattttttaacaataaacacctttaattatcttccttccgactactttgttgtaacacacaatgtgtttgtctcctgaggtgagcataaaaaaggagcccagcatgacttgaatgctaccgtaattaaagaaaagctaaaaaggtcaaaaacaagaatgtggtaaatcttaagcaactccccagaacaggcgccacctgccactttgtgctgacaccgtcaatcattgaatcggttactgaatactttcttgcatttcttcttctccaccttgtgcccacgttaagcaggaagacatcatattttcattagcacctgttttgttttttcaccttctgtagactgttgagtgaatttctaataataaagccaaaaggaaaaataatggcaatatgattggacaagcagtttcagaatcaaggtaggatgcctttttgttggtggaggttttttgtttttgttttgtttttggacttattctccctcatatcaaataaatttattaaacacacctgaacacttgttatgtgccactgtcggccacgtattagggacacggaagaacaataagacatactccctaccaaaagaggcttatggtttagaaggaagacacagtcttgtaaacaggtaagtaaaataaaatgtgagctgcactatgctggaagtcagcccagggtggcccaagtagaccatagccagtctacataaatagggagacacgggggacagctttctagatgtccctaacgctgaatcctaaaagatgagaagcatttctagggtgccagagtggagaaaacacctgacttgtgggagaacggaaggcctcgtgttcattcaatggatcaactatcattgggcatctccacctgcgagagacggcgctagcccctggggatccagtccccggtgagctggaaagctactctgtgctctcagaggacttggaacagagaatgcagacagggtggcaggaatgcaggaatgtgctcacagtgcaggaacccggtggctcgcagagaagggcaccaaacttagacctgggagatcaggaccctctcccccaaaacctggaggattgctccaaagctgtaccgagtcagtggcggaggccgggtgagcgtggggaagggcatcagacacggtatacctgctccacctttcccttttgttttgttgtcacaagaggcactacttcgctgcctccgtctcctctgtgggtggaaaggatggacccaaaggaacagaaggctgtggccactcgacgatggttttgatagggacttatcttgctctctctccctggacactctctttctaggcctgcagcctctctcctcccttcccatttccaaagcctctgccccaacctgatccaagtattatatgtaaacctgtcattagggttctttaaatcaaggctttttgatgacaaaaagagggtttaaaaaaaaaaatgtggctcacgcctgtaatcctagcactatgggaggctaggcaggcagattgcctgagctcaggagttcgagaccagcccgggaaacgcggtgaaactccgtctctactaaaaacacgaaaaattagccgagcgtggcggcaggcacctgtagtcccagctactcaggaggctgaggcaggagaattgcttgaacccgggaggcggaagttgcagtgagccgagatcgtgccactgccctccagcctgggtagcagagggagactccgtctcaaaaaaaaaaaaaaaagaaaagaaaagaaaaagaatctgtaagaatatccagtgtggcttctgcctctggaataagtaatagtcttagtgaccatggctatgggagtacccgggttccatcagtgtgccctgtgtggttttggtctgggctgcattggcgtggcctgtttttttgtttttgtttttgtttttcccttattactgttcgtggagtgttttagtttgcttttttgtttgtttggttggtttttttttggactctgcgaatggatgtctaatgctctcgtctccctggcaggacctccttcctgtgtctgcagtttctcttgtagccacaccgtctgcccgatcatcagtgctaggaaaataacgatgagaacagacctttcgaagcccgattatcagaaagagtgtcttcatgcttgaaatctgaatataaaacagacgcccctgaagtgcatccctgtgacactgcctgtacagcaccgttaaatatctcatcggcagtaatagcttaagactactgtgctcagtcacttctttgggtgtcactcatagcaatccccatccctgccatcatcattatcacacagcactgccataatgacaattataaagatgttagaaagctgagacaagtcattctgaattaaaccgcagctcccataggtcctctgaaattacccgtttccaatatctccattgtttccctacccaaaagcaaaaaggggagacaaatgtctcttgagcgatgcacaaaatacattataagcctgggaataatcaaagctaactgtgttcagtagagagagatgcactgtgactaagtttcactgaattttaatggcataatttttagcccagaaagcaagctcatgtgtgccggagtgattaatgatacagtttatgcagctcattggtcatacttaaattagtttaaatattcatctgttgttttgttataatgaatctccatgtttctttttatttctgttcccctgagtgtttcctcttgtctggttggaggatgtttgcctgaattgggaaagaaatgccaatagccctgtaggtgacaatgcacccaggctgctgaagatcaggggagatgaggcaataaacgcttcatttcacactgtgaaatgcacacacagctgcaccagcttcttgagtgagatgtcttggtggattctgtgaggtgccaggtcagagattaaacttactgatttgtggcacatgaagccattggatgaagttggatgctgtttgctgtccctgggacttcctttaaagtccacacatcaatttttataccaactccctgaaagtcctccttttatgagcattcataatttacattttgagttggaaagtcctgtaactctaccttctgggattttatgaattttcctcccaaatacaaaactctctagatgctgaaattgcatttgtggtgaagaagggaaaggccataagagtaacttaataagacttcatgttacagaactgaaagatctttcaaattcacataaaaggaggcctgcacttgacactgtcctgactatataacaacatctagaagtagacagtgttgcctttttatgctatatccttgggagtacaatttacaaatagtctactacacacttcttgcacttgtgaatcacccatatagatcaacctttaaagtgtaaaaaaaaaaaaaaaaaaaaaactttataacatcctgagaattaatccttggagagctggctagatacagaatgaaaaattccagacaccacaagtagttagagctcagcttcctggataaatcagttaatttggaaattgtggcctccatacccgctaggcatgtttgttcatccattgttctcctccctatctcctagccacagtgaaagaaaacgaagtgtggtgtacacacacttctagctatgaaagcagctgcatgatactggaaacacagtgtctccaaatgtttcagccttgggggcttccctcattattactatctgaataaagtgcttcagtccgctatgatactttactctaggaaacccagctttgttcctcacattatcaatgacttccaggagtgttcaggaaggacccaacttttacactcactattcaacatgttattaccatgctgctaatgtttagctttcttctacattatttgacccccaaaacagacactataacccaactaatataattctgttatagcatgttacaagtttttagcaaaggtgagaatcatcaaattgcatacgggatgttattattcttcatatccatcaaagtacaggaagtccttcacaggcagccatctttttctctgggccacaccagagaagccccctgccttctcctttctttgagtttcaaggactgaacttcatgtctcacaagcagtcagaggtggaagcaaatgaaattgcctttgcaaaaattctaacagtgagaggaatctcacctgactccatcttgcttctaacctcacaagctagctgactttgttagctttaaaacaaaaatgatacatcccttcctgaaactaacccctccttgcttagggactgaaaccatgtttgtaagtctaatgaaaggacataagattaggattatgggaggggcctgaattctgctaagatatatgcatagttaaacaataaccagctattgttccagaggtacaagatttgtaacttctccaactgctcctttagataatatccatatggtcaaaacctaagattgggctttgaggtattttccagacttttgcatttggtttgaccagctgatgccacctgaacccaagactcataccagggaactggctcaaccagtcctgtgaccttcatccagatactgactcagtgcacaaagaccattttggacattcctatgatttaatccccagtcaatctgcagcacccattccccatccccctacccaccaaattaccttgaaaaacactagcctccaagttttactatctctcatccttctcttggctggccctgcaataattaagttctttctttgctgcaatacctgctatactcaatgcattgacttttctgagcagcaggcaagattaacccatcaggctgctatacaaatacttcctgttaccttagtactcaaaacaatctatggtccctcttctcaacctttctttcttgattatttaatctctgttaccattcttacacttacttacttgcaataacataatacttactctttctgtaataacttgcaggttataattggatcatgagtgacctctccccaaattcatttatctcatcttaagcctaatgaatgaaaaaattatccataatgagagaaaacagcaggatccttttcataaagagatgtttgaaaacaagtatttttggaaataatatattaagatgcatatgtggctatatgaccgattctaatgtgtttaggccttgctaatatatcggtatgggacaatctccttcttaaaattgtcacactgtattgtttgcttcagtccaggatagcaggactttttgacctgaaaggaaaaggtaaggcaagggcagaggttggacccttgtcccttaggacaaagcaggcagatttacatcactgccttccaggaaatgacagcttacccccaaaagtaaagaaaaagtgtactttaaaaaatactagccaggtgtggcggctcacacctgtaatcccagcactttgggaggccgaggcaggcagattgcttgagctcaggtgttcaagaccagcctgagtaatatagtgaggcctcgtctctacaaaaaaaaaattttttttaaattagtgtgatggtgcaggcctatagtcacagctactcaggaggctgaggtggaagggtcacttgagtccagggggtcaaggctgcggtgagccatgattgtgccactgcctttcagcctgggtgacagaacaagaccccgtctcaaaaatatatatatgttttatacttctcactatagaaaagccatttaaagcattctgtgtagggggaataaagtgagacacaacctgagtattataatgagcactgaatttgtagtaaaaagagtaagtcagattcttgatttgcctcctgcaggctttgcactttgaaaaaattatttacattctctgggctttggatctcttgtttttaaaattcagagtttgaaccagatacccgcccacctcatacagcttgaaaactctacaagactcaagtttaaaacttctgcattccaataaaagttagaaccctaatcctcttgctacaggctagcaagatttctcgtatgaaaataatgacactgcaaatcagtacctgaggtctaccaaaacctcatgttgtcaaaaccaaattgtcatctaactatttgaaacccgccacaaccctttctcgtaccattaatgtcaaagcacaccctctgagcagaggcagcagtcactgttttttgttgttgttgttgtttttttctgagctttctcacatactaacagaggctttgatgcaaaatatagagcagtttccgacctaagggactttggaccaacagatatcatgctagccctaattttttctgtgggttttcacacgactgtgtgtgagaaaagcaagagatttcagatctaaacaagacccactatacgaactaatgaaaatattgggtgtgtggtctacaaaacagcctaaataagtacttctctctgaaagatccctttctccataggcctattcagattaatatctagttttcttcacattaaagtgtatatgacagttgtcatgataacttagtgaaaagtttagccaatagaatctatgtagcacttttaggcttctcctgctgtctgaattttttcttaattttctttctctcaaattcagcccacctaaagtttttgacagtctgtttaccaatcaggaaaagatttaattcttatttgtcttaaggcagacatccaggatggacagtgattatgggttcatggaatgttacaactggaagagtttataggattcatctggtccctcattttcctacttgtcaaatgaaaacaatcaccagggaatgtgttgaaaatatagatttttagtctccactccaacctgttgggtcagaatctcaacagacacaagagaatctgtacttttaacaatcataccatcaagcaaatttgagaaacgctgatataatcctatgattttattttgtaaagaggtttattttgattatacatggtcatatatgaaaaaaagaaaggatttcatagcctttcgtgaaagagttgactgcttcatatcagttataaaacataaattgaaaattattcctgaggttgaaacactcaacttgggcctctcaatttctgaaactcttgactttgatgatcgtaaaatgacaatgattattttatgttaattacagaagtcaccttccattctctcccaacctcaataacacctatagatgatatcaaatcgaggcatgtagagccacacactattttaaaaatgtagcattccttcatactcataaacattctcttaaccttaacatatgaaataatctccaaattctcacaaaaatgagtgcccacctgaactaaagtttttttacacctttaaaaatgtaattgtacagacgaaatcggtgtcataaggttactttcactaaaatagtatatccctctaaaaacaactttcacccatttgcaatcactggaaagtcatagaaggtgactagagtaactgatttctctcaagagcaaattcatgctctccaaaggagatcagggtctgtttagaaaactgaggtctaataatcaaggttgccacctggtagatctcatgttccacacatttggatgacttggctgatttcaggaatatgggaaaaatcagtttaacccaggctctctgaaccaatgtctcagatcaaactgatgacccccggacagcaaaaatgtgaccaaggtggaaggatcacttgagtccgggaggtcaaggctgcagtgagccatgattgtgtcgctgcctttcagcctgggtaacagaacaagaccccgtctcaaaatatatacatatgttgtatacttctcagtgtagaaaagccatttaaagcattctgtgtagggagaataaagtgagacacaacctgagtattataatgaacactgaatttgtactaaaaagaatcaggcttagccttcacttcacaacccaggttcacatgggtccttcctgtgcatcccaaggtcaggtttaaccacatcaacctcaaagccttccaaacagaaagcatttggaaacaacaccatctccccagatcattctacagtatgaagccgtgaaactgatggctctcggttcccctattcctggaacacaagtcttcagtttcagatttgggggaagagaaatcatcatagtatgacaattgggagaaaattacgtttttgttttcatatgtctccaaataaaatcccaatcatattttgtacaaaatttccatttttcattattaaaatttcattattttcaggcagccattgaaaaagattgtgccctaccagaatctggatatccttttgggcaacacacttttaacctctcttaggagatgttaatttgagtgagttttcaccattctatctactgcattcgtaaatttccctttttgattattctagtcatgtaacagtgagctcagcaaaacaaacacacgcacaactccaaagttctatgcttaatgtcagtgataaatttcaccaagtagctagaaaagcagctataataaagaatattctaattagtcttagaggcattatgtggcagaaaatatggaattttttttcttatgccgagtttgctaattgcccccaacaataggtgtgaatctcttttgttatacttgcagaaaatatataggtttgacttccatctgggacactctagagaaatgaaggagttgcataaaacttttaatgctgtgaacagctagacacaagttacatagctgctgaaatgaaactatacaacaatttctctatataaacacattctgaaaacacgttgggtaaatggagatattgttgccaccctagaattgatggtttccataaatatcagcatagcatccatactatcttttaattacaattttaaacctgcgaatataataccttgactcgatggtagtctcagagaatgtatgactatattttattccaccacatataaatttgtagaatagggtcttagtgcttagctctgtgagaactatctaactgtctgatgataaaagttgaggagttgtttctgtgaccaaatatgaacataagaccaattatctgcaaatactcctgtaaggtatatttccagtactgttttatgtttggcaggattgtggtggagaagaacagggagatgttctaagtgtttaaaattatttttacatcctagaatcaatgtcttcttaatatcatactctctggttggaaatcttcagaggacagacactcagtgaataacctttaactaatttccaacccatttgagtatgccaggaaaatagcatcttccaagttctagtctagttgttgtatctgtctgtgttgctttccggctgctatagcccagttaaattaccaagtgctgctgatcctttggagcttttcttaatcctcttttgacctctctaatttgaattattctgtgtcatcaacaaagatgtaacagttaggtctctgtgaaatcacaaactagaattgcaattagagtttcttaatcgttgtgcatattgtattgttgcatggggaaagaaagttttggaatttaattaaaagaaaggggaattgtcaatgtacttaatatgccattatattttttcttttaaaatatggagttaaagaaaagtttgattgtctttaatagttgcagttatctaccaatggggactactgaatacatatgctggggaaattcaatgtcaaggaataatgtatgcttgaggaaagtgtcattaaaaaagaatcagaggattagggattctctaagtttttaaaaatatatatattcttagttcttccggttctgggcccattcctttgtttgtagagttacaaaaaacatgattgtttggtagtaattttctttatccagctctttttttttttttttttggcaggtggtaaagtttattcttgtaatttcttgagaagcgtacagcatattttcatttagatgaagttcaaaaacaaaaataaactattaagtgagttagggctacaaaatgtggtcaactataaagaatatcaagggaaccataaacctgaaatctgggagagcagtttcatctgagtcaggaggaaataagtggatggaatcaggcggaagcacgtagcgtaaaagaaaaattgcaccagacactcattaaaaatggcagagagactttctttgaaacgattgtaatatggattaagactattgcagtaggggagagattgaactagactccattggcacaaaagactggaaagttttcaagcatgaagtgagccagagaacaggtactggaagatggtgggacgatgtgattaggccatctgcatttcctaattggcacttccagaatttaggctccttacccttccacagagactgagagactggggccctcccttcttgataacaacatttcaaagggatagctcccgggtccttaagaaaaacactcctgggctgtaaaaggtttacctctcaaagggcagagtaagaatttacaattgcaagttttctaatgtaagtgctctaagaaaagagaagtcaaaggcctagagtcaggaagaaagctgtctgaagtttagtcaagctgaaaggaacttaaagcctccttggtcaacagtaagcttcagtgataatgctgaagtcttgttttctaaaattaggtgggaagtccgctggtcattgtatcatgacaccttacaccttacacatactttaaacattttctttagtatttggtagaaacagaaatactacttaagtgctacttaatagaaagtaaatcaatagtattcaacagaagcagaaatgtatttaatagcactaaatagaagtattaatagcatccagtagatacagaaatgttcggcccagggtcagtggtgttgcccaggggaatagccttcctgggtaacatacgctgagattgctgagtggacaaggtatttccatgtgccgaatttacacagtgcacctctttcctttttcctggctgcactcggtctctctgaagtgaatggcagtatttttaccctcgatttactgaggaggagactcagtcagagaggacattaattgtttcttcctaatatcacaataaattctcattccctaaggctatgtcactccctagaactaagttatctacttagggaagatcattcgtcactgccaggtctccagggtaacatcaaggctttattgttgcaagtcgacaaatcgcctcccatctgtctgccctgactctgtgactgcagccgcgcggtgccctagatgtttccccagtggtctgaaagaattaatgtgcctccctaaacatctaacttaatgctagggaggggcttaggcaatgggggaaatccgcctggaagagatgttctggatgtcagtaggttgtgctaatctggctgtggtcatggctctattggggagacattgacagtccatctatgtctcactgaaagatctttgtgatatctacaggggcactggggaactaacatttcaagaaaataatagcgccagcaggtacagatggtgtctcagacaaagtttctgggctctccctgaagcttgacatcacatcagtgtgtgtgcaactctgcatgtggttggtgagtacaagggcaagagacagagagggtaggagtcagaccgaaggagctaccgtgctggagcccagtgaaaggtgccaggagaactcatggcctctctgctcagatctcaaaatcagaggaaatgacaaagaaccagaagaacaaaggagaagtgacatatgggaggagacacccaagggaaacgttcaaggtcccaacatgacaccttatttgcagaacatcccccaaaacaaagaaatcctctgcacttgttcagaggatttctgatcaacagcagccaacccacagaagcagcagcccttgggcgctaagcagaagagagaaccaatgaggagccattcacctcacctgctgacgcgaaggctgcttgccagttttaggggttttctatgttgatgagcactttggattgttctgagaaattccccctcaacacaaaacacactctttaatgaagagatcccatattcctggctcaaaaatttgacccttgaatcatttatatcatatcattttgttgtagtccatgaattcatgaaaggcacagagtgacccagggctggatatcagccaggttccacgcagacagagtgactgggatgactggatcccaacactcggtgactctcccattcaccaagctccctagtggtctagaataatacccagccacacacctagcgagggctcatagatcttaaaaagttaaagaactactgccactgagcagatttttcatgtctgtatctgcttgcctgccagatttccttcctcttccatctcattgctgaatttaaaaatacttctaagtctatatacattataattgggtaaaataagaaattcttcgtaatttagaagatgtatctctttcctgaagacttcctcctactccacccccaatctccagagacacatttttacccttaagatccttttttttcctttatttcttctaaaaaaaaaaaatgggatacatgttcagaacgtgcaggtttgttacataggttacatgtgccatggtggtttgctgcacctattgacccatcctctaagttcccttcctctacccgccactccacaaaggcccttgtgtgtgttattcgcctcactgtgtccctgtgttctcaatattcaactcttacttatgagtgagaacatgcttaatcctgagattctgagcaagacaacctcctttagagatgtctattgcttggaatgttttaatctgttagatttttgactgcacatattagctttaagaaattagaattgagcattaacatgttcagtttgttttcactattaatttctccataaattatgttagattgcattttttatagtatgtgcaagtgtatgtgcatatacgtatacacacagagagaggctttgagctaaggatggtggattgcccacatctgtttaaatctccctaccaggaaactagcagcaagcatattacttcttcttaccccctcctatattcctgccaaggagggaatttaaaaactctttcaaggagaaacaggtagccagtgatcatcaaacattagagaaagcattcaccgtgacagaggcaggaaaaagaaaattctaaaagaaaaactctagaataaacaaagacatagtaggaatcataaaaaaactgttaagtgagcaatgctgacatgcctgctcctggtaccattattagcagaaaagtagatacaaaatgctttgatataaatgagacatctatatctatcaggttaacatagagataaagtgaacagatgaatttcaagtgatagaatttcctgtgtgtagcacccacattagaggttataagaggataaaatttaaagtaaatttggaatcacccagtcttacgtcctcattatcagggctatggtttaattgttccccccaaagtgcatgtgttggaaggttgacccccaatgcagggatattgggaggttaagcctaatgggaggtgtttgggtcataagggcaccactctcatgaagggattgatgctgttatcttggaagtggattcatggtcttgggagtgtatttcttataaaagcatgagtttgaccccctcttgccttctgccatgttatgacacagcaagaaggtccttacgagatgccagcaccttgatcttgaacttctgtgctttataaattacccagtctcaggtattctgttacagcagcacaaaacagacgaagacagaaaatgggtaccagagagagcagtgttgctatagtaaatacctgaaaatgtagaagtagctttggaactgtataatgggtagaagcctggaaaatttggaggagtaggctgggaaaagcatgcattgctatgaacagaacatttagggtaattctgttgagggctcagaagagaagaaatataggggaagtagagattactaagttgttgtgatcagaatgttggtagaaatatggacaataaagggcattctgatgaagtctcagacagaaatgaggaatagcttattagaaactggagtaaaggccattcttgttataaattggcaaagaacttggctgaattgttcatgccctagggctttatggaaggcagaatttaagagtaatggactcggatatctggtggaagaaatttctaagcaaaatattgaaggagttgcatggttacttttaactgcatatagtaagattagagagaagagaaatgatttaaagacagaacttataattaaaaaagaagtagagcagaaagatttgggaaatctgtggcctggccatgtaatgaacagccatgtaaaggtgctgccaagcaaccctttaataaagggattagtacagctagaaagaagccaggtgctatttatcaagacagtgggagaattacccgaaggtgttttggagatctctgaggctctccctccatcacaagcccagagctctaggagggcagaatggtttcagaggagagtctcagagtgccctccttggtttctctgcccagggcggcctagggactctactccctgcattccagtgtagcagtcctcgaccactccagctgtggctcaagtgggcccaggtgcagctggtgctggtgctccagaaagtataagggtaatctttggtggtacctatatggtgcttattttgtaggcacacaaagtacattagctgtggggccatggtagcctctacctagatttcaaaggatgtgttggacagcctcagggcccaggcagagacatggtacagacagaagtcatagcagatttcccactatggcgatgcctggtggagccgtgggggtagggcaaaccccacaaccctgaccccagacctatagagctactagcatgtagccccagcctgggagagatgcaggtatgaaactccaacccatgagagctcctatgtgggctgaacccagcaaagctatacgggtgaggctgcctgagactttgagggcccaacctcaactccagtgtgttcagcacaagaagtcaaactttattctggagtcttaagatttagtgttcaccctgttggctttttggacttacctgagaccagctacccctttttccctgcttattcgtccttttcaaaatgggcatgtctatactatgcctgttttagttctaggattatattttggaagcacataacttgtttaacttcacaggctcatagctagagggaaatttgcctcaagtgaatcatgctgttagtctcaaccatttctaatttagataacattctggactttggactttgagttggggctgggatgagtgaagagtttagagtctattgagatagattgaatatattttgcatgtgagaaagacatgaatttggtggaccagggatgaaatgctataatttgaaactgttccccaaagttcatgtgttagaaacttgatccctaattcagcagtgttgggaggtggggcccagtgggaggtgtttggatcatggtggcactgccctcatgaaaatattagtgccattatcttagaagtgggctcatggtttctggggcgaattgcttataaaaggatgaatttggcctctcttgctctctcttgtgatgctttccatgtgatgcttttccaccatgttatgacacagcaagaaggccctcacaagacacggatgccttgatcttggatgtcccaggctccaaagggacgttttcattccaatggaatgaaaaacaattccattctttatacgttactgagtctcaggtattctgttataacagcacaaagtggactaagacgagcagttatgttatttacccataatcatataatatattagctgcagaatcaagtctagaattctgattcctaatttctagtcccatgtgatttctattacctaactccataaaatggatggaaatgtctgattctataaggaatctcaaagttccacagagtcaacatatagaacacataaagccaactttatgtgtttttttaaatgtaaatgtgactgatatctaatagctaaaaattcttatcaaatagctaattgttacataattagcacaagtggtaataattctaattactttctttcagattttagaagagctatgttgagaagatttgctaggcctctttaaaattttatcctaggaagttttaaatgggggctttacttttctcttgttaaattttccttaagctcagaatccagtattgcccactgatcaatattttcaaagatagatggcatagcactcaaacatttgaagacattactaaggccttgtcttgtgagttttcagaaagcagaagtcacttatatcttgctcccctcccccatcatctcaaactatgtcgaaatccttccaaaatggcaatcttcatgtaaagaattatttaaaaggagcagccattggcttctgacttaatataatggaaggaaattataaggcagatagtatgtgtatcagactgtctctgggccatgtccaatccgcagctgtgtgcccacttgttgcttctcttggtttgtaataaattttaatgggttacatctaggtcaataataaaaaataagcacaatgatcattcaattcactgaactctaagtctagctactagtgttccaactcgtataaaatctgtgttgaactataaatacagtagtccccccttgtccgtggttttgctttctgcaatttcagttacctgtggccaaccatggcttgaaaatatacagtattttgaaagagagagagaagaaccacataacataacttttattacaatatattgttattatttttctattttattattctcataatctcttactgtgcctcatttataaattaaagcttatcatagacatgtatgaataggaaaaaaacatagtatacacagatgattcttgatttacaatgttttgacttaaaaattttctcagctttacaatggtgggacagcgatccatgttctttgacttacagtagatttattgggatatgaccccattgtaagtggaggagtatcttttaggatttggtactacctgtggtttcaggcatctactgggagtcttggaacatatttcccatggataagggggaaactactgtacaattgtaggacttcagtatgtaattaggaaaagaaaaattaatttgttttcataaacaaatagatcattatagtttacatctgtaaacaatcatggtattcttctgtcaaaacctttccatatcttcttattagttacaaaatacaatctaaactatagagcatggtcttcaaggcaattcagtctgatgcctcaacctgtccatcaaccccatcaactgtattgtttcacttcaaccccagatgctaatcactccatatcatccagactgccttgaacgctgtatgcatttcatgaatctgtacctttcccaagctgcttccgcagttaaaattctctgatcctttgagactcagttcaagtatctatgatcctaggaaatctcttcaacaccccctctttgtcccctctcgtctcagcagaatccattgtttcttcttcattaaagttcccatagcatctaattctatttttatgaaagcatttctcagtcacaccttttttgccatttctgtttctgtttccctccccaaatggtgaatcactagaggaagtcaaggatcatcttatagtatccttgtgtctcaagagtttagtctacccctccacatgtttggtacccattaaatgtttctttaattggatttatgtaagagcttaagagtatttcccatgatttcatttgatgcccatagaaactccattaagcaggatggtaactgactccattaaagcaagtaatccaactgttttaggcttctccaaagagagagagagaagcaataggatggatggatagatggatggatggatggatggatggatggatggatggatggatggatagatagataaggaatttattaggggaattggctcatacaattatgaaagctaagtcccacaacaggccctctttttgttaaatcctttttgtattagttaagggcctccagagagacagaaccaatagaagatatacatctgtatctgtacatatgagaagagatttattaggagaattggctcatgcaattgggaggttgagaaatcctacgctaggctctctgcaagctggagaaccagggaagctggtagcatggctcagtctaatctgaaggcctcagaaccgggaaaattattggtgtaactcttagtctgaggctgaaggcctgagaacccaggtggccattatgcaagttcaagtccaaaggccagacagcctggagttctgatggccaaggacaggagaaggagagtgtcagcgctctgggagagacaaaaaaagaatttgtcttctgccttttgttatctctgggacctcagcaaattggatcatgcctgcccacatgagggaggatcttcctcactcagtccaccaattcacaccccaatctcctctggaaagacccttgcagacacacccagaaataatttttaccaactctccaggtatttcttaatccagtcaagctgactccttaatttaaccatcacagcaactgggcaccaaaaacagattagtgatttacctccaggtcatgtggtcagtcaatggcaggaccagtaccaacccctaggttttccaatcctccatcgcatactttgcaccatcgttgctcagcacctactgagaagtggggacatggtaaagagctaaggatgcttgcaacccaatattcatgtcacttcttgaggtttcagcagctttttcatgcatgcattggctccatggtcacatacaagaaccctctgctttctcatctaagagtttcagagatgccaaagtaacaggattgaggctgaacaatcaccttcatttctaatgtttttcctcacaaaccaattcagaaattcagaaaacatcttactatagtagttgtttcctgaattactaaatggaagctttattaggaagtattctctgttctttctaccaaggcagctttgttccttgggcataaacaaaactatcccttctctctctaaattgaccacagagccaaccttatataaattagaacttgttagttttggcttcagatgccggctctttctcttgaggttttcacctacttaaaattcacttgttgccctttaaattcacatctagcttaaggcaaatgtttgaatttctaaaataaaaccatgtgcccaaaataagcttagggaaaaaataactgaaataaatggaaaattctccaaaataagcaaaagcattaaaatgataatgctttaactttctgaactaaactgaaaataatgtatgctcaagataagcttacaaccacggagagatctctcttctacaaagccttaaagaaaaagcaggaaattacctcagatgaaacttcattacatggcatttccattcccaggatccatcctcagacacgttgacttaattgctctggaaaagagccccagcatcaatatttttcaactttctaggtggttctaatgtcggtcacaatcaagaaatgacatgaacaatattctgaatcatttcagtagatgttgactgcatgactgtgctttctaccagtcctatcccacaccccgcctttttcctaaaataggtatgcatgcagtgtgtgctctgcacacatgcacatacacaaacacacacacagtttcattcatttgtatattcattcaatcaataagttgaattttgccttcgtgcaaggaaccatgactatcagcacaaacaagaaactattcctgaccccaagagattcccagtctaggtgtggagaatatgaagcacagaaatgggaacaactctaggtaggaaatggaaagagagcaaatttttttttttaagaggcagctgggcacagtggctcacacctgtaatcccagcactttgggatgctgaggcaggaggatcattggaggcaaaatcaagtgtacctaacagttttagaaaattgtacatcgtatacttccactttccatcgtgacttctgttcatagtttatagatgtacaacataaagacataattcctaaataaacaaagcttctgtgaaagcataatgtgactctgcaggcctgctggcctgtcttattattgatctgaaaacaagattgacactactgtgattattctttagtgggaagggacattcatacttatttagccattgctatgctttcaggcaaatcaacccctcagtaactccaggcaaatgaatataggcctttcataaaaagtgtcttggagagaaagcccacaactgcaattaacaggaaatagctgatgcagtgtgacagcaagtccccaaacccttaatggaaggattgactgtcatgtgcatggagatgtggttagagaggaaataagttactgggttttgtaaggcaccaacttgaaaaacatgaaaagctgtggcaggccacaaacatggagcccatttggagtagaggcaggcaagtagaacggagaaccgtggcatttcaaccctagattaatctgagtgtcgcttttgctgccactacttaacaagagtagctgtagagagtgaaacatttttcctaaaatgtcatattttctctggtagctcctgttttcttctttgtatcacattatagctccacaaagttcatgcaaatgcataactaaattttgattatgagaggtctcagaatgcaacttgtttatgggaagaatatcattagtatagtttcaggcaattccttgcaaactatccccagtttaaaacagtcacaccttagtcaacaagcatctattgagcaacccactttcgacctggcattatggtaggtgcaaaggctaaaaaaaggtagaatgagatagaacctccacggaatatatacaataacaaattatttttttaaaaaactggatataacttgagaaactcttctgtacaggcattctggagtgagctgcaatccatcattattcagaaatgcattcatgcattacacctttgtcaagccaagttccaggttctgtgcttggtgctgggaagattgaaaggtcagctgaagttacagaaggccacgatgccagcacagctgctgcctactctttcgcctgatttatttctgttatttcttttacaattgtgattaaaaaaacacataacaccaaattgacgatcttaaccatttttaagcacaagcagagtcacgttcagtgactccacttcagtcaagttcagtagcattaagtagagtcacgtttacgtgcatctggtctccacaactctttcatcttgcaaacccaaactctataccatgaagtatccaaagtactcatatgtatcaaaacagagagtaggtggttgccaggttgccagggcatggtggagggggaagggaggagttgttgcctgatttctttttaaagctcagtcttccctttggcttctggttctaagcgtgttagcatcacggccccttttcattatcctaaaggacagacccagccctggttctgcaggtgctgaattctacttgactccaaagaggctcagcctctacctgcacccaggttctgctaacttggtctaccctctgttgtttttcctctctgttttgttcccatttgtaagatctctgccaaacttacttatttgctgcttttcacagacactagaccataccacctcctgggtattcacgatccatgcctggcccagctgactgttctcttattccaggctgttcgctgtttacctcgtccctcttcagcatcctcaatatgcctgcataatgcatatccatttttctccccaaattaaaagctatggccactgtatgttgaaaaatgcttaaaaccccacctaaacattccaggaagcaggaagccatgaatgactttaaaccaagaacagtctcaaaaatgttgtggtttccagtatgtgagtctcggacttcagcatattgctgttcatatgccacacaaatgttctgtaaagtcccattgagaattatgtgcaaatttaaatgctctccagacaatttcaaatatcagctttgatgcaagacttcacctgctaaaagcatctctttatggtttgacactacatctctgacattttgacgtgatacatattccatcagcctgatacattgccacctcccagtgagtcacagtgtcactaactcagaattaaatatgttgctaaaccactttacagcccttgcaaagcacataaaggctgtttgacaattacccccaggaaggcaaataatcagtacacctctgattctcttattattaaccattataaaatcatgtgctgtgatcaaggtgtgtaacaaagacattgatttttataagactacccaggaagcaaatacatattcttgatatacgaaacacacaggaggcctcttcattttcctttgtgtctttaatttgctcagagctgctcctcatacagcactggctttcacctgtcaagctaaggctttaattactgagttatggaaaaatcattgccaattgccttaactacaataataaagaatatcttacaaaggataagaaatcttttttcttcggctctgtagttaaaagactagttctagttttaatctgaacttttctatttctctccctatatttccctttcttcctattttaattgctggttagataattaagtaggtacctgacctgcaccaaatgtgcttgggaaagtctctcgtattttcgttttgctttgttttgtttctgcatgccattgaaacccctgtgttaattattctttccttacttgaagtatcttatacaacctttcttcaccagtatccttttcactaggccaaatacttattttggagtctcaaggatgattttctaaatcttttcataaccgcttttagcccttactcagttttattgtgcctgcccctcattgcacaaagggatatatttgactattccatggcatatttgactttgtaattcgtaaattatttttcatgtcttacatggttaaagatacgtttcacttgagcttgtaacagacataaaaatgacccatggtaaacctgtcgtattagaaaatcaaacaaaaagcataaggagataacacggtaaaaatgaaaagagtacaagctttagacccgtgtggatccgagttcatatctaacttggccaactaatagcttgttaattatgttaccttaggttgtattttttttttttttttttctaatttagtctcggggtctccgtgttctagctccgacccaagggggttcccgggacgtggttgtggatgttcagtgtgcctttaactggatacttctttatcctggcagacggcctgatgcccaggtgtgacttgtggccaggtgtcccacaaacaggaaaacctgtttacactggcagatggccttgtggcgtgctatagtctgaatgtctctatcctcctaaaatccgtaaattgaaacctcattcctaacgtgatggtgttaataagtggggcctttgggagatgattaggtaatgagggcagagccttcatgaacaggattagtgcccagacaaaagaggcccaaggaagcttgtccacctttgtgccatgtgaggacactgctggaaggcaccatctatgaagcagagagtcggccctcatcagacaccaaatctactgctacctctgtctcgggcttcccagcctccagaactgtaagcaatctgctgttgttgttgtttacaaattacccagtctaagatattttttatggcagcccaaacagactgagacatggcttttgtctgctctgtgtctagtgtatgttttgttttggttcggttttaagtttgtttggtttttggtttttggtttcgctttgtttttgtagacaacatcttactatgttgcccagactggtcttaaactcctagactcaagcaatccttcgcctcagcctctcaaagtgctgagatgacaggcgggagccaccacgcccagccaccctgtgtctagcttattcctaccaagagaatcactctctgtgaaagctctgagcagaaggagagttaggttcgcgtgtgttgctcaggtgagacaaagaggagatcatacagcaaaacacatgaaataacagaagcagcgtttgactcacagatccagagcagagagggcagcctgcctctcagggccaacaggaaaggggagctgtcctggacacgcaggctccaccagtgtggggagcaaaagagatcacaagagacctcagggcctaagactttgttggggtctcaggagttacccaagcaggtttcctgctgagagttctaatgggggtgggtggtggggggcgttacagcaacaattaccagtttcatggagccacactgtgcctgagcggtagtaactgtggcatctccatgcagtccatgcagcgggaggggtcttgggcgtgagtcaggtaggttgtattgagctgtcccctggggaggtgggcactagcagatacctggattgaccgccttgaggagctaggaggaagcagagaactagaaatcatgtcaagattcactaagccctgcatctgctatgagaaagtccaacttacaatcaaaatggatgcccaggcaacataaaattgtaagatttcgctacgccttaggcaatgaaacttggctgccttccagtgaatatttactgagcgtctagcttatttgagaaaccataatagacactacagggactgcgaagaatgggaaataaaccaattacacaatcacccacatagcagcgatacaaggccagccatatcaaacaacccaacagataaacagttcatatgttatatggtgtcagaagtaagacacatcaaaaaatggtaaaatacgtttgatactactgtccttataaaatcaccaaccataggaaaaatgatttttattaatgacagggatataatgaaaatagtttatgtgtgaaaacacataagtaattacataatacattatgatcaaaattagatacagcattgctgggcaagacctttttctcctctaatgctgtccttcaatattattaccaaaatatagcaccagtttttgtttttgtttgaggcagggtctcactctgttgcccaggctggaatgcagtaatatgatcatggctcactgcagcctcaacctcctgggctcaagtagtcctcccatttcagccttccaaagtgctgggattacactcgtgagccattgtgcccagccagtacctggttcttaattaactatatgaaaggcaaaatctgttttgctgctgagcaattatagtactatgcattatgtgtgtgtgtgtatgagtgtgtgtataacatgtagtttatatccatatataaactacatatagtttatatttaattgagtgtagacaatttataggttataatatctttagttataacattcacatgggtgtaattttttatactattctaatttatcattcctttctgttttaccttcaactctggttgaagtaatgtagttactatctgttttccgagttagacttccacttttcctctctggctacctgacaccccaagctagtgtaggtggctatatcattgcctggaattgaagtttttaagcctctgataattcagtctgtagaagctacccagctcaagaacaaaggggaaattacatatttcataacatgcttcaacatgaatgcatttaattagtatttataaatttgaatcaaaatgcaggaaatattctaaaaatataatttctctagaagagttatataatctctattaatgtaggccaactgcttctgtttcaaacacagaagaatgttcttcaatttttcatttgtgaaactgaatagtctcttctgaaagagtatatagtatttttccttttgggaatacaaaagcttttacaaaatgattatactaatcatcagatataagagtagtaccaattctctacctagaatagctgttaaccatggcacttggtgaattgggaatagacttaaatgatgcttctccttgggcccccacctccccaactcctacctttctcgaaaccaggctatttctctccaaatctcctttccttttgattcttcagttcgtgctacatgataactacttgccattggtcattaattatggtcgacgctcattattcacaggagtatgacccataaaatcactgcaaacactgaataagttaatactgaaccattgcccctagagggaattcagggttaagttcctgcaagcctctggtcacagtatattcatcaacctatcaatacataacgttattttatgcatgtttctgctttaagacatcttacttaacatatgtttttgattcattaacactgaactcatggccaacagctctataactaatgtctgaaaaaagcttatctaataggcatgttttccccataaggcacatcacagccttcttgtgcttaggaacactggacgacactcaacactgcgcttgggggccatttgaaacagtaatatcaccaataaaaaaaaagcacaaaaatgtcagggggaaatgtggcagtaaataggctgtgaaaaagacatttgtttgcagtatgagctaaaagaaggcagggcatcaccttgttctacatcagtagggatcatgagtgttatgccactcaatttttttgccagcctgtgtgtacacgtgtcctcaaatgaccatgaaagcactgcaagtatagatttggggattacaaataaatttcaacaagtagatgagtttgcaaacatggaatccgcaaataattactgttgactacaccatccttttgaacaaaaataaaagccacaattcaacttgagattggttatagatggcaactggcatttagtgagcacctgctatgagctgggtgccttacttttttttttgttttgagacagagtctcgctttgtcgcccagtctggagtgcagtggcaccatctcagctcactgcaagctccacctcccaggttcacgccattctcctgcctcagcctccccagtagctgggactacaggtgcctgccaccatgcccagctaatttttttttttttttagtagagacggggtttcaccctgtgagccaggatggtctcaatctcctgacctcgtgatccgcccgcctcggcctcccaaagtgctgggattacaggcgtgagccaccacacccagccactgggtgccttacttttagtaacacattgacctgggatgtgatcaactcgagaaccacatcactgtcatgtagctgcatggagctgtatcactcaacttctgggggcttatgtttcataacaattatcttttataaatgttcaatttaaaaatgaaaaacttccccaccccaatcaccacctcctttccccctctcccttccctttaatgaaccatctaagggaaggacatgtgtgcttctttgacatttcttcacagaatccagtccaatggcagggaggctgggtgagggtcagtgtcagcctagccagtagggaatccatggagctggggcatgtcaggggagtgtctcttactgagaactctgggtcctcttggatcaaagaatgtgcaaattgagctaagagatagaggggaattcgagaagatcacctaaaatgggcaaacaggaggaagctagatccaggtagcctgggagtcaagaacagtgagccctgtgtgagctaaaaaaccagaagcaaaccttggccaatggctggagctggtgtttttgctcaagcctggctttcatgggctccccttgatgtgagtctcagagtagggctggttaagtggccaggacctgagaaataaaatctcccttatatactcttgagagaacaagtctaacatatcagtaaggtaatagctataaaaatgtggctaggccgggcgtggtggctcgtgcctgtaatcccagcactttgggaggccgaggctggtggatcacctgaggtctggagtttgagaccagactggccaacatggtgaaaccccatctctactaaaaatacaaaaaaaattagccaggtgtagtggtaggtgcctgtaatcccagctactcgggatcctgaggcagaagaatcacttgaacccaagaggcagaggttgcagagagctaagatcatgccattgcactgcagcctgggcgacaagagcaaaactccgtctcaaaaaatagaaaaaataagtggctaagtcagtagtgaaactacgaagctaacttattacatttttcaccttttgaactttcaaacttgagtcatttatggacatctttgaagggaacagttattataaactctcactgttgacctaattaacattataatgtcaattatatatgtatagaaagaattctagatatacactcctgctaatatatttctaagattttttaatgttttatgatatacaaatttggatataagaaaaattataaaaccaacaaaattaaaactagtaaagtgaatgtaacgagataggctgtatagttcacaccacacaatgtcgtttagtcgacagtggaccgcacagataacagcagttccataagattatagaggagctgaacatttcctatgcctagtaacatcacagctgttgttaaggtcctatcacaacacattactcctatgtttgtgatgacactggtgtaaacaaacctactgcactgccaggcatatagaagtgtagcttatacaattatgtacagtaatacttgataatgataatatttgactatgttactggtttatgtatttgctatattatattatacattttatcattcaagtgtattccttctacttattttaaaaaatttgctgtgaaacaggcagggtacagtggctcatgcctgtaatcccagcactttgggaggccgaggcaggtggatcacctgaggtcaggaggttgagaccagcctggttaacatgcagaagcctcatctccatgaaaaatacaaaaattagccaggcatagtggttcaccctatgatcccagctactcggaaggctgaggcagaagaatcacttgagcccgggaggcagtttgcagtaagccaagatcgcgccactgcactccagcctgggtgacagaacaagactctatctcaaacaaaccgaaacattaagtgtgaaacaacctcagcaggtccttcaggagggattccagaagaaggcattgttaccataggagctggcagctctgtgtgtgtcactgcccctgaagacctcgcagtaggacaaggtgtggaggtggaagacagtgatattgatattcctgaccctgttaggcctaggctaatgtgtgtgtttgtgtcttagtttttacaacaaatatttaaagtacaaaaatgaaaaaattcaaagtagaagaaaaggctgatagaataggatataaagaaaaaatatttttgtatggctgtacaatgtgcttgtgttttaagctgtgttatcacaaaagagtaaaaaagttaaaagaaattaaaagtttagaaagtaaaaaaagttacagtaaactaatgtgtattaaagaaaagtatttttttacaaatttagtgaagcctaagtatacagtattttttaagtcaacattagtgtacagtaatgttctaggccttcacgttcactctccactcactcactgactcacccacagcaacttccagtcctgcaagctccattcatgataagtgccctatacaggtgtgccattctttttatcttttactctgtatttttactgtactttttctatgtttagatatatttagatacacaaataccattgtgttacaactgtctacagtatttagtacaataacatgctgtacagatttgtagcctgggagcaacgggccatagcatatagcctaggtatgtagtaggctatacagtggcagtttgtgaagtgcattctgtgatgtttgcatgacaacaaaattgcctagagacacactcctcagaatacatctccatcgttcaggctcagcaatgcatgactgtattagtaaactaaatttccactttcaatgagaattttttcagtgtagcttgttttgagttcattttgcctatacactataagtttgtgataattcaattttgctactacttttttctaatcaaactactatcaaatctccacccacagagcatacttttatgtaatttgctttcacttgggccaaatatcatttttgtattaagttggcctatgttcttttctcaataggtaaccaaaattaaagcagtagcatttggcagcaattacaaacagaaatgagagcatttatgtcctggcgggagttggttgttaagtggccatccggaagttatgcaatatgttttctttctcttttcttttctgtttttttttttaagattgctattgaaatgaaaacagaaactgcaccaactgatgttaaagataaatacaaagccatcgtaattaaaagagtatgtcacaaatgcaagaataggcagaaggatcactggaactgattagaatgtcagaatactgtttacataagaagtagtgcatactgaaactggcaatttaaatgaacggggatcctgcagtgtaaaactctgaaataaacaaacaaataaataaacagggatgaagacaaattttgctaagaaaattatgtgactatactttaaaaaatagtttctattttacgttagatgctaaaatgaattccaaagaattacagacttcaatgtgcaaagaggaagaatgcatagaaaagtgatactaaaagcaattcagtatttttctgttctctaaattttaaaaagcccttgtggctgggcacagtggctcacgcctgtaatcccagcagtttgggaggccgaggcgggtggatcacgaggtcaggagatggagaccatcctggctaacacggtgaaaccctgtctctactaaaaatacaaaaaattagccgggcgtggtggcaggtgcctgtagtcccagctgctcgggaggctgaggcaggagaatggggtgaacccaggaggcggagcttgcagtgagctgagatcgcaccactgcactccagcctgggcgacagacagagccagactccgtctccaaaaaaaaaaaaaaaagcccttgtaagcataaatacaaaggaaacttggtagatatggcaacataacaattaaaagttcatgtaagtacaaaaatcaacaaattaaaaactgagaaactggaaaaatatttgcaatacattgatataaaaatcataatatgtttttaaaaacttttaaaaactagcaacaaaaagtaaaagatgaacaaccaggtgatggaaaaaaaaaaaaaagatccagaattgttcagtaaaggtgtaaaaagtgtttccaatcaaagaaatacaaactgaaacaagaatataatattttattttggttttggttttgtttaataagcagaaaatggtgaggcatttttgacaagcaattttgcaagacagatcaataatctttaaaacgtatgtagttcttgagcaaggattttcacctctaaaattatatttcaaagaaataattgtagaccacatgcaagattttttttacagattatttgtcataaagttatatataattgtgaaaaatgcaaatcaatgatatctgtcacccagaaaggaaggaaatggttaaatacatttaagtttagccgtataacagtattccttaaaaataagtctcctaggccaggcacagtggctcacgcctataacccagcactttgagaggccaaggtgagcggattacttgaggtcgggagtttgagaccaggctggccaatatggtgaaacctcatatctagtaaaaatacaaaaattagctgggcatagtggcgcacgcctgtagtcccagctactcgggaggctgagccaggagaatcgcttgaaaccaggaggcagaaatttcagtgagcctaaatcacgccactgcactctaggctgggtgacagagctagactccgtctcaaaaaaacaagaaacatcacctaaaaaaaagtctttgaagactattaacatggaagcatgataatggtataattttaataagaaattatgatagaacactgatagaatattatcccagttttacaattccacatgtatttacatgtacctgggaaaattataatgaaaatgttaacacatttttttcttgtcagtaagtgcaggggaaccttacattttctttatggttttctgattattccaaatattgtaaaatacacattattcatatacttttaaaatgtggatcttaactgttttcctttaatctgctatcttacctttttaaatctaggaaatgtatgtatctcaaaatggtaaaactgaatatttaatattctagaaattaatgttttataaatcttaattttcttctcagtaatattgtataattttaaatattggcagattgtcagctatggctgtgcctatttaaagccaaaactcctgccaattttgtgaaaacttacgctcattatctagatttttgtttgtagtacgataaatattttcaccgtactttacctgctttggcaaaagatagatggcagaagaaggagctgattaaataaccaataaatacaagagaaaatctgggacattttttgcttttattattactttttataccattatgctggtaaattatttataatattatgattatgctaggattatagaacgaaaggtaataagttttatggattgtcagtaataataattactgtaaattgtcttttaaaataatgaaggctaaaatacttaggtattgagagtgttttcttcttgctactctgtgatgtatcgttgcagcaggctgagataatggaaaaggctgagagctacaagccaaaaagactgggtgttgagtctctaattccacttcttttttttttttttttttcaagacagagtctagctctgtcgcccaggctggagtgcagtggtgtggtctcagctcactgcaaactctgcctcccgggttcacgccattctcctgcctcagcctccagagtagctgggactacaggtacccgccaccacacccggctaattttttgtatttttagtagagacagggtttcaccgtgttagccaggatgttcttgatctcctgacctcgtgatccacccgcctcggcctcccatagtgctgggattacaggcgtgagccactgcgcccggctaattccacttcttattagctctgggattgtggacaatttctctaggcagagcttcctcgtctgtaaaatatgaatgagtctaatatgtatgcatctagtaatctgatttaatcacaaaatgggactagactatacagtccttaaagaatctatcactatgacttctctcagtggcctttttttttttttttttttttttttacagagctggataataaagagcttagaattttattcctgaaaggcaactagagtgctaggcattctgggtttctgatagaagacatgcacataagctttagcaaacactcagaactctatgctccctaactacaacttcgccagagtgcagaggccaactcttttcctttaaaaaactaactccaggatgtgttcacatggtcaataagatctatagttctttgctgatcatcccctgggaaacttttaaaatgaagtctgacacattacaaaccatgcacagaaacaaacaatatcagtaaaactctcaagtaatgcgtggttttgagccatgtagagtccaggtaagccttccaagcttggttaggtgcaaaacatactttctccagtatgtaaattaataggaatctttttttttttttttttctgagatggagtctcactctgtcagccaggctggagtgtagtaccacaatctctgctcactgcaacctcttcctccctggttcaagcgattctcctgcctcagcctcccaagtagctgggattacaagtggacaccaccacgcctggctaatttttttgtatttttagtagagacgggttttaccatgttggccaggttggtctcaaactcctgacctcaggtgatctgcctgcctcggcctcccaaagtgctgggattataggtgtgagccaccatgcccagcctataaataggcatctttgatggccttttaaaacaaccagactttgtaggctatctgcaaaagataatagtttgaaattttaatatttatttaaatagtcctcctgatggtaactgatcactaacttttgaagtgcgttgggttggactcagtaaaaatctcagcaatagcttataggaaattattcttctgttttctaaggcaggaggctatgcacccgtgtcatctaaaagagtggcccatggtgctatggagcaagccaaatcttcattgcagtccagttctgtcatttaccaaatctgtgacctccagagagctgttttattaatctacccctcagcttcttcatctgtaaaatgggacaatgatagcccttctcttccagattaggcacctaatgcagaacctagtgagatctaaatatatattagctacatctattattatgtttataaagacaaaggataaatggtagtcctgttttgtcccactcaaagctgttctctgagccacaaaaagactgtttcagctgcatgccaagttaacacattgcagttaagaaggaaaagcattgcagttaagaaggaaaagcattgcagtagagactagtccgtgaacatctttgtcctcaccattcctatcgccttcttttaaatgaaggaggcagtgggtttcttatattttggtccccatgattttgcaatttatagccttgataacctggccacagctaattaagccaaggttcggggctcattccttaggccgtgatgtgcaacttggcctgtaccctctaacatggcttctcatgagaactctacctaacagaaagttctgtgttgaatagcgatgaacggattcactccaaccttctctcagtgactttgaataaaagatatgcagactgtatagcagcctaaagagtgggctctgttccctcgcaaattttagcatactcattgagaagggagggagctttggggagacagtgagagaagagaatttaaacattgtgggcaatttcttctgcccttccatttgctgtggaattttccagccattttatgttctgtggatttttcatgcttgatatggttggtttctgggatgtgtttcagtcaacattgacccaaaaaccatgcagtcagttttctgtctaaaagccaaagctgtaacctcactgatattgcagaaatgtttctatcactttctgacccctaaaagtgcatgtctcttagatcatagctttgctggtatcaagattacatttttaacagtataaaccttttacatatgcagtagcaattagaatgctctccccaagaggaggacattctctgaaatcccaagtaggagtgaacccagagtagcatagcatatctgctaacttgattccatctgtctttgttgcaacatgctcactgagcatatgcccctaaatgaatatgagatgaagacaggatctgtggtccctcccgcaacattgatggggtaagtttttttgctaggctgagtgtggttcaaatatttttgtacaatatatatcctaaacacaaacaactacttcgtctgttgcccacccaaaaatatgctgatctgttttgtgctgaagtatgatcgttcgtgttggcgtccttgagaagtaatgggataaggtacttgaagggcgatttaagagctttccagagcagcccttggcttttcttaattttccagttttgcaacaacttttagagcccaatcctcatgtaagctttggatccactggaattaaaagctcagactttatagacaaacagacctgggtttgaatcctatttccatcacttgcctttaggaaagttgctcaacttttctgagtcttcattttctcatctgtgcccaccctcttattgcagtgaggcttgagtggtattcacagccctcggtgcagtcacttccatacataagagccactgttgttgttaacatagtttagaagttaagagagtcacaggcgtcgtaaaccctcagatagtaccagtcatgaggaagcagaattcactaagcggtgggtaggagggtgcacaagtagccaggtatacaagtagccgggagctgctgagtgtcccaggtctccatgaggatcaatcgctcaatagcttggatagtctgcgtgtggataacacatcagcaaggaatagagacaacgccttaaaacagactttcagcatttctggtgtcgaaaggtcctaacatgaggtctcactaaattcgagatttcatcagcctgagaagaactcagggtaaaataagagtagtaatacacaccccttttaacctgggttagaatgcgtttatgagtgtgaggtgatcttcaagtataaagccctatgtggatgtaacatgatagcagattataaatattaatagcattttaagtcaaagataactatttagaattgtgaataatagagaagaaagactgtgggcatcactgtacctcctaccctcagttaaaacttactgaaggaactgaaggttaaacattcttgataaccattgtatttctgcagtgtctcagaagtattactagaagacaagcatgggatttagagttaaactaaccttgggttcaaatcataatgctgccactccttgactgtgtgatggtggagaagttatttcacttctctaagcttcaaattctctatcagaaatgttttttctgtagctatctgcttaggaacaaagagaaaggcagcttcctgcatgactcagcttccagcttattattattattattattattattattattattattgttattatttgcttttgacaaagtgaactgaggtcccaagtttttatttccctttcacagagtcaagtttattggtataatcctgctaagaagtacttaaaacaaaaactagctattcacaaacaagtcaaatatataccctctagagtgtgttgataacgtgacttagtacatgaagagagagcatggtgttcaattgtgcaggtcaggtgaagctagtctttcatgcctcatcacaagtagcagatttccattaagaattggcaagctctcaaagctcagactctcccagagcagagcaaacaggcagatgcgaatacatgcctatcccagcagcatctgtttatgccagtggggagaaaccatcccctccacacacggttaaacaagtcagtgtgcagcctacctccagggcccttctcgttttgcctgggaatgtcctgggtggcttgtaggagatgaggatgcagcttggggcagccaaacctggggcatttcagaggcagagtataattcatgtggcaatacctggctctttatggcccgtagttttacacctaccatcctctgcacacagaaaactttaggcagaaatggagcatgcacaaccaggtctgcatatccgagagtggtcatttccttgcaaggcgtgtcgcttgactgaggggactagggggctgcagaggggctggcagatgtttggcttttggtgcagatatgagccaaataaattgaaaataggaagaaggagtacatgacctcacccaaattttaattcccatagaatagttttttgtttgtttgtttttagcgttgtatgcctaatagggtaaatgttattcaaaaaatagcccaggtgttagaaagacaaaatagttgttacctttagggaaatggttgtgaacaaaaggggcacacagggggtgtctgggccactaataatgttctgtttcttgatgtggattcgagttacatgggtgtgtcactttatgaaaattcatcaagggccatcaagggctcggtggctcatgcctgtaatcccagcattttgggaggccaaggtaggcggatcacttgaggtcaggaattcgagaccaacctggccaatgtgatgaaacccaatctctaccaaaaaaataaaaaataaaaattagctgggcgtggtggtacactgctgtagtcccagctgcttgggaggctgaggtgggagaatcacttgaacccaagacgtggaggttgcagtaagtggagatcatgccactgaactccagcatgggtgacagagtgagaccccatctcaaaaagaaaacaaaaacaaaaggtctggcacggtggctcacacctataatcccagcacttttggaggctgagcagactaggatcacctgaggtcaggagttcgagaccagcctgaccaacatggtgaaaccccttctctactaaaaatacaaaattatccgggtgtggtggtgcatgcctgtaatcccagctactctggctgaggcaggaaaatcgcttgaacccgggagagggaggttgcagtgagctgagacggtgccccattgcactccagcctgggcagcaagagcaaaactctgtctcaaaaaaaaaaaaaaaaagaaagaaagaaagaaaattcatcatgctgtatacttataatctgagtatttttcttcatgtaggttattaaaaaacagcagaaatattcttctctcaaaagaaatttctatattttaaaatatgcatatttatactatacatatatttatatttaaattatatatatatatttagtaaggaggggaatacatataacttgatacaaagtctgcactaagttagaatatatctaatgcaaattaatacttgagtgcatattaagatatatcaaaatttaaaaattggtcaaggtttttaagtgctttgacagttacagtaaggtaaggttctacataaaataacatgagtattgtcagcttccaccttacatttccaggaatagtcatttttcatgcattcattatattcttttcagcatcatttgcagagtttttgaacttctaagctgtaccacacagaaatgccataacactcattttgactatttcaacaaagtattataactaagccattaattgatccactagctttgctgttgggaaaatttacttattttgtaaatacagccacattgacttttaaagtcatctaaataagcttgttattaaataaaaatgttttgaaccttaaaactgctttaaatgattttaaataaatggtttatatttttttctcagtagtaataatttttctgaagtatttgcttattgtttttaagtgatttctttatacatatatatgtatatttacatactatgtgtatatattaggcaatattaaatgacctgaagcttttgatcaattctaatagaacagacaattgcaattctaaattagctctcataaaatggaacattttgcaagtagctaataaatatttgttgatcaatagttataccttgaatcctttatctattagaattttccagacaacaaactcatattgtttctcctttaggttcatttggatgtatcaacatagtaactcttgttacaaaaatattttaagtttaaaatcaattatttggttaaattctgtatgcatattttaatagttaatagacaaggtaaaatcagctcacttccatgtgttcaatatttattgcttgaaaattaaggcttataaattagagtatgctaactatgcctttttgttatagatcctcagcgctgttggttgtattatggaatagttaagtataggctctgctctccagacaccaaaggtttaactcagctctgtctttcaccaggcttgagcaccaaaggggaagtcagagaaaaagtaacagcaagtgaaataaaaatagaattctcaaaagcaatagttgaaagacaagaccacagaatggtatgatcaaagtgttgagagaaagagaaacagaaattgagagtttgagaccaaaaggtttttcattaaagcaatctctaaaggatttacttaatttttttaaataaaagaaacccagaagaaatgtctgaggtgtaagaagtattgatcaaagacattaatgaagatataggttaaaggtttttaaaactgtgtaataaaatattaacatcaaaattaatgtgttttaaaaaggagtaaatgaaacaattaaaaatgaagtctgttagaaagagaataatcaaaattacagttttttaagatccttgtattttaagaggatttaaaagagtgattaactttagactttcttaagtatgtaagatagaattccaaagtgcccactttttaaattttttattatttattttttgagacagactgtcattctgtcacccatgctgtagtgcagtggcatgatcttggctcagtgcaacctccacctcccaggttcaagtgagtctcctgcctcagtttcccaagtagctgggactacaggtgcacgccatcacgcctggctaattttttgtatttttagtagagacgaggtttcaccatgtcggccaggcctatctcaaagtcctgatctcaagtgatccacctgcctcgccctcccaaaatactgtgattacaggtgtgagccaccacacccagccttcaaagtgcccacttaatattaaataatatataacttcaaaaccagaatgggggaggaaatggattaagaaaacaaatataaatcatctattcagaaagactaaacaatataagacaataggaacaagtctgtctttcttgcttttacatgtgtgcatgtgtgtgtgtagtctagatacctagatagttagataaatagatatagatagatagataaacagatatagatagatagatagatagatagatagatagataaacagatatagatagatagatagatagatagataaacagatatagatagatagatagatagatagatagatagatagatagatagatagatagatgatagagagagagagagagagtgtgtgtgtgtgtgtgtgtgtgtgtgtgtgtgtgtgtgtgtgtgtgtttagtccatggcagtggactaaatatactagctaaaagatcttgtcaaattagtttaaaaagaagctaagtggtttttttaagacacatctgaaataagaggactcagaaagcctgaatggaaaataatgaaaagagacataatatgcaaataataattaaaggaaaaaccgggtaactataatagcaggtaacaaagacttcaaaaacctttttagaaggtagaaaggatactgaattatggcaagcgattcattttgccagaagaacttagcaattttaaacttgaattcgcaaaatactctcaaaatatataaagcaaaaattgacagaagtgcagggagaaattgataactcaaatatcatagaagaaaatgtggcatattaatttcagaactgatcatttaggcacacgacaataagtaaaaatagaggtttccaccaatataatttaaaaacttgattgacataaagtctaaacaaaataaagaacacacattcttctaagatataaatgaaatgtttaaaacatttatgactttctaggggaaggtatcttaaaaatacttagaactgaaggacaataaataatcctataaataaatattcatgagatgcaagacaaagatagttgtagttattttacactttaaatgcttaagtaaaaaatgagttaaggctagaaactcatagctaaattcaaataaagtaaaagtatgtgatgatgtaagagcagagcttaatgaaataaaacttgaagttatagtagggaggatcaacatagtcacaagttagtttcttgaaaacagaaaatcctccagcaaaattggttaagaaaaaaggagaacaccacaaataatcaatacaagaaatgaaaatggagataattataggtagcagacactttaaatgacaataagagaataccatgaacaaagctggccaaagcatttgaaaatttaggcaaaatggatgaattccatctatagtatatatgtatcagaatattatttttattgaaagatattgtcactgggtatcgagttctaggttgacagttcattatttttttctttcttattttaaaggtgtggtcctactgtcttctggattgcattatttcctgtgagaaatctgtcattgatatgtttgctcctttatgggcaattgtgtcctttttctctggctgcttttaagaatggccttatgatatacctcagtgtagtttcttccattcatgttttaatttaaagccattatctcttcaaatattttcatcactctcccaacccccacttttggaaattcccattatacatattgtaccacttgactttgccccacagctcattggtgctctttccttttttcttttttcttttctagtagcttttttttcctctgttttttattttggatagtttctatcactgtcttcaagttatctaatcttttcttctgtagtgtctaatctgctgttagccctttccagatattttttctttttttaatttttttttttatttcagtaggtttttggggaacaggtagtgtttagttacatggaaaacttctgtagtgggtgacaacccactctttgggttgtctgtttactctgctgattacttcttttgaggtacagaagctttttagtttaattaggtctcatctatttatctttgtttttgttgcatttgcttttgggttcttggtcatgaagtctttgcctaagccaatgtctagaagggtttttctgatgttatcctctagaatttttaggatttcaggtcttagatttcagtcttcgatccatcttgagttaatttttatataaggtgagagatgaggattcagtttcattcctttgcatgttgcttgccaatcatcccagcaccatttgttgaaaagggtgtccttttcccactttatgtttttgtttgctttgtcgaagatcagttggctgtaagtatttgactttttttctgggttctctattctgttccattggtctgtatacctatttttataccagtaccatgccatttggttgactgtagccttatagtatagcttgaagtcacgtaatgtaatgcctccagatttgttatttttgcttagtcttgctttggccatgtgggctcttttttagttctgtatgaatttaggattttttttctagttctgtgaataatgatggtggtattttgatgggaattgcattgaatttatagattgcttttggcagtatggtcattttgacaatatttattctacctatccacaaggatgagatgtgtttccatttgtttgtgctatctatgatttctttcagtcctagccagagcaatcagataagagaaagaaataaagggcatcaaaatcagtaaagaggaagtcaaactgttgccgttcactaaggatatgattgtatacctagaaaaccctaaagactcatccaaaaaacctcctaaatctgataaatgaattcagcaaagtttcaggatacaaaattaacatacacaaatcagtagttctgctatacaccaactgcaagcaagctaagaatcagatcaagaactcagcctcttttataatagctgttaaaaaaaaaaaaaaaaaaaactcaagaatatacctaaccaaagaagtgaaagatctctacaaggaaaactacaaaacactactatcttttgtatttttgtttcagtttcattgagttttactccgatctttgttatttcttttcttctgctgggtttgggtttgctttgtacttgtttctctagttccttgaggttttaccttacattgtctgtttgggctctttcagactttttgatgtaagcatttaatgctatgaactttcctcttagcaccaactttgctgtatcccagaggttttgataggttgtgtcattattatcattcggttcgaagaattttttaatttccatcttgatttcattgttgaccaaatggtcattcaggaacaggttatttaatttccatgtatttgcatggttttgaggattccttttcaagttgatttccaattttattccactgtagtctgagaaagtacttgatataatttcaattttcttaaacttactgagacttgttttgtggcctatcatatggtctatcttggagaacgttccatgtgctgatgagtagaatgtctattctgtggttgttgggtggaatgttctgtaaatatctgttaagtccatttgttctaggatatagtttaagtccattgcttctttgttgactttctgtcttgatatccagtgctgtcagtggaatattgaagccccccaatattgttgtgttgttgtctatctcatttcttaggtctagtagtaattattgtccaaatttgggatccccagtgttaggtgcatatatatttaatattgtgatattttcctgttggactagtccttttatcattacataatgtacctcttcgtcttttttaactgatgttgctttaacatctgttttgtctgatatatgaatagctactcctgctcacttttggtgtccatttgcatggaatatctttttccactcctttaccttacatttatgtgagtccttatgttaggtgagtctcttgaagactgcagatacttggttgaattcttatccattctgcaattctgtgtcttttaagtggagcatttaagtcatttacattcaacattagtattgagacatgaggtactcttctatttatcatgctagttgttgcctgaataccttgttttttgtcaccgtgttattgtattgtatgccctgtgagatttatgctttaaggaggttctattttggtgtatttcaaggttttgtttcaagatttagagctccttgtagcaattcttgtagtgctggctttgtagtggtgaattatctcagcatttgtttgtctgtaaaagaccatctttctttcatttgtgaagcttagtttcactggatacaaaattcttggcttttaattattttgtttaaggaggctaaagatagggccccaatcctatctggcttgtagggtttctgccgagaaatctgctgttaatctgataggttttcctttacaggttacctgatgtttttgcctcacagctcgtaagattctttcctttgtcttgactttagataacctaatgactatgtgctaggtgatgatctttttgtgatgaatttcccaggtgttctttgagcttcttgtatttggatgtctagatctctaacaaggccagggaagttttcctcaattattttctcaagtaagttttccaaacatttagatttctcttcttccttgggaacaccagttattcttaggtttggtcatttaacataagctcaaacttctttgaggctttgttcattttttaaattcttttttctttttttctttttttttagtttgagatggagtctcactctttcgcccaggccggagtgcagtggtgctatctcggctcactgcaagctccacctcctggattcacgccattctcctgcctcagcctcccgagtagctgggactacaggcgcccaccaccacacccagctaatttttttgtatttttagtagagatggggtttcaccgtgttagccaggatggtctcgatctcctgacctcatgatccgcctgcctcaacctcccaaagtgctaggattacaggcgtgagccaccgcgcccagccttaaattcttttttctttgtctttgttggattgggttaattcaaaagcctcgtctttgatctctgaagttctttcttctacttgttccattgtactgaaactttccagcgtatttttcatttctctaagtgtgtctttcatttccagaagttttgattgtcttttatttatgttatgtatttctctagagatttttttgtccatatcctgtattattttttaaatttctttaagttggttttcacctttctctggtgcctccttgagtatcttaataatcaacctaccgaattatttttctggcaatttgaagatttcttattggtttgaacccattgctggcgagctagtgtgatcttttggggtgttaaagaaacttgctttgtcatattaccagaattgtttttctggttccttctcatttgggtagaccatttcagaggaaagagctggggtttaagtcctgctgttcattctttggtgccatggggtgatgccttgatgtggtgctctccccctttccctagggatggggctcactgagagctggactgcagtgattgttattgcttttctaggtctagccacccagtggagctactggactctgacctggtactggggagtatctgcaaagagtcctgtgacatgatctgtcttcaggtctctcagccatggatcccagcacttgctctggtcgaggtagtagggaagtgaggtagactgtgtgagggtctttagttgtagttttgtttagtgcatgggttttcttgaatgttggttgtgctagcagttagttggcctccagccaagaggtggcacttttaagagagcatcagctgaaacaagcttgtcctaagtttgcctgaataggtatttgggcttctcaggtgatgggttggaccatagcgctcccaagagattgtattttctgtcttcagctgccagggcaggtagggaaagaccactgggtggagccaggattaggcgtgtctgagctcagcctccccttgggcagggcttgctgcagccactttgaggatggcggtgtggttctcaggccaatggagttatgttcccagggggattatggctgctctgcagtgtcatataggtttccagggaagtgggggaaagtcgtcagtgactggcctcactcacttcccacacagccagcaaggccagtctcactcccactgcaccccaccgatagcactgagtttatatccaggtgccggtgagcagagctgaggtcttgtcccagactacaagcctcccagctgagaaagcaagcaggactttcaggccccacctctccccacctgctgtagcttctttgctcatatctacactttctgttcaccccctaccccacccctgccccagattgtgcccagaaaaattcatatttggtcaaaattattacaaagttcagctagaagtttccttttccctgttgtctttccccagttccactggcagccctccccaagaacctctatgaggtaaagtcagaaacggcttccctgggcaccaggaatgcctacagggctctttctgctgcttcttctagttttatatttcactgggctctctaaattcatttcagctctaggtaaggttaaattcttctcctgtgatctgaatttacatgttccccagtgagggtatgtgttcagaagtggactttccctcctcacgctttgggcactcacagtgtgaatttcactttgttgagtgtagatatttttatatcctatattatgcttaagctttgttctgggatgaaattaacttattgaaaacagttgatcctttggagacttgcttttagacttcatgaggtgagaccagcacagcccttttctagggctgattttttcccaataatgttataatttccttttgagtactgtacctaataccctgagttacaaggttttgcactcagactggtgggaacatgaattattcttaatctgtgtgagtaggttgttccctcagctcctttcaggtgagttttctctgacccaggttgttttattacacacatgaatttattggtaccttgctgaagacttaagggacacttctgcagatcacttaagttttctctctgtacagctctctcctgtctggtattctgttctgaagaccctagactaccaactctgtctcctcaagtaaggagctcaccaggttcctaagtttcccttccctgcactgagacccagaaaattttatcaggcagtaggctgaagcaattgtggggttcacattgtttgtgtctgtctctcagacataactgccctgccctgcctgatctctatgactgttttatatattttgtccagtcttttagttgtttcagacaagagtaagtcaaatcctgctactccttctcggctggaagtagaagtttctagtcttatgatttttaactgttgtcagctaattaaaatgtaaagttttataaggacttcataagtgtatgcaaatgctcctaaggctttcctggatgtcagtttaggcccccaggcttcaggattaatctttaattaatactctgagtggagacagggaaaagaagggtgaatgaagtttctgtggtctaagaaatcccaatagacaacttctggagaaatgacaagagagggacataagcaatcaaaaagaagggcgaggccgggcacggtggctcacacctgtaattccagcactttgggaggccgaggcaggcggatcacgaggtcaggagattgagaccatcttggctaacacggtgaaaccccgtctctactaaaaacacaaaattagccgggcatggtggcgggcgcctgtagtcccagctactcgggaggctgagacaggagaatggcgtgaacctgggaggcagagcttgcagtgagccaagattgcgccactgcactccagcctgggtgacagacaaagactccgtctcaaaaaaaaaaaaaaaaagaaagaaagaaagaatggggaggggacatatgcatctccatctcaactctctaaaactaagactcagacagagattttggtgaaaaatgtgtgcctaataaaatacttgctctaaaaattagattctagatattatctgaatatgtgccagtcactattctaagcattttacatatgtggatgtatttaattctctgacaactgcataagtaagctattatcatctccagtttatggataaagaagcaggctaagcaaattccccaagatcccatagttaaaaaatggcatggctcagatttcaatccaggctctgtaactaatatattatctgctaagaatatcagtcttatcatgtttagttctctggcttaaagtccacaacataataaaagtgaattgtagatgctgagatgaagatattaaatgtaaatacaacaaatacaaggaaaaataaaaactgacaatttgtttaaaagggcaaggacatagaatcctctgaaatagacattgcactgagaagtctatcactagcatattaaggaatgaagactcagataatgaacttgctgttaaaaaagcaaacctctgttaataacttttaattaaacctttgattatatttttaaatgttttttatttcttaaaaaacagttttgggctgggcaccgtggctcatgcctgtaatcccagcactcgggaggccgaggcaggtggatcacctgaggtcaggagtttgagaccagcctggccaatatggcaaaaccctgtttctactaaaaatacaaaaattagccaggcatggtggtgcacacctggtagtcccagctacttgggaggctgaggcagaagaattgcttgaacccaggaggcaaaggttgcagtgagccgagatcacaccactgcactccagcctgggtgacagagcgagactccttctaaaataaataaattaattaattaaattaaataagaaacagttttgcatttgaataattctgacaccaaaataatttttatcctggaatacactattcaatagtggtaaactttgttatatggaaaacatttcttatttctgagcaatatcaggtaaatgaatcaggaattatttgaattagaaggtattgttactaaccccctcatacctccaatgtactaaaactaatacatcttaaaattccttttaatcatttaatttttcttttttccaaaattttccccacataaataaagtagaatttagcctcttctacttcaaaaataaagtattttctaacaatgtttatcattataagtttctcagggctcaaatgtagaacatctttttgatagcttttcactctttccccaaacatatcccagttttatgagaccaagtacaaatatcttcctgtcacacatcatcaggagaatcttgccaggtgcagtggctcacgcctgtaatcccagcactttcagaggccgagacgggcggattgcctgaggtcaggagttcgagaccagtctggccaacatggtgagaccccgtctctactaaaaatacaaaaaaaaattgctgggcatagcagcaggtgcatgtaatcccagctactctggaggctgaggcaggggaattgcttgaaccaggaggtggaggttgcagtgagccaagattgtgccactgcactccagcctgggtgacagagcgagactccatctcacacacacacacacatacacacacaaaatatggataaaatatctagtgtgagaggaacagcagaaggagaaagtaatgtcttgaggaaggtgcgaatcatctgtaaatactttttagagtaatggaattcctagacagacagcttcgcaggcagtattgccattcagtatcattggcaaccttcctaaaaggaaaagagtaatgttaatgccatttctgaaggtatgaattgaggattttgattctttttccataaatacttaccttgtgaaaactcctctgcaatctctactgtcagtaagttttataaatgctgtatacaagtcttcaattcaccattgcctgcttgaggcttatttattttttgagaaagaagctggagaagtcatttgaaaattcatgggtagttcactcttcaaggttgtggtgtgctcttcaaatagctataaaaatttccaagagacaggaccactgaccctgcgcttcgtagcaaatagctttacttactcattatctgactagcgtattagttaatcatgtaaacaattatctttcttttcaggtggcaataattcatggcatctcctcccccttccaccccacacatatacttatttattgtcacagcctgatttataattgttttttaggatttcttcatatcctccctcctacctttacccctgagttcagaaaataataaacactctaaatctccaagcaatggaactcttctaagagttaagctaaagtctatcctaccaccttgctatattaatgtcagctcatttgatgtgtctgtagagcaggatttgtttggcaagctttttctgtaaaggaccagatagtatttcaggctttttgagccatgtggtgtcggtcacaacttttcaactctgccatcatattgtgagagcagaagtagacaaggtatgtttaaaaaaaaatgggtatggttgtgctccaataaaatcttttttatagacactaaaaacttgaatttcatgcaaattttatgtgtaaggaaataattttttaaaaatctcttctttaaccttttaaaaagacaaaagccattcttagcctgtgggtcgcacaaaaacaggcagcaggccatgggccatagtttgccaacccattatctaaacggttaacagaatgcttactacaggttttctgaccctcagcactagtaatactttgggacagataattctttgttgtggactgtcttttgtttttgttttgagacagcatctcactctgtagcccagactggagtgcagtagtgcgatcttggctcgctgcaacctccacctcccaggttcaagcgattctcctgcctcagcctccccagtagctgggattacaggtacccaccaccatacctggctaatttttgtatttttagtagagatggggttttgccatattggccaggcttgtctcagactcctgacctcaggtgatctgcccgcctcggccccccaaagtactgggattacaggtgtgagccaccgtgcctggcctgtcttttgtattttaagatgtgtcatatcatctctggcctctgcctactaaatgccattaacaccctacatcccccaattgcaacaactagaaaatctacagacattgacaaatgacctttggggacaaaattgcccccagttgaaaatcactggtctaatacactgaaaacttagaatacaccgcataaaatatgagctggtaggctgcgtagtataagatagcgtcatgtgtcacctgagagatagccattggattctcatgcttctaatgtagaaaccataataccgtggtcttccccttacctacagtttcattttctgtggtttcagttaccagagatcaaccaaagtctaaaaatattaaatggaaaatttgaaaaataattcatcagttttaaattgtgtgctcttccaagtagtatgatgaaatcttacaccatcccaccagagacttgaaccagccatttgtccagcatatccacgcggtagctgctacctgttcctgagtcacttagtagacttctggattattggctcaacagtagaggtattgcagtgcttccattcaaaaattccttactttacttttattatggtatattattgtaattgttctatcttattagttactgctgttaatattctattgtgcctcatttataaattaaactttacatagatgtgtatgtattggaaaaaaatatggtacagctgacccttgaacaacacagatttgatctgtgtagtcttcttttatgtgttttttttttcaataaatacagcaggccctccatatcaatgggttctgaacctgcaaccaaggcaagacacaaatatagtattcacaagatttgaaacccatgtatatagagagctgactgacttttcatctgggagggttctggatggctcacttccatacttgaatgtgctcggattttggtatagaagggggtcctggaaccaatcccccatagatagcgagagatgacggtatacatagggtccagtattatctgaagtttcagacattcactggggctctgggaatgtataacctgcacataaaagagaatttccgtactacctccaagttaataaccactgaagaaatcctaggcttaagagagcccgttattggaacttagatggtggcgttagagtgcttatgctttggacttaggagtcagtatcccttccccccagctttgtctctttctatattcctttcccatttttcctctttccacctccttacactcaaaccatacagtgtgcacctgacagtggactacaaagattaatattcgatgaaaggactttgtccatttgaccagaccacttgaatgatgaggtgggagccacagaatacatagttgatattaaattaagaatctaggccagacccggtggctcacacctgtaatcccagcactttgggaggccgaggcgggttgatcacttgaggtcaggagttcaagaccagcctggccaacatggtgaaacccgtctctactaaaaatacaaaaattgctgggcgtggtggcaggtgcctgtaatcccagctacttgggagtctgatgcaggcgaatcgcttgaactcggaggtggaggttgcagtgagccgagattgcgccactgcactccagccggggcaaaagagcaagactgtctcaaaaaaaaaaaaaattgagaatctaaattaatttatagaaatcctttttccataaatttatcttttctccaagttttcttctgatatgcaaagtgtgagacacctactcttagcttttagatagtttacaggccaatgacacacagtagatgatgttctgccatgatgtctcaaaggcagagaaacattcttatttttatcaacactttctcatccccatctttaaattattggtataaacaaacttctgcttctcactttagattataattttatcattttttacaattcatcaaagaaagtttttctaaattgcacggaaagttctatagaatgctgagttatgtattctaaagaatatttctccttcccattttttcatagctaaactgtcaatatttttaccttaacttcctacaaagtcctatagctatttgattacttgatgtttcagtataaaaaaaaattaggtcaggtgtggtggctcatgcctgtcatcccagcactttgggaggccaaggcaggtggatcacctgacgttaggagttcaagatcagcctggccaacatggtgaaaccccgtctctactaaaattacaaaaattagccaagcctggtggcaggcactggtaatcccagctcctcagatggctgaggcaagagaatcgcttgaacccgggagacagagattgcagtgagctgagatcgtgccactgcactccagcctgggtgacacagcaaaacttaatctcaaaaaaaaaaaaaattaataatgctgcttctgcctgaaatacatgatttccagtgagtgaaggaccacttgctctactgaagtaaagctactttactcaagtctctgaaggagtaagagagtcctgcagggcacatttgaacagctcactttcagatacaagtgataaaaaatggagcctcagcaacaacaacaaaaattataacttttaaagagatagaacaacatggtttgaaaaggaatctggatttttgcctctggttgctgtcattgacagggaaagtcttatattttctgaacttgtttttaaatccccccaaatagagggattagactgtgtaattccacaaatccgttgattttatgacctggctatagcttgggaaagcaaccacatagtaccgttgttacactccagagctattcaaatattgttatcaaagtggtgccaaaaatttctaatcaaatatttggaagagtttggtgatgagtcgaaagtagcctgtatgtctctgaattctgtgatgtttctcatttttcctccccgtacagtcttcataggtatttagacaagtaaacacctgtaaaggaagaatgtgggcaataagaatgaatataaatgataaatcacataatctgatgtaatgaaagacttaagttattacagaaaacctagaattaaatgaaatatttaaaaagtgatgtcttcaggaagtctacagttcagattcaagggtggcaaatactgtccatggagaccagtagttctcaggagggtgactttttttctccaggagacatttggcaatgactggagatatttttacttgggcatgttgttgatatctagagagtagaggccacggatgctgctgaacacctccaatgtgtaggacaatgccccgcaacaaagaatgatctcgcccaaaatgtcaagaatgccaaaatggagacaccctggtgtagacctatgatagctctgacttctttttttttttttttttttttttttttttttgagacagagtctcactctttcacccaggctggagtgcagtggcccgatctcggctcactgcaggctcgatctcccaggttcatgccattctcctgcctcagcctcccgagcagctgggactacaggagcccgccaccatgcccggctaattttttgtatttttagtacagacggggtttcaccgtgttagccaggatggtctcgatctcctgacctcgtgatccacccatctctgcctcccaaagtgctggagtgctgggattacaggtgtgagccaccgtgcccggccgatagctctgacttctaagtcaactgtgttcatcagtttcatatctcccctcttactttccaccatcacaaaagcctctgcctcctaccaaatgttagtaaatgcagtgaatgttagcaatctatttgaaacaaggtttcttggcattcatctagctgtatggataaagttttaccagcacaaactctgtatgcatggggtagactggatcagacagagcaatctgaaccacaatgttggatttccttcaagcttgagaaatattaatactaccatatatacaggcggggcatggtgggtcacgtctgtaatcccagcactttgggaggccaaggcgggtggctcacctgaggtcgggagttcgatactagcctgaccaacatggagaaaccccttctctactaaaaatacaaaattagccaggtgtgggggtacatgcctgtaatcccagctactcaggaggctgaggcaggagaatcgcttgaacctgggaggtggattttgtggtgagccgagatcacgccattgcactccagcctgggcaacacagcaagacttcatctcaaaaaaaaaaaaaattaccacacatactaacaatatgaaagttctaattcatatttaaggaaacatctgcttctacatgtgtttctatctgtggttctgaaaagcaaatcctaatttttatgaatgataatttctgggcctctttttgtctttccccagatgttccctgctttgttgcttaagagctgcatggcacagaccataaaggttgtgagctcttcccatttcaagaaaccctggggagattcaaataaacaaattcaaaatgccccttagagtctttaacagaccagaattagtacgttgtttgtttgaaaatctttctttttttcggatataaaactatacactcaagactaaatggaggcagtacaattacacattttgactgaattgtctcatcagtaaaagtatcacctggctaattgtaactctttagaattggcctaaactagaaaataaacaaggaccttattcaagtatttcctattatgttacatacatacaagttaccaattagaagttgatatacactattttgtttaaaaataaaattcagcaagcttctgatgatttattctgttcttgtttttcttaccagttttactgccaaaataaactccttctcatacaaagtctgggattataccacagagttactataattggattcaactttaatagaatattacaatattaattttaatagagtatggtttcagatattaaaaagattaatgtacccaaaaacataatcattgttttgttttttttttagacagaatcttgctctgtcacccaggctggagtgcagtggtgtgatctcagctcactgcaacctccacctcctgggttcaagcgattctcatgcctcagcctctcaagtagctgggattacaggtgcatgccagcatgccaggctcatttttgtatttttagtagagatggcattttgccatgttggccaggcttgtctcaaacttctggcatcaagtgatctgcctgccttgaccttccaaagttctgcgattacaggcgttgagcaaggcattgagccaccccacctggccacttcttttaaattgcataattttcctgttctctatttcatccaatctaaaataataatgagttttaaatacttatttttaacattttttttacacctatgatttgagaatatatatatattaggccgagtttcatttttgttgcccaggctggagtgcaatggtgccatctcggctcactgcaacttccacctcccaggttcaaacgattctcctgcctcagcctcctgagtagttgggattacaggtgcccaccaccatgcccagctaatctttgtatttttagtagagacagggtttcaccatgttgtccaggctggtctctaacccctgacctcagatgatccaccagcctcggcctcctgaagtgctgggattataggcataagccatcatgcccagcctgagaatagatttttgacatttttaacttgattttccgagaagaaaaaattacatatttttaaaaataataaatacattgaaatctagattttaaaacatgtttactttctctcaaatttgttagaaatgtcacaacaaatagctttttcaacctatgaacagtatttgtagaagggaaaaatgaggaagaaatgggcacatttttctagtgattgaatggtggtgtctacatcttgaataattctcactgcatatcgttgcttgaattgtagatctgtatggcatgtgacttgcctgggtctatgatgttgtcaacagaaagagtcaaattctgtaaaatatttgaagagatttcttctgagccaaatatgagtgaccaatggtcccgggaaatcctgaaaacatgtgcccaaggtggtcgggctacagcttggttttatacattttagggggacataagacatcactcgatacatgtaagatatactttggttttgtctggaaaagcaggacaactggaagccaagggtagaagggggccttccaggtcataggcagattctcatgatgttgcccagatgtcctattgtaatttcaattggttgagtttatctaaagatctggaatccatagaagggagtgtctggattaagataagtggttgtagagaccaaggctcttattatacaaagcctacaggtagccggctttggagagaatagattgtaaatgtttcttatcagacttaaaaaggtgccagactcagtgaattctctcctggattagggaaaagacctggaaatggaaagggattctctacagaagttagatttttccccacaagagacagctttgcagggccatttcaaaaattgccaaagaaatatattttaagacaaaatacttggatttctttcaggacctgctatctgtcatgtaatgctatactagagtcaggctggatttgggtgtcttattgctacagaaagtcttaagatctctattaatgttaatgctggtcagctgtgcctggattccaaagggaggagggtataatgaggcatgtgcaacccccactccccatcatgacctgaactagtttttcaggttaactttggaatgcccttggctgagaggagaggccaattcagatggctgtggggcttaaaatgttatttttggcttatgatgtggaggcagaagtaacctgtatcactgttgtgccaaagtctctaagagctaatgtgcagttcaccaagttgtctccctatgagagtcagccatcactgcaaacagcaacactccaggttgattgtggttctgtcagcttcatcctgcaccccagagtaaagatgacatagtggggagcctgtcttacaatgagcatatagcagatgcaagaaataaacatttgccttgttaagccactaagatgtcagggttgtttgtcctgcagcaaagcccagctcatcctgactgataaacttatccattcaagtgatcagcttttggtgtaaatgcccctaagaaaactgataaagcggccgggcacggtggctcaagcctgtaatcccagcactttgggaggctgaggcaggcggatcacgaggtcaggagatcgagaccgtcctggctaacacggtgaagccccatctctactaaaaatacaacaaaattagcctggcgtggtggcggcgcctgtagtcccagctactcaggagactgaggcaggagaatggcataaacctgggagacagagcttgcagcgagccgagattgcaccactgcactccagcctgggcaacagagcaagactccatctcaaaaaaaaaaaaaaaaaaagaaaagaaaagaaaactgataaagcctgatgcactacctacctatgccttgccaaagaatggtaataatccaaaaactgtttaatttagaccttcactatgcaatgcatattttatctaggaacacttttactggtatcagtgatcaaaattatagagcagggggggaaatgtgaggaaacaaatctcaaatgtcaacatacgtggggatcttgtttgcagatgaggaagtgcattctcaaagctgtgtgaattgtcctcatcatacagctattttcattgtattctttcacaaaaatatgtatgtggatggattcttaggtgttagagacggggaggaaagaataaaggagactcaaggcataggtggaaaccgtgcatacagatggtatatctttatgtgttgagcatttatatcatgcatctgctaagtactgcaatggaaacaaggataagacgcacagacttccctaaagaaatgtaaaatctcaatgacaaagaaacatgtgaagaagttagtatcttaagcaaaatgatgcaattcatagtaggccactgtgtactggaaaagtaagggctattctattccaaagtgtgatttttttattgggtgagggggacctgagaaagcttcatggagggtgtgatagttaatactgagtgtcaacgtgattggattgaaggatgcaaagtattgatcttgggtgtgtatgtgagagtgttgccaaaggagattaacatttgagtccgtgggctgcaaaaggccgacccacccttaatctgggtgggcaccatctaatcggctgccagcacggctagaatataaagcaggcagaaaaaccttgaaaagactagactggcctagcctcccagcctacctctttctcccatgcttgatgcttcctgccctcaaacattggacccctggttcttcagttttgggattggactggctctctttgctcttcagcttgcggatggcctattgtaatcatgtgagttaatatttaataaatttccatatatatatctattttattagttctgtccctctagagaaccctgactaacagagaggagaggatatctgaactaagcctcagaggaggatgaatggcaaggagaagaaacatgtctccaggaaactgaggcctgagggggtagtaatttttcccgagcatatgataaatgacagtgatttgggaagacttcatggcatgaatgtatgtgagaaagtgggcttgcgagagcaagattggaggagttggttatggaaaggcgagtaaccagatataggctgatagatggagtaagcatagagaagggcattgttttgtttgcttgttttttttaattttttaaatgttttatagatatgggagtcttactacattgctcaggccggtcttgaacttctgggctcaagggattctcctgccttggcctcccaaagcactgggattacaggtgggagtcatcaggccggcttttaaagaagggcattgcagtaggaatagaatgaaaggaagagatgaatgaatggaagagatatatgagccatttcaaaataagaatcacaacagtggaactgagtggctgtggataaaagctaaaagggttaagtcagggttgggaccaacagaactagaacaatacttgtattttggcccagatgacaagggctgaagggcatccagtgaacacccagaaactgaggacgctagactgaagcccaggggaaaatccaagctagtgaggtttttctcttatgagttatgggaggagcaacttggagggaacacttattgattgcatctcttgtaatatccacagcaaaggcatatgaggcgaggctagggaaggagatagaggaggagtgtggtcagagacgcaaaaggcatcaaataaagctgatgtggaagagaaccaggacgctcattgtggtatgaaagtcaagagagagagcttcagggaggtgggggattcgcaggtttaaggagaaagcaaagagaatgaggaccaaggaaaggccattggatttgaagtttgagattttctttctttttttttgttttgtgacagagtctcactctgtcaccagcgtggagtgcaatggcaccatctcagcttattgcaacctccacctcctgcgttcaagcaattctcctgcctcagcctcccaaatagctgggactacaggtgtgtgccaccacgcccagctaatttttgtatttttagtagagatgaggtttcaccatgttggccaggctggtgtcgatctcttgacctcgtgatccacctgcctctgcctcccaaagtgctgagattacaggcgtgacccactgcacccggcctgaactttgggattctcttggtggttgtagagaatgcacttcattagctttagattctgggacagtcacattataaaagacaaggggaaataaagagggtatacaggacactggtgtatactgtccactccagatcagtggatgaagaggatctgcaccctaaggggacagcagatttatcccattgctttgttgtgttgctttgtcgagatgggagatacctgaaagcagaaggaaagcaacataggaagacgctcaaaaataatgattttcttaaatgcacatgataatttatggctgacactgacattttctcagttacctttcataataacattagagaaatgacataaggttgcagagtggggggcagtgggtttcttctgactccacttcggttcccttcatagcatgaacacatttgtaagggagaaaacgaggcaggaatgatgcacattccgagggtgggagtgaagaattaggagtcacaggtaggttagcatgtggaagagaaggtgactgaaaccagaggcagagaggagaaagtggactgagatttacatgttttactccctgaagagactagcagtccctatttccaccaagggcagaaacattcaaacattctgcatacctttccttttatgcatgaaataaaatactggcatttgaaggaagaggttgataatgtttatttcttagaacattcaagcttggcagttatgtgacttatctctagagcctctcagaagtctctggggacgcaggagtctttggagactcacactttctgcaaaagtgcagaaagaaatacaattacttaatgaatacctactgtgtactcagcaaatcctttatctgtcacttgtgttaatttctagaaattacataactaagagtctccatgaattgcacttgttttcttaagagggaaagagaaaaaaataccttctttccttaccatttaagccagtgctttttaaaccaggatctgacactccgtaggtgaccatagatgtagtatcacagatccgtctgtttccaaaatgttacattctgattttaagatcccctgaaagttgaaatttctcttttgctgcaacaactcacacttgagaaaaattttcacaggagactttattttcttaaagcagagtttgttaatatgaattctcacaggactgtggcaattcatttttcttttaatgcgttcattactctagaccaagacatcaatttttgtgcaaaccttgtttcctgctgccacctggtggaagccacataagagttttacagaggctttggtggtgctaggagaggggccagggctcttcctcagtcacagaatcccacacagtgatcaaagagcagatctttctattaaactccctggcagcaaaacagtagaggcttggctctctgccccgggactgtgcagaatgtcacaggtcggaagcccagagcatttttctcttcttttatctttagactcttgtggctctcagaccttgaatataattctttgctgaaaattctttaaaatcattatcttttctttcttccttttttctttctttcttttttctttcctcttttttgctatgctagacaggaagaaagaagggaatggcattttaatgtaaagaagattgcactgaaattatattacttgcttaattgtattaattcactgcaataacaatttaataatatgacaggtcatttacatgctaatcatttgggtctcttgtccagagaaatcatgaggaagggctgggaagtgctcttattatgatcaaaataatccacactctcctagaggagtgcataggtatagaactgacattgtttgtttaataaagtttcattcaaggcaatttggctggttcttttatcaagtgtaatgggaaaacaagccagtcctgatgttaaacactccaatgatccctcaagctttttattctgtaataagttttacagcattatgtgttacccacgacagtcatttagtcggtcaatttcaggctagtgataaaagtttgagtaatgggaaagctgtgttgatgttccatattctttgtgagatgtctatgaattaatgctcccaggtacacactcaatttatatttaacagccattactaaatgtaatatctaagtaaaacccagttatgacctatatatatggaaaactaattaaagctgttggaaacaacctatttccctttggattatttatgtaaatacatcgaggtctaaaaattcagtacaagtcagatgtgttcctgcctagggctattatataaagctcagaaaattttatgagaaaaatgatgattcttaaggattgagcttcaaatgtgaatttttctattttataaggatatagcttgggttgttaagcatcaacatagcttttcaaaatagttttttattctcacaagtttaaaggccttgtaaaatctcttctattaaatatacatatatacatacatattacatatacaccaattgactaacccctctaagtgctgtatctgaactaattttaaaagaatacccgtgtttttcagctcccaaattgaaaagattattagttagtaccgtgatttctgaacttttaatcaaattttcattcattttataattttgaaattttgacaatctgagaatcttctatgattaaatatattctttcttcctttcttttttctctttcccttccttccttccttccttccttccttccctccttccttcctgtcagtctgtcttgctctgttgcccaggctggagtgcagtggcatgaacatggcacacttcagcctcgaactcctgggtgatcctcccaccttggcctcccaagtgttgggatagcaggtgtgagccaccaagcctggccttataaccaattaaatgaaggaaatgatactatgacacagacaaccatttttcaatcaagttattctgccatattaaattttcagtcacctttctattgcatttattgaatttctactttttaccagttctaagcctagatctgtctctcttaaattattaaatgtcttattttcttatgaaacaaccttcagatgtaatacacagaagaaaaaggagtctcaggaagtttagtttgcccaactagaaattgagcacaattacttggtgtgttgagggggatttgaaactatgtccttatgataattgatagttatgataattgatgacaaaggggttttagaaagacctcttttgcttttagaaacacttctctttgcactttctttaatgcccattttttagttttatgaattaaataatatacatttatttaaacaaaagtatcaacatttctcaagtatctataggttacttatctactcaatgcaactaacaatcaaaaactagtgctccaacaaattaaattttccaaacactgaaatattgatcacaatgtctctaagcatttcattgaaataaaaattttgatgtatctaattttcctaaatattttaaatgcatttcaatatgcaaaactctcacaaaattgttgtaaatacaaaggtaatcagtatttttagattaaaatcagttataaatgtgctaatatagtgaatgtgacccttgtccggactcacatttttcttcttagtcttttcctgggttatattcttaacatatcagctatttttctatttttatagcttcttagggttcaaaaatattaccatatccaaatgaaaactaactacctgagagcagccaactgcaggatctgtgtcaggatccagctgattcttggtgaggacacagatccaggtgtctaaggagattcagacactagccagtcatcatcagattaagctgcacttaaatccacatatatcaaattgtttttttttatttttacaatggtgcgttactaccatgatgtcttcacaactgatttgagcagtgttgcaaatcccatttcattatcccatcgttgtgatatatagacttggcctgttggaataccttcttggaaatttaaaaaaatagtttattaagattattagggccattgaagaatttcctcctaggagataatgcattgagtctacctttcagtcctcctcctcagaacacgtgcccgaactatcatttttgagatcaccattgatttctttctacagcgtggtcactggtaccaataaaatgctagtcttcattcctatccagttattatgtggggccccatgttgttagtctttctgatttcattatgatactaagttttaagggaaacttgacttcctatttttgtgtctattgtactacccactatagcgactatatagtaaggaatataaatttgttttcataggaaataaaatacccacatatattaaatccccattaaacataccctatttcatttacccttctttaaattataactatctttttatatggcttatattaacttttctctctcaagcatcattttaagctaatgacctttcagactagacccaacttctttcagtcaaccataattcatgctcactttctccctctctctcatcaaatcatcgaaatttgatcagcaggaatctctttaacttgactccattgattttttagtgttttagtacagtctccaacattcttaaaaacatatttgttttctagcaataacaagatgtcccagactcattccaatttgttttgttttactgccccaaaacatggaatcagcttccctaccataagtagtaaagagtagtagagaatactattaaagtccaaaatctgggaactagggataaacaggagagttgatggtaagtaaaaccagtgctgctgcttaactatatttactaatgtcagagatggaaaatacaagttattttaatgtcataagctcacagtaattttttccaaataagattatatattgctatgctctacttttctcaaattatgtgattttattgaaaatgaaaacttttattttggaattgaaatatttgaccctcttctttctgcttaggggaattatttggaaagatttcttatgcctagttctgtagggttccaaaccatgtatactttcacaaaatgcatgtgtgcaatagcacacatgctatttccagcagcaagttgaatccttgtatctagcactgatggtcaatatgttttgcattttgctttcccacctccaatgaattagtataaactatgaccttcattgatatttctttagtttttatatttgtatgaatcagctacttcaaacccttaataaaatctacaacctctccaataaacccaaagttactagatggaaggaaacaaagattagagcagcaatcaatgaaatagaaacttaaaaacagaaaagatcaacaaaactacaagttggttttctggaaaaaaataaacaaaatcaataaaattttggctagactaagaaaaaaaaagagaagactcaaataaatgaaaccagaaatgaaagaggagacatcataacctataccacagaaatccaaaggatcacaagaaactgttatgaacaattacacagcacacattgaataagctaaaaaaagaataaattcttagtctcatagaacccaccaaaactgaatcatgatgaaacagaaaatctaaacaaaccattaatgagtgaggaaattaaatcaataaaaagcctcctatcaaagaaaatcccaagacctgatagctttactgctgaattctaccaaacatttaaaggataaaataccaattttttgcaaacttttaccaaaaaatgaagatgaagaaacattctcaaactcattttaccaggccagcattaccctgataacaaagccagaaaaagcaccacaagaaaaaaaattacatgcccatattcctaatgaatatagatgcaaaaaccctcaacaaaatactagcaaactgaattcaacagcatactaaaagaatcattcatcatggtcaggtgggatttatcccagagatgcaaggatggttcaatatacaataattaatatgatgcaccacattagcagaatgaaggacaaaacccatatgatcatctcaatagatgcagaaaagtcatttgacaaaatttaactttctttcatgaaacaaacactcagcaaattaggtacagaataaatgtatctcaacacaataaagagcacatacaacaagcccatagctgacatcatattcaattgagaaaagttgaaagctcttcctctaagattaggaagaagacaaggatgcccactcttgccatgtttattcaacatagtactagaagtactagccagaacagttaggcaagagaaagaaataaaggcatccaaattggaaaggaaaaagttaaattgtctctgtttgcagatgacatgatcttatatgtagtaaatcataaagactccatgaaaaaactgttagaactaaaaatgaattcactaaagttgtaggatacaaaatcaacatacaaaaatcaacagcatttctatatattaacatgaattatccaaaaaggaaataaagaaaacaatttcatttacaatactaaaaaagaaatacttaagaaaaatttaaccaaggaggtaaaagtttataatgaaatttataaaacattgaggaaagaaattgaagaacacaagtaagtggaaagatatcccattttcatgaatttgaagaatattgttaagaattcagtactacccaaagtgatctacagatttaacataatgcctataaaaattccaataacattttttacagcaataggaaaagtaatcctaaaattcgtatggaaccacaaaagaccctaaatagctaaagcaattttaagcaacagagagatatcacatgacctgattttaaaacctaccacaaagctatagtaataaaaacagcatagactagcataaatacagacacatataccaatggaacagaataaagaccccagaaataaattaatgcatttatggtaaataggtttttgacaaaggtgccaaaattatggggaaaggacagtctcttcaagaatgtatatccatacatagaagtgtgaaactaggctctcattttacaccatatacaaaaatcaattccaaatgaattaaagacttaaatgtgacacctgaaactgtaaagctactagaacaaaacatagggaaaatgctctatgatactggtctgggaaaagattttttggctatgaccccaaaagcacaagcagcaaaagccaaaatagacaaatggaatgacatcaaactaaaaagcttctgcacaacaaaggaaacaatccaacagactgaagagacaacctatggaatgagaggatgtattcacaaaccatacctctgataagggattagtgtccaaaaggtataaggaattcaaataattcagtagtaagaaaacaaataacttgatttaaaaatggacaaaggacctgagtagatgtttctcaaaagaaggcatacatgtgccaacaaatatatttaaaaggtttaatatcactaatcagggaaatgcaaattaaaaccataagataccacctcaaacctcttagaatggccattatcaaaatgataaaagacaacaagtgttggtgagaatgtgaagagggaaccattacacattgttggtagaaatgtaaattagtacaaccattagggtaaacagtatggaggttcctcaaaaaattaaaaatagagctaccatatgatccagcaatcccactattggctacatatccaaaggaaatgaaattagtatgtagaagagataagtgcactcctatgtttaccgcagcattattcacaatcgctaagatctggactcaagtgcccatcaacagatgaacaggtaaagaaaatatggtatatatacatgatggaagcttcaaaaagaaggaaatccagccatatggatgtacctggagaccattatgttacataaaataaactaggcacaaatcaagtatcctatgatcccacttacatgtggagggtaaaaaagttgaagtaattggaacaaagagtaaaatagtggttaccacagagactgggaggtggtgggattaggtagatcttagccaaaggacacaacatttcaattagacaaaaggagtaatttcaagagatctattgtacatcatagtgactacagctaatgacaacatattgtgtatatgaaaattgctatgagagtggattttatgtttccattacaaaaaaagataaatttttcagataacgcatgtgttaaatacctttatttagccattctacaatgtgtactgtgtatgtacatgtgtatatgtatataatctcaaaacatcatgttgtacaccatacatatatacaatttttacttgtcaatcaaatagtttttaatttttaaaaatttacaccttccttttggaataaatatcccagctctcaaagctgataagtaatgaagtaaggatgaagctacctgatttggctgatgtatggtccagagaaggcgatgcatatgggacaaaatcatgaattaaaaaggcaatttttctttagattaaaaaatgtcaacaaatagcaatgtttgttattctaaggaaaaattatttatgatacatgaaaacataaagaacatccaaagctgagaagtattctttcttcattctttttatagtcttcatcttaagtgacttcaatacataccatttatcagcatgtctgttacatcttatattgaactgtttccatggaacatctccatgggtcagactgtagcctcaaagatactacaagcaaaagagaatccagcagtgtagtgggagaaggaggaaaaccttccctgactgcttggaaattgatgtatttatgacatgaagaagttaaaagactaggccaagaggcacaggatccagataaaacaacttccctcgggttccagagacatgaaaataaagaatttatagttatcaggaaggaggtaatttgctgaaattcccatcacagatccaaaaacgaggaaggaggcagacatgtgttaatagctccgaagtggcctggaagtcttattttgccagtgatttaactgaagatcaaatacactcatgtaaggaaagcagagaaagcttgcataagtctctggcctggacctggaaacccagtctgctttatttccttgggggagcaggtttcctaattcttccacgacatttgttggttaaatgttgaccaacaaaagcagaatgttacattgtgtttgatgggaggggaaagtccttgttttctatctagtctggggaatcatacatcaatccacacaggaatatgcatcaagtgtttccatcttaatgagtggcatgattccagaagggcaacaggccaggagagctctaaagcttccctgaaaaaatggagaggctggttgtgttttgttcttgccttggatggatgaagaaatggaagcaggtgccccattgggaccatggatcaaatgcacttaggaacttaaaggaaagtctaggggctctgagtgaaccagcacctcctgccctgctgggggttagaggcttcactggctagtccgaagcctagtggttttgagtaagaaaagaacttcaaaacattttactgtgatttaaaaatcctccatggtgagcatgcccagcttttgttctctcgatgtacctccaatctctcaagaagacataatttagtaacgctggggttgctgctactataaatgctttgattaacattagaggaagaggacgacagaaagcagcttctgtcccagccaattaaagagcttgtttaaagtatgaaaatgatttattagacatgcaaagagggttgcaaagaagaaagacacacagtctcaatttaaaaaaaaaaaaaaaaaaaacaaccacaaagctttggtccaggtgcctgccttctgacaacacagataaacagtttagttgataatcccccacatcttcttcttcagcacagcaatttgttccagttatcatactttctaaatagaataaaagaaaatgatgctcctttataatatatatagggtttagataaaaataaatagcacagtccacatgctttaaaccaaagattgagtctgtgtgaacagaaataccagatagctgtttgatacagcatttcccaaatagatatatctgagagctctgctaaaaaaaaaaaaaattaaatttttttaaaaaggaaagctagaaaaaataataataaatagagccttgtgatcatatatgtgcatcaacaccggctatatactcctttcggaaaatcacaatgtacgtgactcttgcagtaaagaaatgtgtttaacatttttacatttttaatacagcatttctcatacatatttgactgtagaaaccttctctgatatgacgactattgtcattccctagaattagtattctgttcaacatacttggaaaatacttaactagccaatctatttacaatgggaagagctataaagtccctcagtcattaacagctaatacacttgaaagattgttagcagaaaaaggaaaacatgacgtcaggaagctggggccatggattttgtcccttacacataccttcgttttacagacatcacaatgacaaattcaccctgacccaactgaggtcacatcagcaactgaatgtaggtggattgtctgaaacccattaccgttgtccacccaccatcatagaaaattattttaaatgtatgtattatagtaagagtactcttgatagtattattttttctttctttcttttgagagagagtctcactctgtcacccaggctggggtgcagtggtacaatcacagctcactgcagcctcaacctcgcaggctcaacctcccaagatgctgtaactacaggccagtgccaccgtacctggctgattttttgtattttttgtagagacaggatttcgcaatgttgcccaggctggtctcaaactcctgagctcaagcgatctgcctgccttggcctcccaaagtgctgggattgcaggtgtaagccaccacacccagtggctaatattacttaaaccatataaaactaggcagtggagaaagggagtaagagtacaggctccagattcagacggactttctctgaagtccctcctactgcccatggggacttgaacaagttacttaatttctctataagcctcaatggcttcatctgcaaaggagaataatgacagcatctattttttaatgttttgtgaaacatatggaataatgcatagtaagtgcatagcacagtaaatgacacatattaaacatagacaaatattagctgtaatattttatcatcattttctttacaaataatagtgtttttggtaactaagactaagaagaaaagaaggaagacagaagttgaatgtccttgcagatggggggcaaatctgctggcaagatttgtgatgtgtgttgctaattatctgtgattaactggttaatagattagttaaatcatcctgttggctctgcggaggatgatctggaaggggtggtactagagtcagggagacaaaagcagtgggaaaagataacagaggatgactggagagactttggagctggaattgacagaatttggcacctgattttgcatgggcatgagatttctggcttagaagagaccctgaagtttcataatatggacggtgatattactaagatgaagaccacaagagaagccactcttggctgagcgcaatgagtttggttttagacttgctcttgcaagcttctggtaggaaatcttaatagttaagcacgttctgatagaattttggcacttggctctaggaaggaccctgattagacatagatggagctatcaatgggaagatagttgagatcacatagataaatgatacacagagagaagagcacagtggcatagtggagctcagaggaatgtaaatatttaagagataataagaggcagtggaaccaatgaaatgatgaaccgagagtaaagtagaaagatgatgagagagaataacgtcctgaaagttaaatgagcttgagtcaacaagcacagaaatcagggctacaggctacatgccaagcctctgaacttcctccgtcctggaccatggaccaagctcagtcctgttttccccagagacccacagaaacgccagtttgcctcctagtgtaaccctgcaaagaaagcaatgtcgttctgcatcaatgctgatgagcctgcgctgttcagtatctgtggggcttgccaagctactcctgctcatggaaacctcagtcaggagcgaggattccttggcagatcgtccctgtgttctctgcatgaggtctctgatctggctgcaccaataacaagaactaatgtcatgtttacccttcacaaagttcaaaataacggtacttcgaaattagccaggcttctaataagcagtctgagaagtacacagactccaaaacagtgtttgcagagcttctgtagaaaagatcatctgcatcagaggcagctgagatcctaatgaaaaagaactgcaagactgagtgattggaaatagctagggttatggctcagcaagctgccttttcagcaagccttgcagatgattctgatgctcaccaaagtttgtgagccactgatgactacagaaatagaatatcaggctgaaacacacaaaaagagcaccatcggggaaaaataatatgaagaaaatactacatttttagtcctggtccctaatccttcaaagagttgttatgctttgtggaaactaatcaggtctagtctcccacctttcaaattatttctgttaaaatgttctcccctcctgcccagaattttctaatacacagtggaatgctttattgctctctttaagcatgtcaactagagcaggagaaaagtttcccatgtattttcttcaaagaaaaagatgtttaaagtttaatattaaaagaaagagtcatgaagtagtttaacatttttttcacagggcgcagagagttgcttctgcatggttatttttactaagtactttccaatttatactttatttttctcaagtataaaaatggatcttcctacttaaaaacaccaatgtccaacttcatggtcaaatgtaaactttggaaattattacttgatttctgttagtggaggaattagaagagtttttgttccactatgttattccaacctcatctcctcgtttgtcaagattcttaagctgaacgtttttctgcgtgcatgcatgcatgtgtgtgtgtgtgtgtgtgtgtgtgtgtgtgtgtggtcacagtgaaacatagattaaggctgagaagtaacaaccagctaattattataagtatagatataggccatggatattaaagtacccccattttgtgttgatacatgaaatcatagaaatttcatgtatcatagagattaatcacatagagattaatttagaccataaaaacatttcaattttcaggaatcccttattaaaataatttttgaaaaaacaggggtgaatattcatgaagccaccacgtcataaaggtttggttgatgaatagtgagagtaggggtgaatagaggtaaagcaggagacacattggcaaggtcagggctgcaagagacaggagagcatcgaaaccaaaccccaccttcccacactcctaaagactgtccagtgagtaattttcccatttatacaagagcctggtctatgaaggcaaataaaatggaaggatttaccctcactgggcattgaagcacaaaccttgcccaaggccctgtcccgagcaaaagagcttccctactgggaaagatcaagatcttaatatcccttaatataactcaaataatcattagccaacctgagagaagaggacaggctctgagtctgaggagaagggttggaagggtctggttagtgcctgaccttcctataatataaagctacttggagatattagagctagtgaatgccttctcccagccaaatccatgctccaggaatgggcacagagttgcaaactaaagatcaattgttcatcgtggtacatgtctttgtgaggtattatgggacaaacttcagttcatatgggaaaaccgaacccttcccacgtggtccgtgaaaacccagttgcacattttcagacaacttctttatgagtacagggcattaggaagttgaaccagcccggccaatttagaacaactggtctctttaacatgagcattccccgtcagtgctaccaaactcctttccatgtgtcccatgcaaccagaaaatgtgttgtttaaattcagctcgtgtcatttgtaaaaaaaaaaaaaaaaaaaaaaccataaaaaataaaaataaaaataaaaaaattaaatagtttgacaagataaatcagggactttggaataaagagttagtaatatgttgagtagtttgtcacatgatatcatttttaagctactcttttttgggggggcggggcacggagtcttgctctgtcgcccaggctggagtgcagtggcgcgatcttggctcactgcaagctctgcctcccgggttcacaccaatctcctgcctcagcctcctgagtagctggaagctactctttctaaataacttcaacaaatattactgatgtgataacaaggcttgatttcatcaagcagtaactctgtctccatgtggatagcggtcttttgaagccctcctcggctgttagagtgcataacccacagctctcaaactggtggagacaaggtggtatgtttgactaattcagtgacgttcggtaagcacctactatgtgcccagcaaggtgtcaaaaacagagcaaagaacaaaataggcaaagtgattgtatatatcactttttatcctaggtcaggataagcaagcagtacataaatttttaaaacaggtattttaggtagtgatacatgctataaaaattacatggatagagaatgaccaaagatgactagattgaatttaccacttctttgagtaggtggcagtggttcaagttggtgactgagttctaaacgatgggaaaaagacagccctgcagtggtatgtgggaagtgttctgggcagaaaacatgttctgaagctggaacaagcttggtactttaaagaaaagaggctgggcgcagtggctcacgcctgtagtcccagcactttgggaggctgaggagggcagatcatgaggtcaggagatcgagaccatcctggcaaacatggtgaaaccccacctctactaaaaatacaaaaattagctgagtgtggtggcacacgcctgtagtcccagctactcgggaggctgaggcaggagaatcgcttgaatccaggaggcagaggttgctttgagccaagatcacgccactgcactccagcttggtgacagagcgagactctgtctcagaaaaaaaaaaaaaaaaaaaaaaaaagcatgcttgtgtgactggagcctaataagcaagtgagagaatagaattggatgatttcagaggcagagacaaaatataaggaggtcctagctgggcacagtggtgtgcatcatagttccagcaactcaggaggctgagcaaggaggatcacttgagcccaggagtttgagtccagcctaggtaagatagaccccatctctttaaaaaaattttttaaattttcattaaaataaatataaggtctttacgtgctatgtattccatgaagtccagagctatgaatgccatagagtaggttctcagtaaacatatgagacaaaatatggctgagggtgaccttagatcaggctttctgaatcttacagaaaaatcttcttttgaatctcttttagctgaactttgaagagaaggataaagtagcatctgtttcaggtgccagggaagcccagaataaaaggctcaggatgacacagccgcatcaacatccagtgtttattggccatctgtcccctaggaatgtcttaagagctcatgctctatttacgagaacagccggggacagtgagaggaaggaagaaattgctttataaaaaagagtagctgcattcttttgtgtgtggaaagagcactattgtggaagcgacgaaacccaggtgtgtaaaaatagaaccgagtgttcacattaaactttccgtgcctcagtttccccacatgaaaagtggacataataacagcacttgagtgagaattaattgagataaaacctgtgttgaaatactgcttagaacatgggaagggtctgagctactatttattaataatgccattatcatagattttagctacatttattaataactccatgaatttagaatgttaatggaataaggattggagaagaaaaatttgctatggccagtgagaattccttgcaagaaaaaagcattgcaattgtgtgtgtgtgtgtgtgtgtgtgtgtgtgtgtgtgtgttggatatgggcagttgtagtgtggaacacctcagcagcacccaggcctcacttgtggatggtacaacctcaggaaacttactcttcctcagtataaatgagaaggtccccttttcccccaatggctgcagtgttggtctaggatgaggtcttctctaccctcatctgcgtagttccaggatggactttctcctcaaaatcacagtccaataaacaaaagtaatgaaaagggtctaacttccgtttgtatctcatgaggagcatcaaaaaccagttagttcctagcatagcacacagcactcttgaattctttcagccattcccagggccctcgcttctctaccctgcccctcccatccctgtcaggtcctgagctcctccttgctcctccctccttttttttttttggttttttttttttttttttttttgagacggagtctcactctgtcacccagacttgagtgcaatgtcacagtcttgggtcactgcaacctctgcctcctgggtttaagcaattctctgcctcagccttctgaatagctgggattacagacatatgccaccatgcctggctaatttttgtatttttagtagagacggggtttcaccatcttggccaggctggtcttgaactccttccctcatgatccactcgcctcagcctcccaaagtgctgggattacaggtgtgagacaccgcgcccggccacgctcctccctcttttgaagacttgttggactcttgtctttccttctccttcctctttccttttccttttgttctgtctaaactcctacagaacaaataaatcaatgaacgaaacacctaggtccttcccagtgtgaatcctttccattaccatccacaaaggtgaccaccattaaagctgtgtgtgaaggcttctagacattagtcctttattctgagtttaagcaaatacacacacatacagatgcatgtatgcatatgcgtgtatgtgcatattatatatgtggggtatatacacatatctttgtatcaggcacataaacaatgcacacatacttaataggtttgtgcaaaaaaactgcaattacttttgcaccaacctaatattactataataaaatggagctgtgatatacattttattctgaaaatagcttgtcccttaacaacatacaatggacaatttacatagatcgattttatggtttatgccacattatgtcacattttttgtccaaatgaatgcatgtttcttcaaatacatacagtaataaatgtatacattgtggttacttccattttttgctatttgaaactctttataaacatttatatacccaaaggattataaatcatgctgctataaagacacatgcacacgtatgtttatagcggcactattcacaacagcaaagacttggaaccaacctaaatgtccaacaatgatagactggattaagaaaatgtggcacatatacaccatggaatactatgcagtcataaaaaatgaagagttcatgtcctttgtagggacatggatgaaactggaaaccatcattctcagcaaactattgcaaggactaaaaaccaaacaccaccgcatgttctcactcataggtgggaattgaacaatgagaacacatggacacaggaaagggaacatcacacaccggggactgttgtggggtggggggaggggggagggatagcattaggagtaatacctaatgctaaatgacgagttcatgggtgcagcacaccagcatggcacatgtatacatatgtaactaacctgaacattgtacacatgtactctaaaacttgaagtattataataataaaattaaaaaacaaacaaacaaatcactcacaccatggaagcacaaaactaaaaagttcagtgtgtgtgtgtgtgtgtgtgtgtgtgtgtgtgtgtgtgtgtggtgttctacttgaggtagaaggtaaaagattaaggagaaaaccaagtggattgaaatctgcaataaagcgaccattctccagtactaaatgcacttgaaatttattcccctgcatctgtaggtaaatgtccttctgttcttgaaacaataaatccccataaacttcccataaagttctgcagaagtgaaatgtgagattggttcccttggaatccattcagtgctttgtttgtgcatcttccaatcttaattttagagcccttgttcttcgtccagagcccctagactgggaaaaggtcagaatgcaacatgtttcaaagctgctgtgctctgggtggctgtcagactgttggagagaattgctttcaaaacccagagtatgccaccatctactcagtttcagattagcgtaacccacagcaccatgctatggcaggggaagctataatctttgctttttgttatcatttaaattcacttttaaaaatattaagattctcaaacagccagattctgaacatgcagtcttccccattgctatcaattatgtctaaggcaaaaaaagaggaccaaaacttctattttttctaacttttattttaggttcaggggtacaggtgcaggtttgttatatagttaaactcgtgtgacggggggttgttgtacagattattttgtcacccaggtactaagcctaatacccaatagttattttttctgctcctctcccttcttccagcctccaccctcaagtaggcccctgggtctgttgtttccttctttgtgtccctgtgttctcatcatttaactcccacttataagtgagaacatgtggtatttgattttctgtgtcagtttgctggggatgatggccttcagccccatgcatgttccctcaaaagacatgatctcattcttttttatggctgcatagtattccatggtgtatatgtaccacattttctttatccagtctgctactgatggacatttaggttgattccatgtcattgctgttgtgaatagtcctgtgatgcacatttgtgtgcaggtgtctttataatacaaagatttctacgcctttggatatatacccagtaatgggattgctgggttgaatgcaaaacctcaattttacaacttgaaatattgaagcgggaaatgtaagtgaaatcccaaattggcatgccatactaaatgttattgtaataacttatttaatatttgattatccaagcacgtacttttgtaccacattctgctcaataaatgtagaaggaagtgccgccattttggattgcagcagtacctcttcgtgcagtgaaaatcttttatgttgtggcccagccagaccctcagtgcagtttgcatatagctttggggcctgtagtgctgtggtaaccattgttgaaccccaaatatccaagacaggtctcagtcaatttaggaagtttattttgccaaagttaaggttgcgggcccatgacacagcctcaggaggtcctgatgacatgtgcccaaggtggtcagggcatagcttggttttatacattttagggagacatgagacatcaatcaacatatgtaagatatacattggttctgtccagaaaggcaggacaactcgaaatggggagggggcttccaggtcataggtaggtaagagacaaatgcttgcattcttttgagtttctgattagcctttccaaaggaggcaaacaggtatgcgtttatctcagtgagcagaggagtgattttgagttgtgtctgtcctttgtccacaaggatattccttgtgagggaggtatgtagctttttttttttttttatcttagtagctatcgtttttaggaatacagtggaggcaggtttgccctaagcagtacccagcttgacttttccctttggcttagtaattttgggggtctcctttcacatcatccacgcagcagcaacttctggtgaacacactgttcattattccaggcaccacttatgcagtctgtctttccctgatacaaattctcagatttctttgaaattaaaactgttctaaatctgcatactggatattacttcattcacattatatttattttaattatgtaacacaaagttgtaaaacttctgttagtcttaatatagactcatatatgtcctgtgtcatcaatgtgaattccattttcaatcctcacctcaggatgattacgagcaaagcacagtgtgtctaagctccaatgcttcacactaaaaacagcaacaaaggccaccagttgcaaaacagaatcgttctcgctctcagatgtgttctttttatccttaaaatcagagcattcatttccgtttggatgcactatttatttttatatcagaaattattttcacttagcagttgaatggaatttgtttgcaggctttctttcaatagtatttccttcttcttgaggatatatgaattctaaggaaactgcagcacattttgtaaaaatccaaaccaattatctcacccctgcctacaaagaagtctttgttatttttctattattattaaaatatatcagcaagattttttggcctttatagttctttggtatttcaaaatgcttctgtatgatgttattgctttaaatcatcacaaaccctgtgaagaaagaattatttttctaatttacaaataaagaaactgaggtcttagaagactgaattcatttcctcgtctctctttctttgcactatgggttatcttgatgctttactgatcctgctctcccctgagacatgtggactctgttactgttttcagcaggaaaatcatggttctattaataggacatgtgaatctttttatttcctgtaatgaaaagagcacaaaaaggaaactttgatttgtgtaacgtaatcgtatggatcatatcaacccattaccctgggtatagagcagtttcccagtttcacatccgtcattctgctgaaatgggtggcttttttccacattttactcacctgatggatttgatataaaacctgtttttctatggatgtgaggctctggaggttttgtagtctatcaacacataaaggctgcctggcattacagcactcctgctctgcacagtggtggagtgtagctaaatgcagctcagtctttttacagctcagctatgaccatccttcattacaacagggcagatgataaaatggaaacttaatgctattagatcatgaattccaattatatgaagagagatggaggtaagagaaattagatgccaaaaggagatacaataaagacagaagtgacgttcacagggctggcagttctcagaaccattgtcacccatcattgtcagtaccacctgaggacccggtgaagatgactagcatatcagatatctgagaagggaaatgctgagtgtgtccaaacatccaaacaaataatgccaaacctagaaaagcttctgtccatatgggttaaatagctcttcaattctgaaactgtcaaaagtaggctttgcagatggtcatgtcaagcaatgataataactggtagtggaattcccatggttcaaatttattaaaaaaaacacactattttcatttattcaagaaacacatattgaatacctgtgtgtcaagctagatattacagttagaaatatatagaaagcacaatctctgctctctgaaatttgcagcctagcagaggagaggaacacatgaaagtaattataataacaagttagatgcaatgatagatacaagatatcctaggaggacagggaaatagtaccatgcccagtccggggatacgtcagaaagactgtctggaggaggtggcatctgaactgagtcttaaagaatgagtagaaatcaagtccaatgtggtatatgaactgagagagagaaggggaggatgttgtagaaaaagacaatccaaaaagaggaaacagtgcaaataaagctggaatccacacacaccattgtcatggtgggaacaatggtagctgcatgttgctgaaatatacattctgaggctaggagtagaaagagataaggctggcaaagcaggcctatgcttactatgccatgtcaccgagcttgcaatactatatattctgcaagctatttggaaccgttgggatttgatgcatgagagtgaaatggtcggttttgcattttattttattttttattttttttttttatttttttgtgatggagtcttgctctgttgcccaggctggagcgcaatggcacactcttggctcaccacaacctccacctcccaggttcaagtgattctcctgcctcatctcccaagtagctgggactacaggcacctgccaccacactcagctaatttttgtatttttagtagagacagggtttcaccatgttggccaggctcgtcttgaactcctgacctcaggtgatccacccacctcggcctcccaaagtgctgggattacaggcatgtgccaccatgcccggccttgttttgcattttagatggatttctctgttggctttatcaaggatgaatttgagatgagcagcagcaggaacagaaccaagttaggaggctgctgccacatccaggcaagagacaatgcagagccaaggcagcagaaggaatggagaggaggagacacagcacagactatttagaaggtgtggctatcaggccttggggattgactggatgctaaggaagggctcccaggttcctgccttgaatggcagagtgggaaaagctctaccttctgagatggagaatactgtggatatagttaatttggaagaaaaatgcttgctttcagatatttagagttagatctctactatgagtttaaggctaaaataggcatttcttactggacagctttaccttgatgatttatactgaagatctaacttatgcacaaatttgggaatcgttaacatatgattagtacttgaaatcatgaaatgggtgaaaattactcaggaaaagaaaaaaagcataaatattcatccctgggacacaggaacattttgaagttgtcattccccagagtcacccccacccccatggcacttcagtgtactgcacactttgagatatatatatatatatatatatatatacatatttttttttcctaataaatagagacgaggtctcactatgtcgcccaggctggtctcaaactcctgggctcaagcaatccaccggcttcagcctcccaaagtgctgggattatagacctgagccactatggccagcctgatagtctactccttaacctacaggaagcagacatcaatttgttttacaacctctacatgcaaaaaatactacatagtcttatttttactaaatcaaaactttgtttcttgctaaatcttcttcccctctttgccagggtgtaaaagattcagtcttgttattccccgctttctggaatcaatcacatagcaacctttagggcttacccaggacagaaattggagtgaggacaggaaggccacaagttcccatgacacacctagctattcacgtctccgcttctagttattaactttgagccccggtagacctaggattactcaggcataaataatagccccccaaatgaaaagtgggaaattgtagagccctaatgtggagagcctgaagagcttcataaaaaaatcttagacttgttcccaccctccaaacatgtgaaacacacaactgtttcaaacattttaaatgtaccgaaattacctcataagtaccctttatatttaaatgcactaataatgggattgacatgtaagaatttccatgactaggaacaagcccgttttaccacaagccccagaacctggctataggtcagctcacagcagtgcaggaagcacctcaactgctttcaccagcatattctttttctctgtgggaccccatccccattctagcccaaaggacccgaatcacagagacacacagggtgaaatatttatgttgttgactcctcccgcaaacttgtcctctgatcattttgtgttgcagccgtgaaacaggcttgctggacgggaagaaatgctgcagagagagtggctgactcaaacccatggacagcattttattaataacttgcagcccttcattctaagtgaagcttgcccaataaaatgaggcctagagctgaacaaagctcctcttacctaacctgaatgtacaaaaaaggtttaattaaggaagtaatttttttctcccgtaaggaaatcttgacaaatagactcaaatttgcatgcaaatgaagccatctggttgattgttgtccacagtccccagctcacaggaaacaatagaaggccctttgcataactcagagaatctgcaaatctctaacatttgggtcactaataattttcagagtaattagtctcttcagagctgctatttacattggaaggtgtttgccatttacagcagaagctatagatattcttctaggtgcagccccagtgtgagccatttggtgacctgaggaaatcactcaatctgggaggggaatgacaagaccattggccactggagccagcctggcagcgacactcctcaccaaactgcagcccagagtgccttcacgcagtcttctccatgcgagccaaacgcagactcttctagccaccatctcttcccccttcctaattccccatctcccctctggggagggaggagacagggcaggggcaggcacaccaggcagggcctctacttctcatcacctgtctctgctactctgcagttatctcccgtaaacatttgttcaaatgcaatcatgtccattgcttgggtaactctaccttcttagtcgtcaggtccctcctcctttcatcagatttttacttaatggctactctacaaagcgtaacacagggctggtgctcaaggatgatagctctgattcatgtgtcctgaatggaattaccaaaaaattaaaaaaaaaaaaatcagtggagatgaagagatagggagtacagagttttggaagctagtgagggagcagaggaaggaaagagatgacgaggacaaaagggcagacatgggtgaggttgagaggagtaaaccagctgaggaagtgaccgctgcaggcttagctgtcaatcctggggtttgctgctccccgtggttggaactggaggacataatgctctgtgaaataagccaggcaccgaaaacaaatactgcaagctctcatgcatgagtggaatctaaaacaacagactcagagaagcagagaggaagatggtgggtacagaggctggaaggtgcagggaatggggagatggtcaaagagtgcagttaggaggaacatgcttggttggttaagttgtattgcacagcttggtgaatgtagttagtaatagaatatgtatatttcacaattgctaaggatgaatttcaaatgttcttatcccccaaaatgttaagtatttgaggtgatggatatgttaagtaccttgatttaattatttcacttcatattcataaatcataacatcactttgtaccccatgaatttatacaattatacattgtcaatttatgatttctaaaaaagcattagtacctgtggtaaatcaggctcaggggaaaagcctcagggtttgtcgtcttactgttcacacattgaaggaaaagaggctcctcttccatctttccccattccttggccaagcccttgcacaggctgactgtaagtgaaattaaagaatatcagtgtagtagtaagtaatcacatttgttgatcttttgttttgtgcctagcactctgctaaatgtatttcatgggttatctcctgagattcttaccataccctataaaagaggttccactgttattctgttcctggaccaaatagggtcgagctgcttattctcaccacccaataagagatgcagatgaactgggaaagaagagaggtgttttgttttgttttgttttgttttgttttgttttgttttgttttgtttgagatggagtttcgctcttgttgcccaggctggagtacaatggtgcgatctcggctcaccgcaacctccgcttcccaggttcaagtgattctcctgcctcagcctcccaagtagctgggattacaggcatgcaccatcatgcctggctaactttgtatttttagtagagacagggtttctccatgttggtcaggctggtttcaaactcccgacctcaggtgatctgcccgccttggcctcccaaagtgctgggattacaggcgttgagattctatttctgtaactgggtacagggagaacacctggaaattatcgccagatcaactcaaacttacaaagttttccagagcttacataccttgtaagctatatgtctatgagtaagtgtgcatttatctaaagacataagtgactcacttcttttaatttataactaagatctgagtcctgaagaccttcctctggagcctcagtaaatttacttaatctaaatgggttcagatgctggactaatgacccttgtctcctgctaaatcatggaggtttggggagttccttcagacccccattaaacttgtttgtggaggcctggggagtttcttcagacccccaatgaaacttgtttaatcctaaacaggtcctgttaagaattccttcattatcttgccatgtttcaaggtccagaaaaggcctaggcaaactctcggtgggcttttgttacatcctaacctttgtataagggcactgcttctttcagcttttaatatttaacttaaccattcagtcagtgctgaaacagttgttatggaggcctgcattagtaagacctggtctgccacaattccactgtacacatgaggatttaggaaggccaaatgatctgcctcacgttgcccagtaggtggagatggtagagccagaatgggaacctggaggtcggcttcctcagcctgcacacggaaacagtgcagggaagcttcaccaggtgacagcccagagcagcccagggactcacttcctgtcatcactcccaccccccaccacctcatcctggtagtaccacccgcgccaatgcttctagggctcttgctggacccacaggtggactgtgacttcagtctgttacctccttctcttcattctccacgaaagaacttcagcacatcacaagttcagttacttcactactggcagtaaaggaaaatctgtaagtccaggctgttgacaggcaggtgggaagcaagctgtggagctccaagaggcccaggaaccggaggcaggcaagggccgggctcagagccggaggaatggcggaacgtctatgtgagggtcagtcacaccccagctccccgctatgaccctgccagtgactgtcctactctacccatgcaggaagtgggggttcacactccagacaccaggcaccaaaaaatgggggtaaagctccttaataaaaacagaggaaattgacttaataaggttgacccctctccttagccttcttcctgtcagcttcccaagcactgagcaacagacatatattcctcatgaggaaagtagcggattcttctctcaagatattgaacattcagtgaccaaaacaagtcacagatactgacattcggagtcccttcaatgggacaggggactctccatgtgatcatgaagcccaaacatcaaatccaccaccatcccagacacacacactccagattgcagtcagctgtctagtacttgactgttcggtataaacagacaggtgagagtcaccaactatgtaggataatgtcagagatgtcataaaagaagggacccccaaactcacaatccagggtaggggtgggtggcaggaggtctgggaagaaacagaggcgacagagaaagcagaagaaaacttttgataattaaattaatattctcagagagacaagagaagatattgagatattgcctccaaaaaaattagaatggggtgctatgaaaaaggggactatcagagaacgagaaataatacttggaaatttaaaatatgatagctgaaattaaaacacaatgacagtattgaaaataaagctgaggaaatttccaaagaagtagaacacaaaggaaaaagatcaaaatgtggaacaaaattagaaaaaaaaaaatctaaaataaataggtgtttgagaaaagggatcagagaaattattaaagtctcagacctcatatgggagaaaaatctatatcaaggcaatcatgaagttccaattaaaagagttaaagaaaagatcctgaaagtttccagaaaggaaaaaaatgtaggttgcatataaggcttcgtaaacagaaagcagttgctttcccggtagcagccctgacagcctgacaattttctttctggagtttctcaattaagtgcgaaagtagaataatgactcatcagaggaacatgggtttagaaagttaacctcgagtatctcttttctcaaggagctacctgagaatgtgtttcaggaaaatgagagtgtagacctaggaagtggatgtcatgagatcctgaaacttggggatgtaataccaaagtgtggcaaaaggaagtccctgcactaatggcagagggaggtcccaggacaagggctgtgcaggaaccctgagaagaccccgtccaggtgggaacagaggaaagagagccatagaagatgcctccaggggacaaaaacgtgactgcagatggcctgatgtgtgcaatgttggaaaatgtttgagaagagttttactgctgtgttagagaatctggagagaattcgtggcagatacatagaaaaataagcaaatgaaaaaaataattatggattttaaagaaactaaatacaagaaaatacaattgcaacaaacaaaaatataagaaaatacaattacatacaacaaaatgcaagaaaatacaatttaaagaaaatacaagtagattttattggttggcttttaaataatattacatagtcctaaaatatgaatactgtgctaaattttagtattattattattattattattattattatagtgtcttactgttgcccaggttgaaatgcagtgacatgatcacaattcactgcaacctcgaactcctgagcacaagggatcctcctgcttcagccacccaagtagctagaactacacagctattttttttcagagacaggatctcactgtgttgcccaggctggtcttgaactcctggcctcaagcaatcctcccacttcagcctccccagtcactgcaattacaggtgtgaggcaccatgccaagcttgaatttcaatataaccaaaaatctgtgatttagctatttggggagaatatagagaaaggggctggggaagcaggcttataaaagtgctaaattctcatcttatattcaggaaaatcagtagagaatatctaaaaggtataaatcaataagtagctccagaggtttttttttttaaaaaaaaatacagctgtttaattgaaagagttaaaagtgtgagaaggtgtctctaaggaattgggaaggggcgggaagcagggaactgctttttgctttagtcctagcaccactagacttttataactatgtacatgtaatactttgttagaaacaaaaattaggttgaaaatgaaatgctgtccatcagaaaatgtgctcagaaagcttgaagttggaatcctatactatcttagtctgttcttgcactgctgtaaaaaaatacctgagactgggtaatttataaagaaaagaggtttaattggttcacagttcccgcaggctgtacaggaagcatgatgctggcatctgctccgcttcttgggaggcctcaggaaacttacaatcatggcagaaggcaaaggggatgtacacataccccgtggatggagcaggagcaagagagagaagggaaggtgctgcacactttaaacaaccacatctcataagcactcaatcactatcacaaagacagcaccaagggcaatggtgctaaactattcatgagaaaccgcccccaggatccaatcacctcccaccaggccccacaacattgggggttacaattagacatgagatttgggtgggaacacagatttaaaccatatccaataccaaataatcactggtcggattcaagtaagtggctgctatgaaatttgtgtgaagatatgatagtgcattttctattgatgcttaattggggtttaaaatgatgtgatgatggagaccagcaagcctgctttgcaggctcagccccgctctcctgcactagctagaggtgcctccctggttcctcttgccacacgtgatgagccctggccttgcctaacatgcagtcacaaagcttctcatgtgattgactcacttccaagctgcagagccttcagtgtcatctcgatcattctgtaaagcttttgactccagccccgggctgggtctccagtccctctctacctgcctcattattctgttactgttgactgacccttccagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgacttccccgtgaatgagtctattcaagagatcaaattagattgaagttgcttagtgagcatagaattagaataaatggaattgtggtctatagagatatttcatcacacttgaataactgatggaactacttttctcctctctgcggatatttctgtctgaataaccagtgctgggcctcaaataaatactgacatgttttacttttagctttcctttttctagaatcattttagacaactgcccttctgttaatacatcaccacctcagaaaataagaaggtacttgattggattgaaattttaaaatgttaattgcattcgtatcctggggatacagcctaaagagacagaattgctttgcttaaggctgaagtctggctggggactttgatctctgcaggctctcgggtccttaaagggctctcacccaattaggatgagctgaatccttctggccctgggcctcatctttattccctcccagcttcaggactctctgatgagcgagagcgtagatttaggttttctcacagaggtgcacctgaacgcctcttgctgtgtagtaaggcagatgttgaggggggaggaaggcttacccttgataactagcaacttgagctttgcaaagcgcctttctgttcctgttaccagtagcctacactacatcatacaatattctcctccccaagaagaaagcaacctatttgcctattttctcctactgaaatctatgattttatactttgtttaaaaaaaaaatagcagccgagcatggtggctcatgcctgtaatcgcagcactttgggaggctgaggcaggtggatcacttgaggtcaggagttcgagaccagcctgaccaatatggtgaaaccccgtctctactaaaaatacaaaaattagcctggcatggtggtgtgtgcctgtaatcccagctactcaggaggctgagacaggagaatcgcttgcacctgggagggggaggttgcagtgagcctagatcgtgccactgcactccatcctgggccacagagcgagactctgtctaaaaaaaaaaaaaaagaagaagcttaagactgcactaagattaggaacacattaagaacagtttttaccctaatgaagatatttacaaacatattttgcactagttccctgtttatgtattacctgcgacagtaattaataggaatgccattggctgagacagcttcagagccctagatacctagggaagcaagccaaatcctcttcaatgtaaatactgaaacgaaactaagcttatcagcaatcagaaaccaccacctaacctctaactaaagactttccacattaaccaatcaaacggtttctttgtcttgcatccacaaacacatttctctctctccaaccccgcaccccagtagacaacttgaattctggtgctgcccaattcacgaatcactgaatgtccaaataaacatgttaagattttaatatgcctaagtttatcttttaacatgcctggggacttatctagatgttgctatattctagacatttctaaaaacaaaaacaaacagcattaattaaataagaccatattttaatatttcataatttaaaattatgacttaagcatggcagaaccaacacaaagtaacttttatttgaaaatagtagctcaatttaatattgcatatgtgtataatttgcataaaaggaaggaaaaatatcatttgtgtatgaatagaaactaatggagtgcacttagttgattcattgtgccttttggagaaaagatatagcaaataccgtgttttttaaaaagcatacatttggagtttagtatcagagctcaaggctttagtaactgctttaaatcacacccatatattttagtctttagctgtgacagtaagtgtactcagaaatgtgcacattaaaaaggaatttctcccctgaagatgaagttgagagccaactcttgatcccatattaaattcttagtccatctgtcctaatggagtctgagtaacgcagtttggtgtttttattgcatcctgcgagctgcttttctcctggaaacactggctgctctgtcaggcaatgagtggggagaggcagctggtacaatcacatcttctccaagagctcaaggacagaggctggctgagagccatttggtgggctcactgcctcatccccatactatacaacaatcccacaggccagagcctcacctgcagtccccaggaggaagtaggaagggaagagaaggcaactcacctctgagagtttggcgcaggagaggtgaggaaactgccctagcctagtctggtcacttctgcctcgttcccggctcctcacctcctccaggctccgtcagttgtattcctgaagcacctgcaccaggtgtctgggtggccgttgacacaggagtgagcactggctcttccaaggcagaggtggatgaaaagcaagagcaaactaccaaaaactttgttcttactttgtcatcctgaggtttatctcagatgctgcttgcaccagaccaaagctaccagtacatatgcaggagttcaaaacagcccccacccacccacagagtaaccccaggggcttctcccaattgttgtgtctattggcatttacttcttagagtcccataggactccttggtaggaaccccaactatatcaatctttattgttatataattataaaatattgtttatcataaatattataaaatattttattgtacaatttatagaaattctatattaatatttaattttatatagattgtatatattaatactttaaatatctttatatgtaaatgaatattatatagacacacatataacttttggaaagtcaaaaatatatttgtgaggatttggtccaatgttgttcaacagaatgagagaaaataatgactattgctaatggtacttattaaactcaagcaatgggtatctgttacatgactaggctgatcagggtgtgagttaacctgatttttttgttttcttcccacagggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtgtgagtataagttgcttgtcaactcatggggagccactttcgtcacctcagggtggtccgggtcctgattgtggaaggccttttgattcaaacgtggaaggtttcctttgttccaggagcaggactagaggtggacacacaagcctgagtttgggctccaacctcagtccctgtccttgggatgctctcagggaagcaggcacatccagattctcaagcaattagtcaagaagatgagagagaacacaccgccctgagaatgtgggagaggaatgtttatcttcagcttcatgtcttgtgtggctgttttccaaagagacagggtcaaaaataggtgaggggtgtgtgcattgacccgaggagcagggagtgaggaaaatcatgtcaaggtcaaggaagacaggaatgataactagtgacatccgtgtgagttcaggaggccacggagaccacaggactgggcaattccatgacacagagtctgcaggattcctacagaggacccacacctgcccaccctctgcaagtgagttctggatgtcatgtacttagccaaagatacagagacaataagaggcagagcaagagaggatgctgcttagctcagctcagctggccttggagcaaacatcctaagggggcgttcaggcttggggagctccgtcagtggaaggtgggggttagctgcacaagacttgagaagcgcaatgcttgccctacctggaccctttaaacatcagggccccaattcagctttaggaagttacaatcccctgacttccaggccagttgattatttgcaaatgttgaactccgttggctgtgagagtcagggagactccactggctgtgagagtcggggagatcaaccacaaggacgaggccaggctatgtcccctgtccctttacaaaacctcagccttacactcagcatatcaaaaagtctcccttccggccaggcacggtggctcacgcctgtaatcccaccactttgggaggctgatttgggtggatcacgaggtcaggagttcgagaccatcctggctaacacagtgaaaccccatctctactaaaaatacaaaaaaaaaaaaattagccaggtgtggtggcgggggcgcctgtagtcccagctacttgggaggctgaggcaggagaatggcgtaagtaaacccgggaggcggagcttgcagtgagcctagattgcgccactgcactcaagcctgggtgacagagcgagactccgtctcagaaaaaaaagtctccctttgccaagtctgtcccctttaaatgagtgcttatgttcctgggtctggtctgagaatgatcccaaatccatttcccatttctgctgaaatgctattggattcacagtagcattcttaggttcaattccacaccgtcaggtaaattgctcaatctctttgaatcctaattttctgatttataaaaaggaaatgttaatttgtgggattgtgatgagaatagaatttaaatactcataaggcatttattttggtatctagtagttattgtaattatcatcttctgaggatgcccatggcagatctgatctgagccaggtctgattgaaagggaggctaaggctatcctggtcctagaattaaaattaactaattaattaaaatcccccctttactgaattctggataagaataattgaaaggggattcttgcttccctcagttaaaattaactaactgaatcaaactattttctgacttctacataagttggatcaaattttagaaagattttatggccacaaaagaaaattgccagttctatatttgagtggttctgtaagtttctataaaagtgcttggattcccccatctttattttatgtcctcaagttttgtaaagccacgcctgggtaagaaggaacacatactagatagagggagagcaggtgtttctactcagccctcggggtcaaagaatttctctactttcttctacttttttctttttttttgagacagggtgtcactctgtcacccaggctggagtgcaatggtgcaatcatggttcactgcagcctcgaattcccaggctcaggtgatcctcccacctcagcctcccaagtagctgggactacaggtgcgtggcactgcacctggctaattgttgtggtttttgtcactgcgggatctcgccatgtcggccaggctggtctcaaacccctgggctcaggcagtgtgcctgccttgacctcccaaagtgctgggattacaggcatgagccactgcacccagccactaatttctaattatgaaaaatctttagagctgtcttcagagttttccaggtctttccacagtatgaaaaccatgtggcccatggttcacagtatgaattacagcctccttttgtcaaatacctttactttcactgtatcctttactctgggcaaaaacatgtgaaacgttcaagacccagattcgagcctctaatcttccctcagagccccctgtatctactaataaccagagagggtggaaagacattttcacgatccccaaaatgtcacatattagatgcccatcattatatgtcatctccatcagggttcaaaggagcctcatggagagggaggcagacttctgtatttaagaaaaactacaaagcaaaccaaaagtggtgctttcatgaagaacatggagaaaaaaatggccatgatggaggcttgttgctgtcgctgtctcatcaatcacactttttctttaatttttttttatttttttttatggtgtctcgctctgtcgcccaggctggagtgcagtggtgcaatctcagctcactgcaacctctgcctcccaggttcaagtgattctcctgcctcagcctcccgagtagctgggattacaggggcccgccaccgcgcctggctaatttttgtatttttagtagagacgggctttcaccatcttggccaggctggtctcgaactcctgacctcgtgatccacccgcgtcggcctcccaaagccctaggattacaggcgtgagccaccacgcctggccgctgatcatactttttcagtcagacacttcgccatcaggattcctgagacattgggtagagaattctctcaggcccacttccttgtgtgaggaatcactctgcaaacctaattgttttcacaacagtggcgggctaccagaggggcctcaggaaacgttgattctgaagttaaactctttagaactgtctctatgtttttcccatttagcttgttaggccttctgatctctttctgataggaattcacattttttttctctaagcgtgtctcagaggaatttggtcacagttcatgactacatattgctttccagaatgacagttctgttaattaattacattgtgcccttctgtcaagagtggaagattctcgactcagaaaacaatgagtcagtgtacactaagttaatgagataccatcagcatcttatgcacaagtagaaaaacacagagataaaattagggcaatctcactcattagcatgctttaatggtaacattttaaccctatacttcatgtatttactattcatatttattcattcatttaatgagtatttactgagtatctactatgtcccaggtacagtgctagtgctgaggtaatttagtcaaatcaagtgtgatttctttccctcaaagatctttctgtttgttttagaaagcaggcaagtaactcaggagttatgataataacaaaaatagctcagcttcattcagactttcaggcctcgttccaggcgttttacgtgaatcatctcacactcctaaccaccctgtgaagtgcatactagcattcacatctccattttacaaacgaggaaactgaggcacagggtgagcaagttgcctggccaaggtcatacagccaggaagtggcagagctggtgtttgaccccaaacattatgtgtctgtcccaaagtcattgctgctaaccttaaagcacactgcctcacagaacagatagcaagaaagaggccgggagcactgaggggaatttttaaacctgactggcttgacaaggagcgcctcccagggatggaatgctttaattaaattttgatggataagtagaagccagtaaggtgaagaagtgggggaagaacaggagccagggaaaaaaggaagtttcaggataacaccaaatgaacgaaggtgtcggagactgaaccgaaggacccaggaggggacaggtgcagtggggaggggcaggggccagcaatagcaaggtgggcacagatgagcacccaatgcactctgccagggggagcatctgactcaacatgaccctgaaggctatggagagccagggcgtaacttgatcaggtttgcattcaccagagaaaagactggaagccagacaaccagccatgggagcctctgttaagacagaggcagaatgcatagaaagagaggaagacagtgatgaagcattgtagatatgaaagatccttcaatgagccgagatcacaccactgcactccagcctgggtgacagagcacagagcaagaatacatctcaaaaaaaaaagaaaaaaaaagaaagatccttaacagatagattccacagacattcaacaaatactcgtgagggttaagtggacgggaagatcctagaatgaaaccagtgtttctagttttgatgttgtgtgagtggggcacctttcatgaaggagtctgacattcaagagcaaaatacaaactgcattctggatattttgagactgagtctctgtgggctataggaggatctaatcaagtggacacatctagaggatgctgaatggacaagtccagaacccaacagagaggtctcagaaactcagtttgggagtcatcatcacttagaggatcaggaaataagcattcagtaccctcagcatggatgagattgcccaaaacaaatgtgtagagagaggaagcaagatgtacaagaaagacaaccagctcacacctgtcatcccagtactttgggagtagcagtaggtcacacctgtcatcccagcactttaggaggctgaagggggagtatcacttgagcccaaaagtttaagaccagcctgggcaacatggtgaaaccctatctctacaaaactaaaaataaaacattagccaggcatggttggctgcacctgtagtcccttagcctcctgcccagaggctgaggcaggagaatccctcgagcccaagaatttgaggcagcagtgagctatgatcacacagctgtaccccctagcctgagtgacagagcgagacctcgaggaagggagagaaggaagggagacaaggaagggagagcaggaaggaaggaaggaaggaaggaaggaaggaaggaaggaaggaaggaaggaaaaagaaagagaaagagagaaacagagaaagaaagaaaagaaaaaggaagaaagaaagaaaagaaaaccacattcaaggaatagaaggaagaaaactagtttgcagaaaactaacagagaagtaggaagacagtggtacccagaaaccaaatgaaaaagacatttcaaaaaggaaaaaaagagggttagatattgctgagaggtccctaaaacaaggacataaagtgaccatcagatttaacatgtagaggtcacggtcaaaaagtcaggtatcactagggtgagtggaagtggatttggagatcaagagagggtggttttgttcattctagtttgaggatggtagagactttagcattcatatagttgaaggagaaaactatggtagagaagggggattggtaatacaggagataaagggactggctgaaggagcaaggtccccatggctgtgggcatgaggtagacccagcatcgcagcacctcacaggggtgagaggaagaggcggaagtaaagagaacagcgtaaaccgcccactaggaagtgcctttccaaatcagaatttgttgttgttgttgtgtgtggacgtttgtttgttagtatttttgagatggcaaagaaatattgttcaaaaaaaatttatggagcagatatcagaaaacccagactctaaacttttcttcatcactaacaaccatggatctgtccatgtattttttcagttacccctaagggattagcttgactgctctagatcctttttctgactgagagggccatcataaccagggtcccaacctcgggccaccacctcctgagcacctgccctactgctggtgctgggaggcgctggggaagctgaggtggaaacaggagaacccagcatccacctcctagtgaaggagacaaacacattagtgacagtgtggatacataatttcattgagagctttgcaagtgccaggccctgttctaaagcttttgtaggttattaacttttgtagtttacacagcaagttttatacacattttacagctaaggaaatgagagcatagagttgacactgccgaatccagatatggtgcatttaatcgttaaaataagtaaattacaatgataggcacaaagtattatgaacaatcggtggagaggtatgtgacctatcctgggaatgaaggggaagatgagggaatgcttcagttgggtcataaaaatcaggcaaaaaagttaaaggaatggggaaaagaattctaggaggaagaggcaatgcgaacaaaaacacaggaatggggagtgtgatgggcgtttgggaaactacaagcattttgtattgttagagtgtgaagtatgacacaggcagtgaagatttggggtcaagtctcagatctcattctaaatatatggtcatctaaatatttatctagtatttattgagtacctgctatgtgtgtacctaaaatgaacgtaagaagaagacatggccccatcccagaggcacacaccatctagtgggaaagactagtaatcttaatctctctctgtctctttctctctttctctctctctccctctctctctgtctctcttttaggttcaggggtacatgtgcaggtttgttatattggtaaattgcatgtcacggggatttgatgtacagattattttgtcacccaagtaataagcatagtacctgataggtagtttttccatcctctccctcctcccgccctccacgcttagtacacgtatccatgcgtactcaatgtttagcttccagttataggtgagaatatgcaatatttggttttctgttcctgtgttagtttgcttaggataatggtccccagcttcatctatgttgctgcaaaggacattatctcattcttatttatggctgtgtagtattccatgatgtatatgtaccacattttctttatttgagactagtaatctctgttattataaaactgtgtgtgtgtgtgtgtgtgtgtgtgtgtgtgtgtatatatatatagttttttttttttttggacagattctcactcactctgccagctgggctagagtgcagtggcacaatcttggctcactgcaacctctgcctcccgggttcaagtgattctcctgcctcagcctcccaagtagctgggatcacagacatgtgccactatgcctggctaattttttatatttttagtagagacagggtttcatcatgttggccaggctggtctcgaactcctgacctcaagtgatctgcctgcctccacctcccaaagaactgggattataggtataagctaccacctacagccagcctataaaataatattttggataggataatattagaggtacgaacaatatgctgtggttacttagatgaggcaatatttacttctgactggagaaggagaaaagtttccttgaagatgctaacattttaaaagagccacaaagtaaatggaaaaggaagtttcaggtttagaatgccaaaggaaaaaagcacagcatcatagatggcatgaacacatcaaaaaggtgtggctccgtcatacacccatgctgcgagggttacggaacattagttaccattatatctccagggtcaccacaatgcctggcatgtggtaggaactaaataagcatttgttgaatgaatgaaatgaatgaatgaggtgctagtctgaatggagagccccagaaaatctaggtggagaagcagatcaccacgactgaggtgctggcgatccaaatatagacaaggaataatatgtggaaaggtggaaggacaggtcacggttagtgaaattttggaactcacgatttcacaggaaagcagtttgggcggtaagaagaatgaaaattgaaatggaattttgtaggttgtatcaaaaggctgcggagaaagtcagggcactgggaggccagagtagtgttggttggtcacctatgtcactgttgaggtcatcaatggtgaagacaagaggtgaaatggacagggaatccatgacccaaactttactgtcctggggttcaaacagtgaccacaatatgaacggggagaggacgagtcacaggtggacgcgaagccgtttgaagactctggagccatagagtggaagaagtacggagaagggaagaataggccaactgttcgcctggccccaagatatgggccactcagaaaaggggttacaattctaagggttgtaagttagggtccccttagggtggactgcaatcagaggaaggaagtgtttgaaagtgtttaatgatacaacaaatagtgaccatagagtctatttttgtttaacaatttaaaagagattttagtctgggcacggtggctcatgcctataatcccagcactttgggaggccgaggtgggcagattgcttgaactcaggagttcgagaccagcatagccaacatggcgaaaccccatttctactaaaaatacaaaaattagctgggcgtggtggcacacccctgtgatcccagctactcgggaggctgaggaacaaggatcacttgaatccaggaggctgagattgtaccactgcactccagcccaggtgacagagcaagaccctatctcaaaataaataaataaataagattttagaggacatttgtgaaggggatttttggagggaaattttgaaggaaaagctcactgagtaggtaacattcaggaaaagcaaccagaaactgttgtaatactttaacataagcttccatgttgcccaagtttgagatttttaaggtatcaggataacttggagggaatatttgcatttagcagacatatctccacaaaaatgtgcaggcagcggcctaatgtcctactaatcttaggaaataatatgaggaaaaactttcatgttcaagatgcagccttatgcaatatacatgctcaagaaagtcagaagaaaatattctgcaatatacagaaactgatgagtcagaagaagtaaactaatggcaatttatcttccagtatttcaaaattggaacaactttttatttttaaatagtttcactcttgtagatgtgaagaatgtctaattccacttaactgggctgttgttctgttggggtgttatttaggatgttttaaaaaatattgtgttttttattagtacaaatcaggtgttagcacctggatttttcacacatatattatatttatttatttagaggcagggcctctctgtcgcccagcctggagtgcagtggtgcaatcttggctcaccataacctccaccttctagacttaagtgatcctctcacctcagcctcccgagtagctggtaccacaggtgcacgccaccacactcggttaatttttgtattttttgtggagacggggtttcgccatattgcccaggctgatcttgaaacctggactcaagcgatccacccgcctcagcctcccaaaatgctgggattacaatcgtcagccaccatgccgggcctctggatttttctttttaattatccaagccaacttgggttatcaacatggatttaggaagaattttagtgtttctactactttgcaagtctaattatggtttcaatttatattcaacatttggaatctgaaaagtgattctgacttggtcattactatacataagaaaaaaaactattctctccccaaaaataaaatttgaagacctgaatatttaataacaacacttgtgattaaaaagaaattctctaacttctcgatttaaacctttgatttgaattacagaccaaaaagaagtttggaagtgtaaactaaaatgaaatttgtgctatattaaagcttttcatataatagctttttgttcttaataaatattaaaagatatataaatagttggtaaatcaatttagattaaatttatccagatttctttgccaattacactgaagggacagttatttgaatgtacagtagaggtatcctagagttatgaagatggattttagaatagaatgtcttctggatataaaaatatttcaagttactttagagtttactggtccactcatgtcctgatctggaaatttccagagaagattgggaattcctcctaagctggccagacagagtgacatctctctacagattctagagttctgcctctctcccactacacttcagaggtggctttgaaagaccacccaggcctcctgaccagccctctcacgtggcagctcctatgggtgccacataaccgcagtctctccacatcgcctttcctccccatcgtggagggtaccttcctggtaccaggaaggatcttccatttgaagatacaactgccttcttggtaataattcctttgccttgggcccacatcctggattccaagtaaccaagggcaggctacttccagtcacacccaaagagatggcttgtccctcggctggggctcaacttctgctttggaaaccagctgaagtccaggacacaggctccccaagacctcactagagatctggtgtccttagactctccctattaaactccagcttatttacatagtcacgggcattttaggacaataaaaagaaagtaaacatcagaggcaggatttcctcaaagacattacattgtacatacatgacggtatgtcctgatttctttcatgcgatgctcgaaaataacctaagtaatccacatcgattactgcagagaagccagaagagtaactattcctggggatagctgatgtcaactaggagggggtgcaaaggaactttctgggtggtagaaatagtctttatcttaatgcaaggaatgattgcatatgtaaaaatgtatccagctgtgcattaagatatgcacattttaccgtgtataaattacagctgaatggaaaagtagaaaaagagaaaaactctgctctgagaaaatcttgaatgacaaaaaagttaataaatcactcaatttttcaactacacttagagagaccaggattctaagctgactgaccagagaccagtccttgaacctctccagactttatcatatccacttgtaaaacaagaaggttgaacaagatggtatttaaggtctcgtctaccatgaacaattcggcaaacctgccggagaccatcagccatccagtgtggcttaccacctcccaacctaagtgaactcacagccaagcagcaccttaacttttcatgccagggttctcagttctcctaaggatgatggggggagggatgtgccacaataaaacacatctgcttccagtaattccagtcagcatatatgctttcaccaaacgtagtcaggagatctcctaacattattgccacctaattgtaaatgctaactaaggagccatcagaatggcccacgatacctcaagctcaacatatcgaaactgaaatccatcattttcactcaaaagcccccttctgtgctcccacttagttaatgtcatggccatcttcttcattattcaaattagaaaactcaatgtcctatttaaagttttactaacctccccataggggatagactgttttatcttgatagaacactgcatttttaatataaagaaatgctattcttcctgtaagccatcataccagaacaatgccacagaaagcatcaattcctactagtcataaaaggcagctggaacatagatgtgaacataatgaaatcataccaaatgtctctacctcccaggatggctttgctagttgaaatccctggattctggattcagacaggctcataatttgactccctcactccagtccctctatcctgataaccaccctccctagtgaggccaaatttctacagatctggtccagttactcctttccttacagaccaccatgattccccctgtgccttataagacaaagtacaatcccaagcttggtaagtgatttacggcctaacttaattttcaagtttttttcccctactccatacaagctttgcccctcacccaccagcaccatgtgccacagcctcagctatgtccagctactgatattccctggacaccactacagtttcctaagactgactatgtgtctgcctgttccggaattgcttccccttcattgaaatcctgcccacacaaaattttttttatcattttgcatcttgatttataatataaaaaataagacagaagacttcatttccccaaaaataccaaaatttttacaagacaattcattaggtgcattgcctggaaagtagcaggaatcctcattagtcagcatcttcacatagcatttgtctgaatggagtagtttatcattactccaaagacatactgaagtttcattaaaattttttgatgtaatttttcttctatctcactctcttggattctaacgttttcttttctcttttcttcttcttttttttttttttttttttttttttgagacagagtctctctctgttgcccaggccagagtgcagtggtgcaatctcagcagctcaccacaacctccgcctcccgggttcaagcaattctcctgccttggcctcccgagtagctgggaccacaggctcacgccaccacgcctcgctaatttttgtatttttagtagagacaggttttcactgtgttggccaggatggtctcaaactcctgaccttgtgatctgcctgccttgacctaccaaagtgctgggattacaggcataagccaccacgccctgccaacactttccatattatttactctatgtggtagttcatgaaacctttcccttctaaaagatggcctgttaaagtgtcaaaaagaccaacaactagaattggcctgcctatgaccatctgtaagacaacagaccctctaagagaagaaatcaaagaagtttgaattcacacattctgagacagacggaagaaagatatgctattattgctggataatgaacacatggatttatgagaaaagcagaaatatatatgaaaaatttaaattataataaggttagagactttccatctgccattctaggagctaacagtatctccataggcttgatatttttataaaaacaagtgcttcaagaaaagagttaacagtcagtcagtgtgtgttgctaatgctggagaattgattcaactagggatgacacttgggaccaattaattcaaagctggctttaaaaaaaaaaagtagatacaataaatcagggagtagagcttcatttaaatatagtgagggactgggatagattacttgaaaaagctcagaaccaaagattgtctcaaaaggccaaagacaactataagtaaaacaagtgctaggtttctataagctatcaaacactgaaatcaaaaccatgaaagaaaatactggccaactggatgtcaactggaaaatttatacaaagtttgttaatttgtacttgtatcccctcaatctataaaaattttaaaacatgttttaaagcaacaagaaataaaaacagtttgttataaatgaaaattttcaggaagttatcgttctcaagatgcattttactgaaattacaagacaatttttaatagcaatcaagtaggaaccttgaggagaaatggggaaacgtaaagacttacatgaaatcttatacgggagtgtggtcacagtaaaaatatatcttctttaaaaagatgtttctatttcttttgtattgctgttttacctttaattttttaattttttttttttttttagtttaggtacttctcaatttttaaggggattgtgctctagaagtttctgatctagttgttcagaacctgaaatgtattttaatgtagacaccgcattgtatatagcactcacattccatagctaaccgtaaagagctctgctgttgctgtagttgagtgttgattcaaggtacacaggacaggctgagatctgggtcctggcttctggaggccatgagatgtagaatagaaatgttgaagaacaaaaagaattgtttcttgtatttctgaaggtcaagcttgagcatgacaaacttctccacagggaaagtttttatttgcctttttgatagtcaaatcacggtcctgcctctccttttgttgggagcctcattttggtgggttagtaaagggaacatctccaacattcataggagcatttgtttaaagggctcccacgtggcttccagccacttctctccactctgaaacttctatgaattagagaatccccctaattcattcaaatatattacggcctatatttttttaatattacaatgatctgacacagttgggtattgaaaatagagtaaaaccattacaccacaattatcccttcatccctgatgaacatcctcttgtccatttttttaatcatacgaataaatgaaaaaaatgtgataaggtcataagagagttaggaacattatgtaatcttctttaaaaataagataagctgctctacccagtaaaaccctaggtttctgcagccatatgacagtctgatatgcatgctatggtcggtcacggtggctcacgcctgtagtccagtactttggaaggccgaggcaggcagatagcctgaggccacgagatctagaccagcctggccaacacggtgaaaccctgcctctactaaaaatacaaaaattagctgggcatggtggcgtgcgcctgtaaccccaactactcaggaggctgaggcaggagaatcgcttgaacctgggaggtggaggttgcagtaagctgagatcgcgccactgcactccagcctgggtgacagaatgagaatctgtctcaaataaagtaataataataataatatgcatgctatgctctggtccatgaagaccttccacacagtgatttagaggttcagactccttttctctgtggctccaccatcgtctagagcccgggaagtctagctggcaaagagagaaagggaggatagagaagcattctctcttcttgaccacactgaaccagcgtgaacacattccttgccctcctccctttggtaagagctagtcacatgtctccacctggatgcacagggaccaggaaggcagttactggctgggtagcagctttgcgggagtgatgatgaaaaggggaaagaaaccttctgtgaatggttagtggtctcttttacaggtactatgacaccaaaaaggagtaaactttaaagacaccaaggtaagtttccaggagatgcagcatttgatttgcattgaaggatgacaggcaaaaatgagataagggcatttttctggagagaaaacagcataggcaaatgcaggtgggggaggaagaccgtgcaacatagaagcaattgaaaggaataaagccgaagcccaaggaccacttcaaagatacctctctctagagaaatgacccaccgcctatctgttaagagtttgacaaatgaaatctggctgaacctcaggccttgtcggaaattagtcattttgcttgcctttgcggatggtgttaaaatgatcaaatttggttttctgcatctctgagtttgattcctctgatgagaactgatgcgaatgccaactgactttttatgaagagtggttgatatttagtattctacagagtctttctgggtaagtgtaaccagagccagtgaataatagaagcagtgtatatctgtcaagtgtaattataacactgaattatgctcatcctgcattccggttcctgtatacattagtttaaacatcagaacatgctggcatttcagacctgtgaggattttactttgaaaaatagcatgcccttgtttttagccatttttaacaggaaaaaagaacttatatcttgttcaaaattattttatggtaaagtttgaccactctgttttttaaaaaaatcttctcaagtttctaaaaatagggaagaaatgaggaatatttcagtctagttttaaatgccctctaattttctgtatttaaataaaatcgtatacaataaaataatatcttattttgataaactgaactttctgattaaatagttgttaaagttacagaatagagttgcttataaagtcaccaatctttgccagagaaagtggaaattatcagattgtaactttaaaattatgcaagtattgtttatcgttgaatgatttaaaaattcagagcagcaaaaaggacaaaacaaaaattcagctataatcccatattccaatatatttaaattatcattttggtgtctatatttctaaacatttttctatgcatttatatatactttttttttacaaaaatgagatcatagggtacatactgttttgtaacctacttttttatgtaataatattttaagaacacattttcatgtcatttttcttaagactccataacaatatttttttttcaactgagaacaaggaccataccagaatctccaagagggcatgtgtagtttgaaaacttataattttatatttagaaagaaaacccaaaaatagctattgttttggtaatataacctacagaatataaagcatagaaatttccaattggctggtcggatgtttatctgggatcttctgaggtttgttatattaccattagcctcctacatggggcatgattagattactatgtcaacaaatgggagcacagattttgaaagattgtgaaatacagtgcctcaactgccaagcattccatttaacccacagtcccttgctgttgggcttaacttttgaaagataaatttccacacattctgatccactggcttctggttgctcattcccaatcataacatatgatagcatactatctattttaagtatgtgatatgcgattgctttttatcacatactcacatatcacagcctcaagctgcagggcagctcaaatgatgaaagtggaagacaggccgggtgcggtggctcatgcctgtaatcccagcactttgagaggccgaggcaggtggatcacctgaggtcaggagctccagaaaaacctggtcaacatggcaaaaccctgtctccactaaaaattgaaaaaatagctgggtgtggtggcaggtgcgtgtaatcccagctactcgggaggctgaggcaggagaatagtttgaacctgggagggggaggttgcagtgagccaagatagtgccactgcactccagcctgggtggctgagtgagaagaagagaagagagcagaggggaggggagggggggaagggagggatggggaaggaaggagggagggagggaggaaacaaggaaaccacactggaaggaggaaggaaggaaacaaaccacattgggaagagagggaggaaggaaggaaggaaggaaggaaggaaggaaggaaggaaggaagggagggagggagggagggagggagggaggggaagggaagggaggggaagggagagggagggggaggtggaaggaatggagggaacggagggaggaagggagggaagggagggagggaggaaggaaagaaggaaggaaagaaataaacaaacaaggaaaccacattgggaaatccaagcaaagatgggctcagcaggtcacatggtttggatatttgtccctccaaatttcatgttgaagtgtgactcccgatgttggaggtgggaacctagtggacagtatttgggtcatgggggcggatccttcatgaatggcttggtgctcttcccatggtaatgagttcatatgagatctggttgttttaaagagcttggcacctcctcctcctctctctcgcttcctctcttgccatgtgatgtgctgctgttccttcaccttccgtcatgagcataagcttctgaggccctctctagaagtcgatgccagcactatgctcatatagcctgcagagccaagagtcaaataaacctcttttctttataaattacccagccctaagtatttctttatagcaaggcaaaatggactagaacagctggatagtactgctaaccgatgaccctatccccaaagctgtttccattcattctctttgttgagagtatgtcaaaccatcccaggatggaggctggagatgagtttaaccccacctgcaactgttctctcgatggagctactctacagaaaaatcatgttccattagttcactaaatcgtaacaaaagtaaatgtacttgtttgaacattgtacaaactagtcctaaaagggttctcacgtattttatatgcgcagtctttagggaggcaaaaatgttttatgcaatctatacaagaaagttatattttcagctgttatccaaaacaaaggaagcgtactctgtgaaaaattggtattattgtttaacaatatccatttccagaggaatgcttttcttaagtagaagttggctgacacaaccataagggatgctgtgaagtgatttctgtcatttttcatacatggaaacatatgaactcaagggtctactaactcttctacaactttaaaggagcacttatcctgggatactttcaaacctgagattctgagattctatatttttaatgttcaacccttagtttcctcatttctaatattcattactaagtagacgataaagatcaagttaagcatagcttcagaaaaactaataaaataatttaaattggttatgcatctcttgtgacgattctaaggcaaaaggcacttttatagaagtctttcacactttaagaaagcttgctatatagaaaatgattcagttgggcacagtggctcacgcctgtaatcccagcactttgggaggctgaggcgggtggatcacctgagttcaggagttcgagaccagcctggccaacatggcaaaaccccatctctactaaaaatacaaaagaattagccagatgtggtggcgcgtgcctgcggtcccagccactcgggaggttgaggcaggagaataatttaaacctgggaggtggaggttgcagtgagctgagatcacaccattgcactccagcctgggcaacagagcaaaagtctatctcagaaaaaaaaggaaggaaggaaggaaggaaggaaggaaggaaggaaggaaggaaggaaggaaggaaggaaggaaggttctcctttcctctctaatgtctctccattcccatttaaagtctctgttgatctgcagcataattttacttttttctccactatttgtccaatactgcaaatgcactgtagttgaagagaatctgttgttgtaatggaaaacagaatcaatctctttttatactctgagcctatagcatgtagtatatatgtcctcatttggcactttttaattttcattacagagatcttctctgaagtcatatcaaggtgacactgaaaggatttgatagaaaggaaacaatttgtggcaaaacagagagagaaaaatactacctgtgatacaacctatcggcagagtcacaagtcagtccacagaaaccagaaaacagacgtccccttggctgctttccttctgatagacttatctaaagctctcactagcaagcatgctccttccaaagccatagcctttcatcctcagagttcatctttggcttttcctcattatcagtgtccctatcaagatagccatgcatagcacagttatttagaaggcacaattaattgacttgtatgctgtctccttgtaagcttcagcttggtctgtgttgaaacttgtcagcttttcccccaattcatgttgtttcaacctgcagttttattacctcctttggatgccaaattctcctttctccttgcactctccaaagccatgtattttgatgaactggctctctctgacatcacctcaaaccaacttaataaatcacccctagtcttctaccaaagcacatttccttaaatgagttttctcattttgccgcacaacctgaatatggtcggaagaaacacttctttgaagtccatcccctcctcaatctgctctcctcttcatctctaggggatccttaggtatgagtttcagagtttctctaaagcagcttctgggtttccctttattacaacactctatccccagagtaaccatctgggacctttatctattcttccaaaatgggtactgtctgcccaatgaacagctgtgctctttccaaacaagagggtatttaaaacccaactgcaagtcctacatggggtacaggggattgttgccagccacatatcattttggaactatttttgccttctttctttttaaatcatataggcctattaatattcaaggagttattctcaaaaggtggttaaatgcatagaaaaactaaaattagaagagctttgcattttaaagacagctttctgtttttgtatggccaatggtatctcccttttgcttccttttctctgtggatgtctttgtttgtgaagttattttttaaccataataaaaagcttaaaggccaaaatacataaagagaaatacttcttatactcaagaggttatcgagataccagagattttaaaatgagttcgtaacattgattcctaagctccaggcatttccttgaagaatttccagaagacttcaaataaatttttcttgccaatgttcattttcagatgtgtttaacaccaagttttctggtgtgaatatgcatatatgactctaaaaatctctacattcagaaactaaaactatactaaaagaaaaataggtcattttttatttccttcataatatgacaggcaatacagtagttaggaaaactaaagctctatatctagtcattactggattttagtgtctctcagcctcagtttcctgactaatcagtgagggtgggctcaggggtcgaagtctattcactgaagcttttaggtcttaacattattggattcaatcacatacttcttttttttgagacagagtctcacactgttgcctggtctggagtgcagtggcgtgatctcggctcactgcaacctctggctcactgcaacctccgcctcctgggtcaagtgattctcctgcctcagcctcccgagtagctgggattacaggcaccctctatcatgcccagctaattttttgtatttctagtagagatggggtttcactatgttggccaggctggtctcaaactcctgacctcataagccacccgcctcggcctcccaaagtgctgggattacaggcatgagccatcgtgctcagcctcaatcacatacttctaagctgatgtgattgtttctgtttttgtggagttacaaccagttgcaaatttagagagaccacattccccataagactgcatatgcttctgacaccaattgcaagttcagaagttccccaaaccacccccaggtttgatagttctgtagaaggactcacagaattcactgaattctgctgccgaaggctgctatactcatgctgcattatgggtgaagaatgcacgtgaaaatcagacaggggtagaagcacagatggcagagtccaggaacagtaccagatgctgagtttacagtcaacctctctatatagattcaggagcacatttctttcctggaacgggtgtgtaacaatttgcatggggtattgccaatgagggaagcttcctgagcctccatgttcagagtctttactgagactccgttatataggaatgattgattgcccacatggctgacctcagtttccagcccctcagaaggctggagaatataagccaaagccccacacccttcatcacattgttggtcaatctggcatggtaaggccccatcttttttctttttctttttttttttttttttgagacagagtttcgctcttgttgcccaggctggagtgtgcaatggcaccatctcggctcaccacaacctccacctcccaggttcatgtgattctcttgcctcagcctcccaagtagccagattacaggcatctgccaccacgcccagctaattttgtatttttaatagggatggcatttctccatgttggtcaggctggtctcgaactcctgacctcaggtgatccacccgcctcagcatcccaaagtgctgggattacaggcatgagccaccacacccagcccaggccccatcttaaatgccatctggtgtggccctacccctaaaacacaatgttagactatctggaataacccaaggctcccaggcaaatgaagacatgcttaccaggcaggacatcccaagggcttagatattaccttcccaaagccaaaggcaagggccagacctcttgagggcaaggctaaattctctattacacagttctgaaaatctctctgttgaggacaagaaagcaaagattcctaggacttactactagaaggaaacctgaaactcctaatgtttcttaaagtaagattccaggaccacttgcgtcagaatcacctggcattaacaaaatgcagactccaaagccccaccccaaacctactgaatcagattctctgtaacagaagcattggaatatgcattttaagcattttcctttagcagttttttatgtaggccaaaacttgagaattgtaattaagatccaaggtccctgttcctacaagtagagtgaaactagcatgcaataaagcaaagggagaaaattctgcttcttattccactggtgagtttatcttgggcaagccattagtcctcaaacatcatatgtttgaaaataacgtttagctacatttgttttaaacagacataactaatgtagcatgctcttagactgagaaaatattcattgagttactttgtgctcttgggaaagatgcttgtggaatacaagatggaactccatctagttcggctggccttgggaaaatgagtggatttctcttttcagagtatccatgtgatcactgttgccttcctaggcaggagtagtttctattcatcctttcattcattcacaaattggtatctactgtgtggcaggcaatgttctcagtgctgaggagagaacaatgaacaaaacagaaaatgcctctgccttcctgaggccaggaccacatatatattattccagatagtgatacatgctatgcagactttttaaaaatcaggattaaaggggaaaggacagctgagagcgaagtttgttatttaacatagaatgtttagggatggagtttctaatatgatgacttgtgagcagagaagtaaacgctcagccacagagttatttgggtaaagtgaacagcaagttctaaggccctggggcaggagcagtttcaaatgttgtgaaggagaaagtcctatgtggtggaattagaggaagactaagaggagtggaaatagatatggggagtacagacatctctttcaaggaatttggaaacaaaagggtgcatagaaatgaaatggtaacttttgggatagataaggtcaaaagaaaggttttatagtgccagtggttgttaagagtagagatatgtctctgtgtgtgtgtgtgtgtgtgtgtgtgtgtgtgtgtgtgtgtttgtataacaacccagttgtagagggaggggagaattgtcagagtggtgtccttgagctggtaggaaggatggcatcccgtgtataggtgcagcagttggccttgaattaggaacatagatgaactctttacttctttctccttatctctctgattcccatggcgaccttattttcagccttcctgcctcttctcatgaccctttcgtgttaaataaatccttttatcttctgatgtacagttagtacttcattcagaaaaaaaatacaggaaacaaaaaaagatattgataacactgttcaccatagagtgaggctgaaatatctgttctaccaattaccagttttgttgtatgactcaaatgagatttattgtacagaagatcccccaggaagctgccacccctcgaaccttattttagaatggaaaaaacgtatcattaccaaaactaaacagtgttagctggtctgcccatcatgctcatgctatataactttccttctcttttctcttatcctgttctgtactgaatggccaaattttttctgctacttcaactgaaactgtggtctaatatctaaatgctccctcacctgctgagaaaacttagagccaaaaacacctggtattggtcagttgttaaatttatcgctcaatatactaagcttggagtgatttgttgagttagaatgagagcaaatagtgccacctgctggaattacacttggaaggggaagcgtgaacatgccaagagctctccatggttttgtcccaatcattactttaagcctttcagatgaagtcatgagcctgctttattagaaagtaatttcttccacctatattcttttctgatggcaatatgccaccttatgtatttctcttttagtatttctcttttctccctgtaatgattcagtatctaaaattaccattaagaccagctgtatttcattttatttctcttagaatctcttgaaaaattatagaatgttgccatttgaaagaaccttagaggttctccgtagtttcaaacacattttggacacaggaacttttgggaaactatggatataatcctcactttggacctcaaactgaggcctgaagcgtgaaaagtgaaaagaccaaacagctgaggctctatatcagttaagatgctttcagttacaataaaaatggcttgagcaataacataacagcatatctcacataagaaatcctaaggtagatggctctgggattaatttaaaagttgagtagaccaggtgtggtggctcatgcctgtaatcctagcacactgggagtctgagatgggtggatagcttgagcccacgatttcgagatgagcctgggcaacatggcaaaaccccatctctacaaaaaatacaaaaattatctaggtgtggtggtgtactcctgtagtctcagctacttgagaggctgaggtgggagaatcatctgagcccaggaggtcaaggctgcagtcagctatgatcacactgccacactgcagcctgggtgacagaacaagaccctgtctcaaaaaatacaaataaagaatttttaaaagttgaacaatgtcagccatgacccaggctcatcctctgtcctctctgtcctctgtatctctgacatttgtgaggcagctccagcaacattaagaaccacagcttcccacccaatattaaggggcagaaaagggactgtcttttccttataactcaccaaaagactccactcatgtttcattggctagaagggaattatgtgtctcatccaaagtgggtagctggcaaggagcctggaattgccatctttgccttcattaaatccagatccatcctgtgggccttgggtagggctgtccttatgcaaagtgcaagactctggaaacacagagattccagggcaaaatccggttagctcacaaagaaaaaagggaaagtgactaattattgggagaaaaatctccatgggtctcttccacttttgcctgccttctgagcaagaagcattgacagctttgtttataccttttttaaggatgtgtgtatagctaacagccttggaagatacagatagtgtcttcctctgggacagagggtagatttatttcatggccagagtaagaaatataatgtcactctccggggcagaaattgagcaagtttgctagtagctactgtaaaaagattggggtttcctaagtccagggtccctcagctgtgaagcaaacttattgcatgtgcagcatccacctgggatgccctgcattcccctgcaagggaaagcaatgtgaacgggaagctcaggctgcctgctgtgttgtgagtaaagaagtcctttgtctctgacccaggagtttcatgtcttctgccagcatcatcagactgtggccatgttaaactatggttctgccagcatcatcaaaccatggctaacttgttagcctgcaagtggggtaaagtctcagacccttcccagttcttgatactcatggaaaggcaaccattcatgtttggcacagtgttctttccaatgagccaggctatatgcatccaattctcaaatacttatttctggaaatgagaatttgttcggtatataagaaattcctttttcacaggcagaaacagggcaacacttcagtctccaactggagacacacattaagcgaggacagtgtcattggctcaagtgtcttttatgctgtctcccttttattcgctcactctctctataattatctcttttaaaatgtcagttgctctcacccagaagaccaagagcaatcagccacaaactgaacttagaagcttttaaaacacactggctgtctgactgggggatgggatttctcaaaggcttcccgcagcaatgtcagggaagctgacattgagtggctgagaaaaaagagccctttccttggctctcacagtgggtctttcagatccttcctgaggaagcaacggaaggggtgtggaatgtgctgacttcataaatatttctccagcagagcctgaatggaggctgtttgggaagaaagttgctcgtggggtcctttggccttgagtccctcttactgtatcccattagggtgagaggctctgagctacggcatcgtcctggcaactttcttcccttctccagaataaaatattgatgttaaggtgacggtgaagaaataggggatctattgggacaagcaaaaagtatagatattttctagcgacttctggcactcagagtttttccaagtagtgacagtttgaagacctggacacgaattcatcatagcagtaggagaatcacagaggaaattagaacagcatttatccctacgagtcaaaccttagggttaaactcaatttatccctaaattctatttccttgatggcagttgatgcctttaaaatgaaacaatctttcctacttagcccaggaaccctcgttctcttgctgttctgacaacttacatttaaaaaatgctcctgctaaaatacagtgttatgagaacagaacagatttaatctgaaaccaaggctactttttcctcatctgctgtatcagaactacagagaaagatcacacagcctgtgggtcatattatcatcttcctgcattctgatcatacttccatggaaaccttgatggaggtcactggcctgcaagttcaatccagtcccaatgacccctggaggcaggggcttctaatttagatgagatatttttctgaagtgtgtgtccaatgaccacaggtgttgaaatgaaagttctctcgctaacgacatgaaggatcaaaattccttggtacaattaggttgattaaattgagctctgtgtctaatatccctgtagctcaataaagttaatgcagctttccaaggggcccaacacagaggcagggaacagtctaggtcctgagagaatctggcccaccatggtttctaaattagaagtttgattgcttgtgacatcgtcttaaaatggtaccagccaaaagaagctgaattttccattagcccaggaaaaaaaaatgacagatatttaattaaactgcttagagattaggtggaaagcttattgatggacagaggggctgaatatctttataagcaaagttaggcactggtgtgccacatctttaatgttgagaagaattcacccagcctaagggagctgaagacgtgtgtgctgcttcagcctgaggctgcctctcctgtcaatcacaagaaaaaatatacatttaaaaagcttgtttataaagcactaggtggtcactgaggaacttaacataaaatataaaatgtgaaattagaaagctacttatagctaaagttaataaagcaaccacccaatccatttgccaattgttgagaggtgactaattgcagaggaaggttgatttggaggtgatctctaaaaaaaagaatttgtggtcagtgctagagggtaggttatgagaaggagcctacaacccagatggggaataaccaaggtttgcaacagacgatgtacgacagggattattctccagaaatgttgtgctacctttcaggtaggcacaggtggtcataaaatgtaggtcaccctcattacaccaacaataggtcaccctcattacaccaacaataggttaccctcattacaccaacaataggtcaccgtcattacaccaacaataggttaccctcattacaccaacaattcaagggtccccaactttcaaaagagtataaagatcaatgaaatcaagtttcataaattcccccaaagcagtagctctcaactctagctatgtgttaacatttcctggggagtttttttaaaataccagtgccaactcttgaccaactgagtccaaatctctggacacaggtgtttcaagagatctccaggtgactatgaatcacttcccaaggagctacttactgaaaaggtaaattgtatgtggaattagaagatatcaggctctgaaatctgacaaaccttggttcagttcgtgactccactaacttactgaatctaagacactcaacatgcgctaacttctccagacttcagtctccttatctggagagggtcaatgatggtcacatcttggaaggcttctaaaattaaataaggaaataaatatatacctgacacatagaccccccaaaacacccttggttattaatggttaatgattgacattttatccttcttccattgattttgccatcgacctttgtaggacgtgacaggcttagatgatttttcctctccctgctttgtttgtcgtctagaatttactgctatttggtatctgggagaaaaatactcatgtttttcatgctttctgctcctccagctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtaagtaatggaaaggtaaccatggcttccctctgttgatttttaagagcctgcacaatacaaaaaaaaaaaaaaatcagcctatgcaaggtttgatatagagatccttccaaaagtaaaggtgttggcctcttgtagtctccttcaagacagaatggaataaggaagaagtttcaggagacctagatctcgttccacttccactcttgggagctcactgtcctcagctataaaatcagagtgcaggctgagacatctctcaggtctctctaatatctgcaattttaggtttatggttttagaagtgtataaagttatttgatcatttggggcacttgtaactgtgtggaaggaaaggaaggaaggaaggaaggaagggagagagggagggagggagggaggaaatgggctaagttcagatttttttgaaatgataaatataaagccattcctttcttgcctattctcaaggttctaggcagagaaagatttagacttttcctgacataggaaaaaagatcagtacaaaaaagaaatttaaacagatcaaaaagttaaactacctatgcaagaagtggatccagacacccagtctaatctttttcacctgtctttctgctactgacatatttcagatgaacctaaaattacttcaaattcatacctgcttcccatggctagttgaattttaaattttgtttttgagaatattcatatgttaggaaattagcaacttttcctctgttgaatgaaataaagaagtgagtttgaaggactttgtggatgcatcatcttagacccctctctagggggtcaattgatcagtgcagtcaactgtggaagtctcagacaaagcaagataagaatgtgacttggttgctgttcatattcataacacctgccacttgggctccaccctacgttacagcctcactgagagccagttaattttaacaaggggcagagtccccacagtgtctttcatagttgtgttgggaagcttgaagagcggtagaatgtcattaaaggaaaggtaaaattagatctccattcattttgtgtgatgtcggccaactacaaaacaaaggtgtgggtcaatgagctttgaaagtgagactgacttttaacaaccacatcagctggggctataaaagagttatagatttagaaataaagtatttcctaattacaactggaaatcagccctttccaaatccttccctcaagttatagatcacaaaattacacattattttttaattagctaaatatcaggtccattgatccctgctgagcacagtgaagaaatttcacttcatcaacatgtgtggcccagattagctaggacaagtttcttcctaaatactgttaattctgaacatgctgggtagattctatctggttttcatcataacaggtgaccctacttgactcaacttctcgtttttttgaccctgcccctggatatagaagtccaactttagttttgttcctttctgttggctaactgtggctgtgtgtaagaattttgaagacctagtaaggttgtaaaatgaagagatggaagagtatttattatggtcttggaaggaacatcaattcacttaaagaaggtgacccaataataacttaagaaaagagcaagggcctgagatcagaattctacagaaccatggaatataagggataaacagaaaaagaatatctcaggaagaatgaagaggaatagaaataaggaaaattaggagagagtaatgtcacaagaggaggaggatttgattaaaaaggtaatggcaaataatatcaagcaccatgagtaaaataaggctagaaatgtgcgtgtgtgtgtgttttgagatggagtctcatcctgtggccaggctggagtgcaatggtgtgttctcaactcacgactcactgcaacctccacctcctgggttcaggtgattctcctgcctcagcctcctgagcagctgggactacaggtgcatgccagtatgcccagcaaatttttgtatttttagtagagaaggggtttcaccatgttggccaggctggtctcaaactcctgacctcaggtgatccacccacctcagcctcccaaaatgctgggattacaggcatgagccaccactcctggcctgtgttgttttaatttagcaattgtaaaaccattgatgaccgcagaaacagaaatttcagaacaggaggctgacgtgatgagtcagcaatttcttttgactagaaaatagtctctagtcccagtttctaattcctgtcaccttaaagggaggcacaaggcacatctctcagatatgagctactttagccaatttgtgaaatattgttcggcaatagaagtctacctcaggtgaagtgagaggggttgttacaaaaaaaaaaaaaaaaaaaaaaaaaaaaggacggccacggtggctcacgcctataatcccagcaatttgggaggccgaggcaggcggatcatgagttcaggagttcaagaccatcctggccaacatagtgaaaccctgtctctatttaaaaatacaaaaattagggctgggcgcagtggctcacgcccgtaatcccagcactttgggaggctgaggcaggcggatcacgaggtcaggagatcctgaccatcctggctaacacggtgaaaccccatctctactaaaaatacaaaaaattagccaggcatggtggtgggtgcctgtagtcccagctactcaggaggctgaggcaggagaatggtgtgaacccgggaggcagagcttgcagtgagccgagatcgcgccactgtactccagcgtgggagatagagtgagactctgtctcagaaaaaaaaaacaagactctaaaactaacacctagttcaacagctatgaatttctggagccacttatctccaaactattcagttagaatttagggacttaggtgttagtctcagttcacctctaatataaaagcattttcttgaccaactattaccatcttccctctctgagtatcttctatttctatgttttgtttgtttgtttgtttgttttacatggagtcttgttctgttgcccaggctggagtacagtggcatgatcgtggcttactgcagcctcaacctcccaggctcaagggatcctcccacctcagtccccaagtcgctgggactataggctcatgccaccatgcctggcatgaggtctccctatgttgcccaggctgatctcaaactcctgggatcaagtgatccttccacctcagcctcccaaagggccggaattacaggcatgagccaccatgcctggcctcttccaatattagacattttttattacatgcttggtaatgattgaacaataccagggttgccaagtggtcagtcttctcacaatggtgtgtggttaacaatatggtctttgactaccacctctgcctcttgccaattgagaaaccactgacaaattgcttaatatttctgtgttaattaggaatacagctcctacaccacagtattaaatgagatattccatgctaagcactcaggagagtgcctcgcctagggcccataattattatcattattattaataatagtagtagtagtagtatttgagacagggtctttctctgtcatccaggctggagtaaagtggcgtgatctcagctcactgcaacctctgcctcccaggttcaagtgattctcctctctcggcctcctgtgtagctgggattacaggcatgtgccaccgtgactggctaattttgtacagaaagggtttcaccatgttggccaggctggtctcagacccctgacctcaagtgatctgcccgcctcagcctctcaaagtgctgggattacaggcatgagccactatgcccagcaggtccattctcattaaatgtgagtttctttttcctttactatcctttaccttttattccctttattttcttcttcctccatgtaatagttacccttctcttaaagaagcctctttcaatgggctcattacttctttcttgaaatattgacttgaaatgtgatcacttccactcaccaaccctacaggaaagctcacatgcagagatgtccctcaatattcagaattattctgctagtcctcagcttacctgcagaggccacagagcagcaaactaaggcccaaggattttttcacagtcagccaagaaatcagaagttcatctgaaaacatcacaccagcatccctgcaacagctaagatatgtgacagaatggcccaagagctccacctaggttccggaaggaagggctttcatacaaattaaagctgaaacagactgcaaatagttcttggctttgcacacagagctctacagaaggccaccttccacccactaacctgtgttaatgtaattgcctgaagggtttttcttgcccgctacacaggtaaaccaaattcactgagacaatgttattgcagtaaataaagcgtttaattaacacaaggacagccaagcagaaggactggagttattactcaaatcagcctctctgaggactcagaggctagggtttttaaggacaatttggtgggcagggggctagggaatgggtgttgctgattggttggagatggaatcataggggtgtggaaaattgtcctcatgtgctgagtctgcctcagggtgacagccacagaactggttgagttctgcgtcccaagtctggatggaggcaggtggtttccagaatgcaaaaatctgaaaaaaaaatctcaaaagaccaatcttaagttctacaatagtgatgttatctataaaagcaactgaggaagccacaaatcttgtgacctccggccacatgactcctgagcattaagggattctagaaactacacctacattttaacagagttcaggcctctcccataattctaatctcatggcctttcattggttttacaaaggcagtttcaatcttccagccaggagggaaccagttttaaggagggacaattatcatccttgctttaaagctaaactctagctgggcacggcggctcacgcctgtaatcccagcactttgggaggccgagatggggggatcacgaagtcaggagatcgagaccatcctggctagcacggtgaaaccccgtctctactaaaaatacaaaaaaattagccaggtgtagtggcaggcgcctgtagtcccagctactcgggaggctgaggcagaagaatggcatgaacccgggaggcggagcttgcagtgagccgagatcgcgccactgcactccagcctgggtgactgagcaagactccgtctcaaaaaaaaaaaaaaaaaaaaaaaaaaagctaaactctaaaccaaatacctcccatggttagtttagcctgacctatgcccaggaaggagcagggacagccaggctgtgaggctagaagcaggacggagtcagccatgctagacttttcttgctgtgtgatctttgcaaaggtggtgtcattagcgaggccaggctcacatgtccttttgcaaagtaaccgaaaaaaaaaaaaacagagaagacacagttcacctcactgcacatctaaaatataattagaagctgtcatcccaaaagggttaacacaggtcttttggaagttgtaagaatccagagattattctggtttaatcaaaaagtaacaaatacatttaaaaactaagagacacagaaagaaaaaaagcacttgctggtatttgtctgaaaagtgcaggaaacttttcccattttttgatccaaaatgagtgtccagcatatgacgagctccctggatggcccagcagaagcacttaagccacatgttgatctgaagcctcagccagcccaggtgttcggacctgggctgtccgtgggccagatttttcttaggcggtggagaaagcaaacaagctcatggtcattgtctaagcatgaacaatgccaggctggattgagcaaagccagctttggcagagacatacaaggagtttggagccctgacagctgatagcagcggcaggagtgggagaaggcaagatatctgctgggcccccagcctgggaggctggctgccagcccagggcatggccaggagctggcaagcaaacaccactgcggggagccaagcaggctgttcaggtcagggagctaggacagggttagcatgcagcaagctagacactagccagagcatgcaactgctcttggcagtcattaagggaggagatcagagttacaagatctggaggccatttcagacagcttcaggaagaagtcaagctcctaagtggctccttgacagaggctaggtcatcttaactcatgacaaatgtccgtgctcaatttacttggctctggcctcttctgatatctctctagaggttaaagggaaccatctcttttgtgcagtccaaaaaggagttgaaaaatcaccctcagtgcttcaagctcttttgcgttgggcagaaagcctgactgagactcagtggaaggcacgctgtcttcaggaggactcagagactacctgagagtggggaagcccgcagcctcttcttcctctgacagtttgtctatcaggagacttttttctcctgggtggcaacctgagtttatggaagagttgaggtttattaaatggacgtataagcaactacagactgaaatgttataaccattctctgagtccaacctccccaaattctaaaatacagcttgtttggtcagctgcttctcatactctctgtattccaaaattgcaaatggatcattccagtgccatctgaaatgcagtatcattgagagaccaaagagaaaatcgcatttgtgtgtgaaggagaaaaatagaattctaataatgaaattcacccaaatctatgtatgaataaaatggctgtttctcatatctaagaaattgataataaaagatgtacaactcaggccgggcatggtggctcacgcctgtaatttcagcactttggaatgctaaggcgggcagatcatctgaggtcaggagttcgagaccagtctgaccaacatggtgaatttctgtctttactaaagatacaaaaattactcaggcatgctggtgggtgcctgtaatcccagctacttgggaagctgaggcaggagaatagcttgaacccagtgggcagaggtcacagtgagccaagattgtgccactacactccagcctgggtgacagagtgagaccacatctcaaaaaaaaaaaaaatgtacatctcaaattgcaggaattataacctagagaatgtgtgcctgcccctgtttcctgcaaacctgcctcaaaagcaaccacgtgaatgctgactgagacaccccggtgaaccccagggccaagtgcttcccatgcttcccctcaatgagtccacacgagtctataacatagataacattgctaattcttgttttattctcacattaaagattagttgacttaccgaaggtcgtgcatttaggaagagacagagatgggatttggttccagacagtctgactccaaagactcagcgctttaatcattcctcttgtcaaagcaaaaattgcactgggcaaagttgaacaggcaaggaagatcttcattcagggctgttgcgacagggtagagaagccagaatgcagtcgagctcgcctccacttcagctaagggcaggagaattttgtttctttattttgattttttggttttttttatttcactaaaatacaatgggaaagtttttacaagctgggataggagggatcatagggtgtctgtgtttgctgattggctctacccaaaggaaaagtaaactttcacaacttggagttaggctcccaccctcccgtggaggggagacagggtgctattttccttgacaattaccatttcaaagagatgactcccaagtttttgaaaaagccattcctgggttgtaaaactggcaaacagctttttaaaaaatttatatctcaaaagggcagagaaagaattaacaataacaaattttctaaagtaagtgctcttaaaaagtgaggtcaggggtctagggtggaatggaggggtcctatgtaaagtttagtcaagctgaaggcaaagttcaggccctcttggtcagtctataccagcgtcccctgactgagatgaccctgtggcccagagggtatgtggaaaggtgcggtgacactgggtgctcccacagcttcccacaacgtgcaggagaatccatcccaaggaagatttgcaggccccacgtgcaataccggccccttgtggagcactctcccagttatggagtctatgggagagactgaagttgacaggcagtggtgaggctggacatcaggcagccctggctggtattatgcagattataaagtcgccatggcaaagatctaggcctgcagagggccactgtcaaacgcaaagggtttggtttaacgagaagttaatgcaaaagcactcttctcagggaatgagacttcttacttgacagtctctatgacatggaaataatgttttgtttttgttttgttttgttttgagttcctttggtaaagcttttataaagtcgtcaaagtcagcatggatctctaagtctcagacacattcttcggggctttgcagactctctcagcagcatgtctcctgcgctctttcctgaaatactttcttcccacagattccacagccgtgtgctgtcctgcttatttttcctaccaagctggccatcacttagtctctcctgcattccctccttcctccgcttgaccactaagcattgcagtgtcacagagccttcctgtcttctcatccgaatattgtcttggatgatctcattcagcccaccatccaatggcttctgataataatttgtgccaatgtctctcaaatttaaatctccaggcctctcttctctcaggaactctagatccacttatcctactttctactttgtgtttcaacttagatattaaatgggcatcttagaataaacatgatgggaaacaactcttgatgcctcctggaaatttgttcctccaaaagccctccccatctcagtaggtggcatcaccatctaatccacccatccaccctaaatttggagttacccttgatttccttcttccctttctttcttctctttccctcatcacttcctatccaatagtaagccctgtgagtctacctccagactgtccctcaaatgcagctgaggcaggagaatagggtctggaggcagggaagataggcagattcatgctgacttcttggaactaaatcaaatgggaacgcttcagcaatgacaggaaggtgaacggctgtgtagcttcacttcatcctctccatttacttatgccacacactgagtaacatccttgccatttacatagggtgcatactgagtaaatgactttgtcacttgacttcgtcttcttcatttacatagggcatataccaagtaaccaatgggaaacctctagagggtgttgaaaccccagaaaattattattattcagaaataaatgaatacgtttatttatgtgtcctccccctagaacgtaagctacatacagcatagacggaggatagggtccaataacaactggtcaatggttacccaataaatatttgctgagcaaacatctggatgaataaataagtgattgtgatttttctgggttaatatccatattcaaaattagatcatctcctttccaaagcaagaagggtttttccttataaactttctccagaattcttttctcaaaatgtgatgatatttaccatcttgggaaatatctttttactgggaaccacagactgaaatcaagcatgacagaagcagaagcagcaaaaaaaaaaaaaaagtcacagagaaagtcagcatattatggaagacagcatttcaaatcagtctagagcctgagcatagttttcagtcttcctgatatcaaattggggtcttgcctgtttggcggtagctgtgatgctggctgcaatcctaatgcagagtttctaccccaacctttgtaactagttcttggttctctctgggatagaaatagggagtgatgtcgtaattagaaaccattgccatacattaaagagtaaattaatttgctggacaaaatctagcaaaaaaaattactacattgaaatcaatcgaccatatgcaaagcaaaaatgcaaataaaatatagaagctcctccaagaaatgccttctccttcacagttgttcactacaagggttaccagccctctattcttttctgaacctgctgggccaccacgctcagtcggctgctatcttctcaatagaaccatctccacctacgacccccacaaagggcaaaggatagccccttcccacttacagttgccatgtatgttttctgccctttgccctttagggatcaaaactaattgacttttgcaattccagctacctttcagtcagagcattaccataggaagtgagtgatgataggtacaatgtttgcgctttttttttttttttttttgagacagagtctccctctgttaccaggctgaagtgcagtggcacaatctcggctcactgcaacctccgcctcccgggttcaagcaattctcctgccttggcctcccaggtagctgggactacaggcacacgtcaccacacccagctaatttttgtatttttagtagagataggatttcaccatgttggccaggatggcctcgatctctcgagctcatgatccgctggcctcagcttcccaaggtgctaggattagaggcatgagccaccaagcctggacaatttttgctttttttaaaatgtgctcccaaataatcaaatcaacagtgtacttttaatgtcttttgagctcccaactaactaaaagataatctgttaactatattatatgggtagaaactttacggtgaacattctgaacctaagaaactaaaggttcaccttctcatgtgtcacaagaccaaatgcttcaggaactctggtctttcttccaacatcctcatggcaattggaatggtctgatgcagagaagacattttaatgtaacggtaccacttttgcaatcaatatggaaaaatgtttttcaacaaataaataatttcttatacagattttttatctttccgataaggactgaactaaacttcatgataataaatggcaactgtcccacagaaaaagattgtaataaaataaattagtatcaatgacacaaatattgaagaagggatagatcctcgcagccccatagttcctcccacagtacactatgagcgtgagaaaaaagaggcccacttttagtattccgcattcagataaacagggtcgtttcccatcagacgcttccctctcatgtttttatctcacagtttggtttctgctccttcgtgttttcaaggccccctgatgtgcaggatattgcgtgggtctctcttcctttcatggtcctattgtcacatcctgacaatgttcctctttcattttaatttcattttattacgttttttcttcaccattgccagcttcaccctctcgccatcgccgacacccactgaaacgtattttatggatggtcttctagtcccaccctctatatatttgttcaaagtatacatatcattgtggaaattcgtgttgtctcttgtgtgccatgctttatatgggtggcattgtactacagatcccattctgtttcttactctcttccctctgccttacattgttaagatctatttgagtagttctctgaatactatgtgcatagtgctccattatgtgtatttaccacgcatcatttattctatcccctaatgatgaatacctaggttttctgcaactctgccaccacgaataaccctccagggaatatatttatgtgcattctctgccacctgtgtgaggacgtcttgtgtgtgtgtgtgcctctgtgtgtccccagaattactgagtcatagagtatgtgtgtacctaatttcactaagcactgcttgacctatcagtttctgagtataaattttaaactttatttactgaatttctatcaatagttctatcagtggtagcttcgggtaattgaagtctattttgctagttagatgtgttcatgatcttcttgatttattgttccttgtaccagtatataatttccatctttgttccttatgacatttttttttaaatctcacagttttgtctctgctcttaaaactaccacactgctgggcgcggtggctcacgcctgtaatcccagcactttggaaggctgaggtaggcaaatctcttgtgcccaggagttcaggaccagcccgggcaacatggtgaaaccccatctctaccaaaaaatacaaaaattggctggatgtggtggcacacacctgtaatatcagctacttgggaagctgaggtgagaggatcgcctgagcccaggaggtctaggctgcagtgagccgtaattgtgtcactgcattccagcctgggtaacagagtaagaccctgtctcaaaagaaagagaaaatgactacactagccaggcataatgatgtgcgcctatagtctcagctaccctggagctgaggcagaaggatggcttgaacccaggaggtcatagctgcagtgagccgtgatcacactactgtactacagcctggggacagagcgagaccctaactctaaaaaaaaaaaaaagaaaaaagataataaatgaacaaactactatgctagccttcttgttgttgctaatattcctgttataacctggtattttttgtacaggtgtttgtatccttttgtttaaatgttcctcttagatttcatattgctgaaccttttaaaaatccatttggaccaattactcctataattttgacttggcagtgaaaataaagatgcaatattttttccatctatgttctcaagacttgtgactcctgtacatggatcggaaggatccctggggctgggggtctctggttcagatccacagctattgatgaaggtgttgttttttggttttggtggtggttgttgttgtttttcttacctaccctgtttaaacacttcatgagtgccttccatttgaactctaatattgtttgttctggaaataccagatatttcttcagatagtttcttgcctgtgtttattcttttcttatgaagctactattgtgcagatgttgacacttctaccctccgtaattcttgacttttgttttattcttctaatctctttattcattcctattgtcttcatggaaggtttcttgacccaatatcccaacccacgaaaatgttcatcagctttatccgttctgccattcagcccctccaaggatatctttattttgacagttatagatttttcacttcaatatctccaactaattcttattcttatagtttgtcattgtcctgtgtctccaatatcaggaaggtgggattctgctaattttgctgccgcttcatgtcggcaccataacgcaggtgtcttttatgcaaatcctacagttttctgctgtcattggttctgtgtcttcagcgctgcttcttgcccttatttcgcagtgcttgctgtcctcagaggtcctgtcatttcgccttctgagttcaagcatattcccttgagatttccaaatgccacctttgttattgtcttcctacaatgaaaaacaaaagttcagggcctgcattgagctcctcctggaaagttgagggggcaaagaaaaactcctgcctcaggacaaacctctggcattgtcatccctctcaaccctttcttgtttccagtccatgtccctcacccacctcccatacacacacacaacttcagagtacctcactcccacctagacaggggacagccatcttccactgtcattgattcttaaaccagtggtgtatctataccactaaatctagcctctcactacccgttcctccactaataagcatcttattgctatattgaagtgtctgtctcaaaaataaccaaatccaatagcctgttactgttgtctgattttccttgacttcttgctcttatttaacaattgtcactgtgccctccttgaaatcttgacatcaaaacactccagtcttctgttttctcagcctctctgccaactcgcctcccttttcccttttcctcaatccccaagcttctcttctttttcctccacccctttgcttggatggctgacatacccatgaggcttggtcatcagagctacactaatccctcacggatccatcccaggcttgacctgggactagcatccgcaaaggcttgtatgtgaagtctgagagtgaagagaacagggtgccagcttggataataacaccagggattcttgactccggatttaaaaaaagactagatacaaatgtttaaatagagactttaaaagacagatggaagcaggagagggggagggggagatacatgaagatcagcagaaagaggatgcttattttacttcaaagatgacaaaactcaccagcaggacacttaatatgaacaataacctaaagatatttgcaaaaatgtatttagacaagagttctaggctgatatatttgacatctgggtttattaaagtttactaaaatagctgttaataattttgaaatttggatccaactagaaaatatccccactttcagatgcaacttggaactgtaggtcccacagtaaagcaatggcttctgaaatcagtgctgtcagactgagcttagggaaagtatccatcatccaccattttagcagtggccaaagcccataactgccttggtttcaaaactgtagtactgagcttttgcactaagaaataaatatgatcttaatgacagcatcaaaaaagtgtcttctctttgttggcttagagattaatttggacattgacattcctggctctgtgagtattgcatttcccctttcagcttcagccatccttgtagctttagagacaatggtctgcccaggtgcaggggctcacacctgtgatcctaacacttttggaggccaaggcaggaggagcccttccatccagtagttcaagatcagcctgagcaacatagcaagaccttgtctctacaaaaaaaaatttttttaattaaccaggcatggtgacatgtgcctgtaaccccagctactcaggaggctgagacaggaggattgcttgagctcaggaggtcaaggctgcagtgaaccatgattgcgtcactgcactcggcctgagccaaagagcaaaactgtgccaaaaaaaataaataaatataagacaatgttctggcaggtggtaaatgtcttgcctcaggtattaatcactctatcagcattttgtatacctaagtacaacaatgtctagaagcatatcagacgtaggagaagaaagtgccttatatgatgtaagcccaaaaatcaaacggtggccagagcatagtaagagtgcaggcttaaaagctatccagcctgggtgtgagttctggctacttactggctatatgacagcaaatgaattaactctcttattctcagttcactcgtctgtaaaatggagataataatatctagctctgagagtaaagttctggaatagtgcctgatacttctagtatttaattaatattagcttttgaaataaccaatagtttaccatgcttatcctgccaccatagcctctacaatgaatcagaccacttagctccacccccattgcataacatttcacatttggacacataggagtgctttatactatggaaacccagtgtcccttcagtctctattttgaagctttcttctagtttaatagtttggattcacatgttctgcatgtcctttactctgaggacacaagaaaatccatgcaataataatgaactgaaaaaaatccatcctattgatggagttatgaatgagcactcatgagtgtcatctgaaaaagcaattttccaaaccccagttctctcagtatgtgaaagcttttttcatacttgccctccaatatctagctgacagagaaactactgatcaatacttgtcaatcatgcagctctgcactaaagaatatggagcaatttcctttaactctctacaccactgaagactcttggccattctgctgttctcagttcaaccagataactgggtttatattttacacacctgcactgacaccacaggtattttgttttgttttgttttgtttttttgagacacagtcttgttctgttgcccaggctggagtgccgtggcacaatctcggctcactgtagcctctgcctcccaggttcaagtgattctcctgccacagcctcccaacaagctgggattacaggtgggcaccaccacacctggctaatttttgtatttttagtagaaatggggtttcaccatgttggccaggctggtctcgaactcctgacctcagtgatctgtctgcctgcctcggcctcccaaagtgctgggattgtaggcataagccaccacacccagcccaccacaggtttttttttaacgggttcaagttgatgcttcagacctaagaaacaatggtagcatatagaacaggagaaatagcaggtacagaattgcaacttgggaaggcccagcctgcccaaacacatagctgcttttgccccctgacctagccagggcagctgtggctgccatgccagagagccaaggtcagggtgggtcacctagacacagaggagtcctagctctttttcccaccagtcactcacaccattccagtggcgggctcaagacctctatgctaattcacagctctccagtccagacacagccctccacgaatgataagatagcaacgacacccatcctaactctgtgctttcttttctctctctttttttttttttttttttttttttttgagacggagtttcactctgtcacccaggctggagtgcaggggcacagtcttggctcattgcaagctccacctcctgggttcaagtcattctcctgcctcagcctcctgagtagctgggactacaggcagatgccaccacatctggctaatttttgtatttttttattttttattttttattttttttttagtacagacagggtttcaccatgttggccaggctggtctcaaactcctgacctcaggtgatccacctgcctcggtctcccaaactggtgggattacaggcatgagccaccatacctggctctaactctgtactttccatggaaacagtgcagtgagaagagggaccccaaggtcactttctcagggaggtctagatcagcccgagcctgataacccttcctcattgtcttggtctgcttgggctgccctaacagaataccatagtctggtggcttaaacaataaacattctcacagttctaaaagctggaagtccaagatcagtgtgtccgtagggttgctttcttctgaggcttctcttcttggttttcagactgctgtcttcttgccgtgtcttcacttgatcttttctctgtgcaagagcatccccagtgtctgtccctcttcttacaagaacaccagttctattggattaggtctcacctttatggcctcatttaatgttaagtacttctttaaaggtcccatcttcaaatgcagtcacattggaggttagggattcaacagacaaattttgaggggacacagttcagtccatagcactcctgatacctctagtatcagatttatatacacatcatctcagccatatttaatttattccaactatgtgcttctatagaatgtgcctatactcaataatagcaataatcgtaacagctaccagtaactagaattagtgcaaagaagtgcattatctgttattaacacactcctacgcggtgcatattgttatgccaatgccacacataaggagactgaggcccaaataggacctgggaagctcacatgccatgagcggcgaagccaacacatagaagtagatctttgtgaccacagttcatgctttcttcatccctgcttgctgcctcccatacatcaaattgtgcctggcatcatcgtgcagctatttgtgatcaccttgggattaacctgcaggcaagaagcacgtcctcatcatcattttacaaatggctttcctgacgcctttcactcatgaactgatcatgcaacagctttgctcttctgagcatcctgcaaccgctctcatctcatgcctccttcccttccaacaggcctcccctacttgcaggatggtacccccttacctttttcctgaagccctctctccatggacgagctcatgatcccctttctgtcacttcctcagtggggcctatcctaaccaccctacttgaaattgcagcctcccccaccccactccaactctggatcccagctaaccctgcttgacttttttctccatagtggctaccaccttctaacacacagtatattttattttcttattgagtttgttgttaaatttctctttctgcctgcaagaatataagctctacaagaacagagacttttgtgtgttttgcttcaatactatgaagcagacaaacaaaacatctaaaacaaggcctggctcatagtaggcgtgaaataaatattttttgaatgaataaattagattttatgtgtgtgggctttagtgtgattccttctatggtgaattagtggccagtctctttgggcaaaagtactcaggaacccaacttagctctttattaagttctgaatttgaggacagtgtttttttttttataattcctcttgatcattgtttttgccctttttgtttaatttaatagccgattattttgtcccagtcttctgtgcattttacagttgtattattcattatgggtagttccagcattttcataattaatctttaattgcaatacttgcaaagcatttcacaagaaaaaatgatttacaaattaaacccacatctcaccttggataattatcacaggtctgactaatgtgcgtgaagcccttgcatggcagggggctctctacaatgacaatgtgttgattttctaattaacaaaggttaagtagcgtttttgcttgaagacctataatttaaacttatgacgtttgtcaccaagaaagatttctacagagcgcagaagtggaactcaaataattttcactgattctagtgcattaatgtcttttacataatatataatgaccgttttcaggacagaagatttttcttcatattgactagatcaggaaaagtaccttctagctcactgtcccatttaaataaatcagggactacctaagcaagaaaagagcctaatttatttagttttcctttatagagcgagaaatggcatttcactcacctgctttataaattatgaagagggaggacaaaactttttatttatttatttatttagagacagagtttctttcttttttgcccaggctggagtgcaatggcatgatctcggctcactgcaacctctgcctcccaggttcatgccattcttctgcctcagcctcccaagcagctgggattacaggtgcatgccaccacgcctggctaattttgtattttcagtagagaagggatttcaccatgctggccaggctggtctcaaactcctgacctcagatgatctgcccgccttggcctcccaaagtgctgggattacaggagtgagcaaaactttacttaatgaacacaacaaatacaaactagactacagtcatatgttacacccagttaaaagagggagaaaaaaaaaagtcagacatcggtgcaaagaaagaaaaagcaagcaaggaagagatttaatagaatttgagagtgtttactgaaattcagaaaaaaagacacaggcccagagggagagcctgtgaaccgtgagccagagtaattcagagctggaaggagtcacagacaccatctagttcagcctcctttatctgtggatggggaaaccgacgctgagagagactatgtaatttgatgaaagccacacaactgagtagaaatagttgatgatcctgagaaggaaagatccacaaacacaagtgcaggaagagagatggatccatgtagaacctaagaagtccaaagacccaagaatcaagacagaagcagagggagaaaactccgccccactaaatcctttctgaaatgaaccctgtatatataaataattaagtatccatgaatagatctaaatatctgccttaatgatataataaaaatatgatttactctagatttatttgctctgccaattgaccctttgaaaaatatctccattctcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaagccaaatgtccaacaatgatagactggattaagaaaatgtggcacatatacaccatggaatactacgcagccataaaaaatgatgatttcctgtcctttctagggacatggatgaagctggaaaccatcattctcagcaaactgttgcaaggacgaaaaaccaaacaccgcatgttctcactcataggtgggaattgaacaatgagaacacatggacacaggaaggggaacatcacacaccggggcctgttgtggggtggggggaggggggagggatagcattaggagatatacctaatgttaaatgacaagttaatgggtgcagcacaccaacaaggcacatgtatacatatgtaactaacctgcacgttgtgcacatgtaccctaaaacttaaagtataatttaaaaaaagaaaaatatctccattcttcatcatgttaacattcagagtcttttcaaactctcaatcattgctgaagatccatgaaataccaattgtttccaaattaaaatacatcccagatagacaaaaggttaacatgtggagagaagcaaaatcacaaacatgttagaagaaaatatggttgaataatcatattattttgtattgtagaaggtctttataagcctctgaccaaaggcaggaatcacacaaataagacaggtggatgtgactacaaaaacatgcaaaactttcatcgggaaaaagaaacaccatagagaagtcaaaagacacaaactggaaagatacagctgcaataaagagttatttataaccaagagttaaagctcatattgttattaatcaataagaaatatattctcttgtattcccagcaaaaagcgaagaacacaaagaaacaaaaaataagaaaagggaaaacattaaaattactcagctcacagtatttgaggtgatgcagatttaaacagtgaatcctttttgcccccgtcgagcagactggcatgaatacaaaaaggcactgaccaatattagaattgtgtggagaagatgaaaatctcataccctactggtgaattagaagttggtaaattcttcttagaagaaaacatatttaaagtgcctttaaaatgtatatgcccttcatcctagcaattagacttaaaagtatgattaactaattttaaagaatgaattctaaggaaaaactggacgacaagtgtgcaaaggttttcataaagattatattattatagtatcatataaaatggaaaattttaaaaacttaaaagtccactggtggtgcaagagcgaaataagtgatagtgcattcacagaataggatgctatgcagatactaagcaagatgttctcgttgtacatttattgcttggaaaatgttgcaaaggctgggcacggtggctcacacctgtaatcccagcactttgggaggccaaggcaggcagatcacgaggtcaggagttcgagaccagcctggttaacatggtgaaaccccatctctactaaaaatacaaaaattagctgggtgtggtggcgtgtgcctgtagtcccagctactggggaggctgaggcaagagaattgcttgaacccgggaggcggaggttgcagtgagctgagatcatgccactgcactccagcctaaacaatagagtgaaaatccgcctcaaaaaaaaaaagtttcatgatatgttaagtgcaaaaagcaagtttcaaaacaatgtgtatattatgattccatttcttcctttttatttacacatagtatgttcatagaaaaatgaaaaaggctgttccctaaaagtgaaagtagttaaatctgagtagcgtaacagaatctgttttgtattctgcttctcagtatgtttatagtgaccacaatgactattacattgatcaccaggcagaaagagatggggagatctaaaaatgatttctacattttagcatattttgatagaatataattgtcttaattgactagtgataaaaaatttttaaggccagacatttatttaataaaatgtcttttggaaagcccttattgcaaggacaaaagccataatggctaaaataatagaagccaaattgaaattctaacacacaaggtgtaactagagggttgaagttcttccaaatcaggcaaaggccctcattctcttcagcgtagaggtgtgaagcccagttgacaaacagatggcagaatgggaaatccttcaaagtagttgtttttaataacttcttttgccatctactctctcatagctttgatcaaaaaaggcactggactctcttcacttctctattccaatatgttagaagaaatcaaatactcccaagggagtcatgattaaaaccaatgagtcacccagtgagagaactgcaaggcttgggtttgcagagatggtacagcaactcatttgccacttcactgatggggttttgcaggcataagcagatgctaattcatctctgccactaaagcctttgatattccagtcctgtctgaccaatctactggagtttatgacttttcttaagataatagagtaagtgatcagaatcaatccccagcctactgatcttacctgaattccagtaaccctactgactactccatgtttaaagacctccaaatctacatctcagaaacatgtacatctatgagacccctgactggaaagttcttctcggtattaagtggtctacacagaacagggcttaagacaataaaccctgtttgttgccttaggaataagacagatctgatacagttgccactcaggaactatgagtccttgagtaaacttcttaacttctccaagcctcagtttctccatctgtacaatgggaataatgcaaataatatctactttgataagttgttgtgaggaccaggtgagtagcatatataaggtactgtatatagagtgcctagtatgtagccctcaatgaaggagaaacttgggttttatttttattaacagtattttcttttctaaatgctcatcacctatttctttcaacagttttacctactattcattttagattagtttccagaaaagttgttactctaagatgcaagcatgtatataaatttgagttcgtccttttataccagctgctttaaaaagattatagctaagaatactatagacacaattaaatccatttgtgatagaatgcctcaatgaatctttctgtgaaatttcttgggaatattttaatattttcatgctcatgaacctcagtccaactctataacttactccaaaaatcacagtgaacgtgcttattgtgctatatgtcgtgtaatgacatttagacaaaagcaatgaaatctgatctaacctagcaataaatgtggtatagctgatttctgtgtaaagttatcagttccagcttccagctaccccagacaaggagccttgggtagtcttgacatgaacttaaaagcaaagcctctcttgagacaagaaccaagatctacaatcacatttcaaacggatttatgtcttccaactaattgacttgttaactatgctaatacattcatgtctctgcctttatattttttcaataagtaatgctacagaactcgatgttgtgagattaaagagcaaagaatctagagatttctgtaaacgctttttctataggaaaccagattagacttccaaaacagctgatataatttttgtgcatctccaaatattttatttctgtaggaaacgtgttgcttctcagaagatggctcttttaattaggccttatagcctgcagggagaaaagcttcaactttctctatttagataggaccaacttgatagtgacaatactagatgtgctatgcagtgtcatctcctaccacagttgttcaaaatatgaagaattaagcaatagcagaggttattccctctgaactctgtgccttctgtcattcccaggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaaggtaaggtggaacccatttccagagccacttttgcgtgtctttttaagcccaaatcatctatttaatgatttttcatatgtaaacaagtgtaccttattctgaggttaagatgatcagaatttttctctcaacttaggtaggaattttccaaccaaaatcatttcctaatcatttttgtttgataaaatgagagaagctctgtgtatggtgcagaatttcttccagattctagcaaattattcactgcccgaaacactacaaaggcagtctcattacatcttaatggtgagtgataaaataggtggccttcaaaaggggaatcaggcctgaccctcccacgttaggatctccaatagatcaattgatcagtcaatttctgtagtgaatcagccagtgcaccccagtggtcttgatgcccccaccccctgcagttgctaagagactggattcaagctacactcaccagaaagctcctctggtcagtcattaacatcattattattactcttactcaggatgcctttgagtggctctcagcctaagctaaactgcagaaatgctgaaaaaccacatttaattggtcagcttagagcatctgttattacttggttattttagtcttgaataattcctttaatccccagtagattccgcagagccaatgagcagagtacaagagcccaatgcatatgcatgttatcatttgaactataccctgtgatcctgcttgaccagaagaagaaattgactcaactggtctgtggcttaatttcccatatataaatgagggatgaagagaggaggagctggtgcttttcctaagccacaattgaaatgcatgtaaatcactcctctctttctaaatgaatgtatagcatatgggtaaagttttctgtgagcggttggtgcatctcttaataagaagctttacataagtagcctgttcagactctgatgaatacatggagggttgtttacactggcattattcacacaagatgccacacacagaaggaggaattgttccataacattctctgtacctccaggctactgtttggcagcgctataatatgagcatacaaattaggccagacagggtatgaaaaatgagcatgagacaacaacaaaggtggaaaggaacaccattgcagaataataccaaagcacattaacagtgctattacagtgcatttttctgttcagaacaacatggttccatgattttcctgcggcacacaattgaatgggcctgcagaacacattaattttgcacttgtagaaatgacagtcttgcaattaccattcattgtgcttgatgctaatttaatgcagtcatttccttgccaaagtaatgtctgaatgcaatcaagtaagcactaatgcctgcgagattccactacataagtaccagtttaaagaaaatcaccatccctttatttttggagagttaggttaaacacagtagctcacgcaaaacctctggagattaataggcaatagtcatgaatagaaaggcaggggcatatcctctccaggttaggccacattgcagataaagtgaaatgacgcctgtgtgttgcctctgacattatttcaacatgtttacacaaaagacatctaaatatttccttattatctgtttagcagaatgagttttcatttgattcaattagtgactttaaccaaaaaatttaaatagaagactgcaaaacatatttggaaatcatttatgagcatccttctgagtcaagtacctccttgacttggtagaatgacagtggaactgtttcagaggaatcccacagctgtccaggaaagctttgtctgcactgaggcaagctccatcagggactggaaggatctcccagcctgatgctgtctctgctctggacctcactctccaggtagcctggtgcctgcacagcagttcctgtgaccgccccccacctcaggctggtgcttcagccaaacagctcagcctctacaaagagctttggcattggccgaagaatgagctccatgcaaggccttctctggccttcctttgggagtataggtctatgcttgcagatgtggaaaacatcgctaatattttgccaagtgaatgaagcaaggcccaacctaccacacacagccggactacgtgtttatacaaaataaaacatgcatacacgcagagatgaggcaaacaaactgtgagaatacacgccaaaatattaactgtggttattttttgcaggaggataaaaatactagtattttttcttattttattttgctttaagttctgcgatacatgtgcagaacatgcaggtttgttacataagcatacgtgtgccatggggtttgccgcacctatcaacccgtcatctaggttttaagccccatatacattaggtatttgtcctaatgctctctctccccttgccgccaaccccccaacagacccctgtgtgtgatgttcccctccctgtggccatgtgttctcactgttcagctaccaattatgagtgagaacatgtggtgtttggttttctgttcctgtgttagtttgctgagaatgatggcctgtagcttcatccatgaccctgcaaaagacatgaactcattctttttacagctgcatagtattccatgttgtatatgtgccacattttctttatccagtctatcattgatgggcatttgggatggttctaagtctttgctgtgtaaatagtgctgcaataaacatacatgtgcatgtttcttattttgtttttgcttagctacattttccagtctttgcacaatgatgtatttcctctaacatcattattttttcttctttggaaaaataatagtaggaagccaagttcttaccccagacatttgagggataactatctctggtcataaaatatctagctatttattagatattattggaccatctagttgtactttctggaatggagaagcatggtcaggtgaaaattttatgtaattatattgtccctgagaatctcaatacatttaacaatgcatttgttaaatctcaatacatttagcagaactcattttccacaagcagctgaagagatcacccttcagatgggcatcggaggaagggctgccttgttggggtcaggttgcatgaaaataaagacctcaagacactagtatcacactcagctatgtgagaggctcacactaggacaggcttgggacccaaaatagcccaggtcataaaatagcccagggggacagataagctaagtctcacccctgtatattattagcccatccaggagaatggtgggcagacagcccatactgtttgaattctgtttttccctcctctccttctccccctcctccccatcctccttatcatcctcctcttcttcccttctcttcctccttccttctccgttcaccataagcacaatctttatttctacatcaatccctgtctctgtctctgtctctccatattccatacctactttccctctctccctttcttttgctggagtgtatagttgaatatgtaagtgaaattaccgtgtcttgtcactttgttgaactaggaagacagggctggatttgagtaggttcctcatgatcatctcttctgctttgtagatgatgcactgatactcactattccgcactagtcaaaaccacacaagaaggggacttcctctaacctcttatccaaaacccttttttcttttctttctttctctttttttttttttttttttttttttttgagatggagtttctctcttgtcgcccagactggagtgcagtggcacaatcttggctcactgcaacctctgcctcctaggttcaagtgattcttctgcctcagcctcccgagtagctgggattacaggcacccatcaccacatccagctaattttttatttttagtacagacggtttcaacatgttggccaggctagtctcgaactcctgacctcaggtgatctgcctgcctcagcctcccaaagtgctgggattacaggcatgagccaccacacccagcccagagccctttttcaaagagatgcctaaagatttgaccaccagttaaagtgttagctctcccagggctacttgaatctttagtaggagtgctgactggggaatatttcatggtttggagatagcacaagggcgttgtggaaaccctacaactagaccatgcaggcagtctcctcatctgtcggcagataactgagcagcatcccatcttctcagcacgttcatcaatgaggagcagtttaactcagtggaggtaggtcccttccaatgcagaattccttggcaccccatcggctgaggctgaggggagaatcatcccagactacatggaaggtttaactgtgggtctgtcatccccaggattattggggaccgaatggatagttgcttggtcatgccaaagatagttttctaacattaaaactgctccttcttggagagtcagatcccaaaacactcaagaattctataattatcaatgtcacttttattactaaccagaaattagagacataatttgcagtacactctctgtgtgtcttctctgtgtgtttaagcaagagagaaaataacatacctatagtagaggcagcaatttctgtgtttacttttcgtggttgaatgccatagtagattgaatagtgtcccccaaaattcatgtccacctaggacttcagaatacaacgttgtttggaagtagggtccttgcagatgtgattatggtaagttgaggtcatactaggaggttggccctaaatccaatgactgtgtcttcataggaagaggagggggcacagaggtactgacagacatagaaggaaagccatgtgaagacggaggcagagatcggagttacactgccccaagccaaggaattcctgaggctaccagaggctagaagagtgaaggaaagattcttccctagagttttcgaagaagcgtagccctgagaacaccttgctttcagacttctggcttcctaggaaaataatacaagttcgaagaaaaacctaccatcttcttaattcttgctcttaacaaggatagcagctggtatttattgagaacttgtctgctaggcagtgtgctaagctttctaattgtgttagcatcgtttaatcctcaccacaacctggtgaaatgattgctattactagtgctcctattgtaccaagaaggagatggttgtagtagcctgccccaaggttcacatattagtaagaggcaagactccctttcctttcattttgtagcaactaaaagcatagcctctagtcttaaagctttttgattattgtgattgagtaaaaagaaattagaatattactggatgcagagtttatcataaaaaataggatacaagaattgaacagacactgtttttttttttttgctacatctaggtgtaaggtttattcatttattgactcttattgagcaaacattcattgaacacctaatgtgcccagaagtcttgaatgtatagttgaatctgactacactgaaatttccaaagcattttaatggtttacagatacaaaatcaggcaagtctagaatatatgataggaatacatgtgaattggatatcacccaggctgctgaaaacagttcttcattatgatcctttcaccaagccaagttaagcaagaacttatcatcaagagacacaaagatatctccaaattcactcatctgcactttttttaactataaaaatgttcatgttcatatgccaaaccaggactgcagttgaaaaatacatttctttaatcactctgaaaccattttctgagttagggagttctgttttcttctcaaacattcatttgtttattgcttagaaaaaacttgaagaataaaagtcacaggattactgagtgaccaagatttgaatagtcattcaatcattgcagtgtttccatcatttacagtcacacaaataatgtgccaccctccctgtgttccagctaagtctcctattctccctatgagtattgtgaagttagctaatattttataatctgtattattaagatggtagaagaaattgtttatagcaaattcaagtctcaacctataagatgatgatggaattagatgtcagtttgaatccatctttctcacatacctgttacgtaaccttaggaaaattgtttgtcactgagccttatcttcaggaatacatagtaactacctcttaaggataccttgaaaatcacacagaataatgtgaatgaatttccacatgaaggacctggcacacagcagtccaacagcaaatgtccttttcattcttagcagctctttgctttttggtttgtgtttttgtttttacttaattcatgttgtcctttaatccttccctaatagctttaaatgtcaaatgcctaactggcattatttcggtgatccttgagtattggattgtcatttcggtacttcaggagcagtggcagtgtcctaaaatgtcatttctacttaattttggtcacagtaaaagtattctgaagccctgaagggctgagaagtatgcagagattctggaagatgcaactggaaaccacacccaccatatcggactggttttgtcaatagcgcaagtcttggagcaatgtatccagtcctttcaagaaccaagttgggtcaccttagtaactcctgcatcccttcctgactcaaggcccatcaggagacaagaaagcgctgattagccaggcacactggctcacacctgaatcccagcactctgagaggccaaggtgggaagatcatgtgagcccaggagttcaagaccagcctgggcaacatagtgagaacttgtctctacagaaagacaaaattagccaggtgtggtggcacatacctgcagtcccagctacttgggaggctgagatgggaggattgcttgagctcaggaggtcaaggcttcaatcagccgagattgtgccactgcactttagcctgggcaacagagcaagactgaggaaagaaagacagagggagagagggagagagagggagtgagagagggagagagggagagagagggagagaggcggggtgcgggggagagagagggagggagggaaggagggaaggaaggaaggaaggagagaaagagagaaagagtgagaaagagagagaacaagagagagaagagaaagaaagggaaagaaagaaaagggaggagaaagagggagagaaagaaggaggaggagagaaggaaggaaggagagagagagaagcagagaaagagaagaaaagaaaagaaaggtcccagactcctttttgctccaagagacctcaggctcaagtccacgttatacctctaaggaagagagggttttccacttgcctcctagagaaacatttcttgttggatgtgaggtagtgggtttgccaaaagcggttggaagactgaacaaattctgttccacagctctcagtatgaaacagggaccagaataaatgcatggtctacccttttagagcaggttggagagaaaattaattaatacaaaatatataaacaaatagggagaaaaagaagagaaatgttggaagtatgcatcttagaatttcacccctatgtgaaatcagctaagctgttagtgacaatggccatttttcctcaggtctacctatccagtcttaataatcccagcttggaagacactttcacatcagtagggagagaaacttttcacaggcttctttttcattttcagttggaacaggaggtttgacagatttggaagaaggcccaaaggaacaagaatagaaccctttttttttcttttcttcttagagaattattcaagtagagaaaatatcccttctctcttaatgtatttcttaaatcttcagaccttaggatgcaatttaaaagtatcatggtaactgtgatggttaattttaagtgtcaacttgactggtgttccatagggagcaggtctatgcaagcctacctccaaaggccaagggagctgagaggccaaagaaacagtctgacaaagccagtttctcagaagaaaaaaaaaacaaattgaatagggacttaccaacagaagttgcgtctctggtatctacaagatgagatggtggattcctttacctcctcagacccagggcctatataccatagagaaagggtctacatgcttcagaagcaagttaccctagagcagaatttgcagtaaacagtagataaggtggaaaacttagtggcattctgcaactgggttattcagaagccagcatggtgcattagcatccaagaaggaggtgctttagcccctacacctagaaatctgtaaagcattactttgaggtgggtctgtgaggctgtttccagagaacattagcatgtgggtctgagtggatgaggtggggaagagctaccctcaatgtgggaaggcattatcctgtctgctaggggctgcagagaacaaaaacagagaaaaggtggtagtgtctatctatctactagagatgagatatactgttttggggcaactccaggctccctagcctttgggctccagaacttataccagattctcatgcttttgagcttgggctaagagttacaccattggcttcttttgttctgaggcctttggacttggacggagccacaccactggtaccccagggtctccaccatgtagaggacgtatcatgggacttctcagcctccacaattacatgagccaattcccctaagaaatcccctctcgtatgtctatatctatatagtctgttgattatgtccctctagagagaaccctaataccataacgcatgaaaataatctgattaaaagcttaaaaaataaagagagaaggaagagccaaaaagtcagaaaatatttatggatgaaaatccataagtggacagaagtccacaaatatgtatggaaaaagaaaataattttgacttaattcagaaaagtcaaagctgcagagatagctgccaagtttaagtggctttgttatagaattttgtggtggtaaaataacattccccctagcctgaggttctctttggggtcccagatatttgagaaaacctggccaattaactttcttagagaaagagatttaaaaattcagtgcagaaaaagcaagtcctccgtaaactgttctaaatctaatacaggacaaagtgttcggatttggctttggttgtaggataaataacttttgtttcaagtgtgtgcccttttttttttttttttttttttttttttttttttgagacggagtctcgcactgtcacccaggctggagttcagtggcacaaactcggctcactgcaagctccaactcccgggttcacgccattctcctgcctcagcctcccgagtagctgggactacaggcgcctgccaccacaccaggctaaatttttgtatttttagtagagacggggtttcaccatgttggccaggatggtctcgatctcctgacctcgtgatccgcccgcctcagcctcccaaagtgctgggattacaggcgtgagccaccgcgcctggccaagtgtgtgcccttttctaatccccaccagtgtggggacacagctgaattttttttcctgagtgttttatttgtatatgttgttgagtgtttttatttcctgttcttcagcaatgatcagaactctaaataatgtgaagttcacagaaataacactctttatcttttcccacatattagctccatgacttgagctgaaactctatacatttcttttcttttcttttgtgagccaaaaaggaactggtctgataaattgtcctgagggttttgcttttagattgctcacatgtttggctgccctgcaagcaggtccattcaccaacgtccacgctgcccttgagtactccatcacgtctatgggccatgaagacctgcctctgacatgcaatttcttcactccacaaccatttgcgcgcttatcatttccaacaggcagctctggccttagcaactgggctcattccaggcattccttggctacaggaaatttactttcttaaataatcaagcctgagactataatgctatagcctacccattttatagatcaacctggctttgaactcactcacatatttttacctctattaattccaactggttacaagagtgtttgatttagataaataggcattttatatttttctgtttaaaaccaaatcctgagaaaacaaattatgaagagccagctgctctctctgagccatccttttcttggcattttaaatgtattaccttcattttctcaagaggactgggcacaggatatagtgaaatgtttaacttgactaacaatactttctagctactcttccaagggatatgtttactaaatataaggtggcttttacagtattcaagttctataaggcaaagactctcaattaaattaaattattggcagtacaatttaacattctacattctgtgtgaacgaagtaatttcaagcagtttgatcattaataataattttattccttcctatacactgagcacaagtttagtgaaatacgggaacatgtacagagagcctgctgtgggggaagcagtggattgccagcaaggaaggacaggatgaataagactaggctgggaatgcaatggaggggatagaaccaactgcagcatgcagggaaacaagccagaaggccgagtgagagacccccatggatacccacgctgaaggttctactgggagggctgcctgattcaaagtcttgtccaaggacagcatggcagatagtggtgggttgcacctaattctgagggcgtaatttgggttaagggagaagactctttggaaaacatatatcattaaagcctaaagtctaaagacaaaagttttaaagcatctcaatttttttaaaattgtctttgaaataatacaattgatatttacaagaaatacttatttgctttttttttttttttttttttttgagacaggctttgagctttgttgccctagctggagcgcagtggtgcaatgatggctcactgcatcctcgacctcctgggctcaagtgatcctcccaccttggcccccagagtagctgggactataggcatgtgctaccataccctgctaagtttttaattttttgtagaaacagggtctcactgtgttgcccaggctggtctcaaactcctggcatcagggtatgctcccacctcagcctcccaaagagctgggattacagtcatgagccaccatgcccagcctacttatttgcttttaatattacaaaattgaattgctttagacattaatagtggacaaaatattttaggagttagattagcttaactatttttcaaattatattccaccagccaaaaatatttcatgaggctttgccttctttaatttctaatatgaaaacagtagggaattttttccatttttcaaaaagttattctaataattaatatgattttctcaaaatacacgtctccttgcagttttttcccttactcccacctccagataattttatatgaacctagtggacaccttccccttgagtatttctgccttaaagataactttaaagatacaacttcaaagatagatcaacaaattgatatgtaaaccaggcacggtggctcatgcctgttaattccagcattttgggaggctgaggcaggattgcttgagcccaagagtttgagaccagcttgggttacacagtgagaccccatctctataaaaaaaataaatatctaaaaataaattgacatgtaaataagtttatctttgctttttgttaaaagaggtcttctaaaaacttgcttttatcaactttaacattactaaattttattttagtattctgaagtttagaccttaactaatgcaaatttgcttactttagactagtacaaatgacttatgatttacctgtgccagtagccaatctcactttctgtgcttctccctagggagttgggtcaagtatagcttacagagaaataccaaattctagcccttatgtgaatcatttctcagcaatcctcaaaggcaccaaaatgtcctttcacatcttctatttctttccatcctggatttatgaccagaaacacagacaacactattctaaactaattttgtttaaagaaaggggaaatttgtactttttgagtttatcccaattaaagagggaatcttatattatatagaacagtggaacaagagtaacttgaattccaatttcaacattattaaaaaccaaagtgaacaatcctaactaggcattctgtttctttataaattgcactaattatataaaattcattattcacaaggctgtgaggatcaaatgagctgatggatgtgaaagtgctttgaaaagcattaatgttataaaatgcaaattattattaagtttattaatcattgagtcactgaaagcctctttagtgagaatcctgcaaaatgtaaaccattatctttcaagagctgctaggaaatcctagacagaacttttctatctgtgttgttagtgttgccataaccaacagcaaaacttttccctctcaattgttgacattagtgctcgcccgtctctctgtacagcactgaaatgcgttatccagaagctccgtgctcacaacaatccagcaagactttagacctcagagttatactagttcatgacaggcagtactgtattcatagtcagccaacccttgaatgcatggccctgattaaattcctgtctctgtcatggaattggcatgagtcatttggcctggaacatcattaaagcagcaaacacacttgagattaaataagaatggattctaaaacatcctcttgaggttgttattgagatcgttagcaaatcatgttggttccttgagtatcttatagagtttcaagaaataaaaagcaactgctacattgtagaaagtacatctaaaattttcctcttatcccaagtgattgacagtctctctgcatcctctgccccgttaccaaggatgataactcctgttcagatgaatgagtccagatttttctcaggtctaagccaaatgtaacccaaatatttgaacaagtccattgctagtcactttttagttttcagagatgaataaagctataagtaaaatgctttctaaagctttactattgaagtaatttgatttaaatcccttttaaataggtctattttagcctgttgacttttatatttccttaacaaatgtctcttataaaggaatcttgtaaattcagttaaaaatataaattaagtcatgtaagtcaaattaaagcagtagatcaagttataaattgaaacaagtttataatccctctcctctattaactaagttaaaatgttatcttctgtggcctcatacaacaacctcctgaatcataaaccacctgaggttatgacaaacacttaataacttcttttaaaatatcaaggactattccaaaagacttttatttctgttactataatgaatttatgattactcagactttcagcttttgcgctaacattcaaatgtcattgggttacttattccaacacttcttctattactatagatggttaaaagttcaggaggccccttttgtcacaaaatcaaagtatgtcgtggttgaaaggactatttcattcattcatattcaactgatattttattaaacatttcctgttatgccaggcactgaactaagtgtgttcacatagtttaccttatttaatcatcacaacaacattcaggcattgatatgatcacctttatttacaaaatgaagaaacagagacttctagaggttaagtttatcatccaaaatcacattgctagtaaatggcagattgagattggaatcctaggtccctgactccaagcctagtgttttttccaccatatacactagaatgatgtcctctttataacacactcactggatcagatccaagttgtgttcatggagagcccgggaccacatgaggcagccctcttcctatttgagcatttcagacaactggaaagatttccctcatcctgaaccatcatctctattaaagatggagaatgtctccatgaagaaacagtgggtgtctggctctgggttcaaattcctgtgcctgtaagaactcagaaacacctatgcaccttcaaaatccccaactctgtggagataaggaagagcacctggcctaagtttgacacaaaaggggtatttaatagctgattcattccttactcttctgtttcctttaccaaagtctcaatggcccttaaaactaatatgctgacacacggtcagtggtccaatttgctatggctattctcccaatgccccaggaggccttgaaagatattggccttgcttgttgtccaatgtagaatggtaaattaatgagatccttggataccagataacacagcttgccctgtgtgtcctctttctatcttatcaccctgatgactcagggcaggcctaagtcctaaaagttctgaagaagtttcccttctttctttgccgttctttctgaggccctctctgtgcggttgagcaaggaaacatacacacacacacacacacacacacacacacacacacacaaacagagccaggtgtgagctggacctgtcggtttctaacaataagtcttagataacaagataattctttgtgtttcttagggtgccacccacacaccgtatccatgcttttgtgttaatagcagagacttctctttctgaatatatgaggagaggaataaaacaagggatgtgaccaaataaattcttctgacatgagagaccactttagattgccttattacaaagaagctgatttgcagggtaaacacaggccatgccctgtaagttttcttattgatgaaattcatgctttgaattactgattgatggttgctgaaggatggcaatttctctgttccagtctggagactgcgctacgtaaaacgagcttctgatgatggaaattctaaaatccaaacaaaacatggaaacaattttttaaaactcgacatctatttctatgaggagctaggagggtggatgcaattggtcagctccagctgtttccttgcttttattgcacagttgttacaaagaggaattcagtgtacaactatgagcttccggccgctcaagctactgcattacactacatggccatactctgatcccaacatgagctttttttcctctagccaaaggataatgtaaaaattatgacacaaataaaatatttatcctctaggcatgagtaaaggaattcacaaatcagaacatagcttgcaagcatacaagagtatgcttgagcagtcccctctttttaataaaaatcaaccatatgaataaaaagctgccctgccccaacttcaccccctacccatcacagaccacaccaccaccccaccatccccgcatacatgcgtgcacacacatgcacacacacacacacaaagccacccactaccattgcagcagggaatcactgatttttttaaattaaacttttagagaacccatgagtttagatggaaaaaatcgtgggagagtaggaatagtttaaggaatgtgcttggagaccagccactcttcacccaaaatgatttcctttgaaattcctgacttgttccctttctgtcctgtgacctattgttctattaggccattctattctattacagcatcatttgaatcagtaggagtgggtctgggaggatggtaataccatctctttaatacctcaatgtggacggaattgaaatggccaagtccttacccagaagagctgtcctgaagaaggagcattgagtttgaagggaggagccaggtgtaatttaggagtggggaagacattggacaagctttgaggagatagttaagatgacttccatgaaaacagagagctgaagcctgttagtaacagactggaaggaagaaagatactcctttctttgctgatcttgcctaaagccagcaggtctgcactggcaaaaagagaggaaactgtctttctctcccctctggcagtttctcttctactaagatccagaatccaagctaatggcattagtgctataatttggtttcactactaaataatctttagttattgatccatgttagaattttgtactattggaaaatgtattctgagttcctaaaatcaatttatattattataatgtatgtaccgtactatcattatgtacatagtattagcatatatagcatttcattcccttgaaaccacttggtcttcatacccatcacttaaaaatactgcttcatattattccacccagtgggtttaccaaaatttatttaacctaaatatttcacaatagggaaatggcaatttcaatttctgttcttaaaattgtttccaatttttttattgtaaataatactgcagtaaatgatttttgcaagtggcatttcaatattttacattatttattgaggatggattgccagatatggagaggtagagttagaggatgtaaaatgcttaggcttttcacgtacaaagctagtaagattttctaaacacagtgccaaagtacatgcagtatacactgagaatgccttgttctctgaacactaccagcaatgtttttcttttttttatttttatgaagataataagctaaaatggtaacctatttgcctttacttcctccaaaatccctagaaaaggatttcaaaatttttttgaaggtaagagtcaatctaaacaaagaggacaggagaggacagcaacatttagaaagacggcaagcaaatggaggaataacacacttagtagacaaagggaggccaacccctaagctggttgagggagaagctcaagagcaggcaattataaaagggcagttccttttataaggaaccgactcctgcaattactgccttaactcattcatgaaggtggaaccctctgggtcaggctctggtgagggccctcttctgggtggcagaagctcaagggcatggctcctcttctctttgcccttctgccatgggatgatacaacaagagggctctcacaagacgacatcccctcgatcttgaactttccagtctccagaaccacagccaagacatttctgttcattgtaaattatctgcggtattctattatagcagcacaaaatggactgagacaggctgctatagcggactgccatagcagtctctgttgcactagaaggctcagaaatgggtagcccctggcacctcagaaagatagacttaaaaacggaaggatcagctaaaaatttctatatgaagacaatcttctcctcactcttgcagctgggtaactgccccagagccaaataaggcagaagacccaagatttagtgtctggaggggcttcttttatctcttgaagatttggaagattgtgttttccaaggacggctgccacaaaagctctcctgacacctgtgcttccagagccaagtgactgctccatcaagacgtgatatctagttttcctctccaagaatctggacagccttgggacttgcttaagccaacagaatgtggcagaaattatgctgcctgacttccaaagctaggttatagagccaaggtgacacgtgccttggggactgggccatgcacattggagtactgattgcccaggaaagcagtcaactgccctgaggccaccatgctcaaggaactgcactaggttacgtggatcggacacatgaaaaagctttgagatgacctaaggaggtagagagaggccaaatttctgattcacagaaaccattagagataatgaaataattgttgttgttttaaaccagcaagtttggggagcaatctgttaggtagcaataaggactggaacagagaagatgaataatagttttttggttttccaaaagaacttactctccaagtattatctttgtttttgctaaatcctttgtattagtctaggctcttagagcgacagaatcaagaggagatatgtacctatatctgtatctctatatatgaaaggagatttatttggggaattggcacatgcaattatggcagaagtcccacaatcggccgtctgcaacctggagaaccagggaagccagcagcatggctcagtccaagtcttaaggccacagaactagggaagccgatggtgtagctctcagtgggaggctggagccctcagacaccgggcggccactggtacaagttctgtagtacaaatactggagaacccagagttctgatgccaagggcaggagatgtcccagccctaggggaaagacagagagagagagagagagagagagagagcaaaaaaagaaaaatagaagaaaaaacatgcattcaaatcattttgtaactcctaattattaggacgataataaaagaagattccagattccagacctagagagcaaccagtacagactgaacaaggaagatgaagagctccatggggactatctttgtctttagtctctttgggctgtgctaaggattgaatgtgtcccccaaaaagcatgcactagaaatgtaatcttcaatgcagaagtgttgggaggtgaggcctaatgggagatgtttaggtcgtgaggactccaccctcatgaatggattaatgctgtaattgcaggagtcaattccttataaaagaacaagtctggtccccttttgtgcactcttgctctctctctctctctctccctctcctctttcctctgtcttctccctctctctgtgtcctcttctctttgtccttctgccatgggatgttcaacaagaaggctctcacaagatgccatcctcttgatcttgagcttcccagctagcttccagaaccatagtcatatatttctgttcattatacattatctgcagtattctgtgatagcagcgccaaatagactgggacaggttgctatagcatactgccatagactgggtggcttccaaaacaaacattgatttctcacatttctagaggctggcagtctgagatcagtgttccagcatggtcaggtgctggtgagggccctcttctggattgcaggctgctgacttactgttgtttcttcatatggcagaaggagagttcagagagctctctgggtctcttttataaggggactaaacccattcacaggggctccaccctcatgtcttaatcactttccaaggcctcacctcctcctaccatcaagttaggggttaggatttcaacatgtgagttttgatgggagacaaaaacatctggtccataacagtcaagaaaaatataaaacagtttacttctgtttccttccagtggtgagataagggatgagttagtgatgagtgtgcagaaaacaaggcaaatgaagaaacaaaagattgcactggaatgtaaatgcaagtgttttacaacatatatgatcaagaacaatgcaagcttgttacttagaaatatgaagttgatgccaaaaataagatggcttctgaggagtgggaagtggggaggtggagtggagacttccgttaatgtgtttcagggcttacagaagcacttgagtcctttcttaaaaatgtgtaaatttatggcgtacaagggtaattttgttgcatgcatggattacatagtggtgaagtcagagcttctaaggtctccatcactcaaacaaaatacattaaataaactctcgtcatccacccctacacccttctgagtctccacactctatgtccatgtggacccattgtttagctcgcacttataaatgagaatatgcagtatttgtctgtctcggtctgacttgtttaacttaaagtccttagactatgtatgtcacaacattcataaaaactgatcaacttaaataccacattaaaatgattacagaaaaacgcaagcaaaaatataataaagtaattttttcccctccctcaaagccaactgataacgaaaagaaagaaatggatgaccaaaaaaaaaaacaaaaaacaaaaaaactctccatgcagtgagccgagatcacgccattgcactccagcctgggctacaagagcaaaactccgtctcaaaaaataaaaaacctccaataaaatatggcaatgctcattgccacaaaccacaaattaggaaggatacgtgacacatgccaactactttgaaatttgcatcagaatgagagaggaggcagttaattcatgttttcttaacttcactcaaagttcagcaattcctttagctctatttcagtttcttcatcctattgctttcttatgaaatatgactttatttttttcctataaaagtagcagaaatgattgaaagttctttgcattttttggcggtgtttgaatttttaataagggccacatgtgtctttctaaaaattaacctattctctttttaaaaattaacaaataaaaacttgttctctttttaaaaattaacttatttgttctctttttaaaaaatgaagatttttttcctcaaaatgaatatacttttgaggtaagaggattttcacctagtattctaaaatcacaaaaacaagtttattatttttattttattgcaaatatttttcctacatggttattttcagatcaaataataggattttggaaataccagcctgaccatactgcacagattgagaggttaggtactaaattataggcttttagagggaggtaaagatattagagtccatctccactccactccccacagataagggccaaggccaacctagccattaggtggggtggacacaacccacgttttgaggggcccacacatatatgttaaaatttctttagaaatcagaagaatacaaatgaacttcggggtcaaagaaaatattttaatatttaacattaatacattttctcttgaggccaacattgtcatgaaatacacattttcataatttttttttgtggaagaaagggaccacaagggcaagtgtgcctggggcccatgaaagtcataatgtggccctgatgaggattctgggacctaaaaagattcctgtaattggtggtggcagagtctggaccaaagctcagggcctctaactcctcctctatggtgctttctgccatgctgttctctggcttgggtattccacacactccatggtccagcccacactccttatctgaccttacctctggccatcagtcatagttcatcttctgctccagttaggtaggcccagcctcatttcctgtaattcatcacaaacactctccatcccagctccatggagcctcccattgttcctagtccactgctgttcattcccagcactggctctcactcctcccactctccccatgtggagaatccttcccgtttccttctgcttgttcaagaggatcctcatctctggagactttgtcttaacactgcctttttttttttttaactgaaacagggtcttgctctgtcgcccaggctgcagtgcagtggcgcaatcagggccaactgcagccttgacttcctgggctcagatgatcctcctgcctcagcctctcaagcagctgggattacaggtgcatgccaccatgcctggctagtgtgtgtgtgtgtgtgtgtgtgtgtgtacatatttttttttgtagagacggggtttcaccatatggcccaggctggtctcaaagttctgggttcaagcaatccacctgctttggtccccaaagtgttgagattacaggcatgacccaacactcctggcctctttcaagtacctttaaagactcctccagccttgagtgatctaccctatgtataaaagcatttgccatttagtaacaaattatcttttcttattcatatttgtcttatatgtcttagttttctttccccaattatcttgtcaggtccttaagctcagaagcgatattagtcaaggttccccagagaaaaagaaccagtaggataagtataatatagataagagggaatttattattggaagtgacttatgcaattatggaggccaagacagtctatgatatgccatctgtgagctggaggcccaggaaagcccatggtgtaattcagtctgagtctgaaggcctgggaacagggagccagtgtgtaacctccagtccaagacgagaggcctaagaactgaaggaagtggggtgggcggagtcccagggcatgagaagaaggatgtcccagctcaagaaaaaaaagagacaacttacccttccttcacctttttgttccatctggcccctcaatggattggatggtgcccacccttattggtgagggcagatctactatactcagcctactggattgaatactaatttatggcaacaccctcacagacacaccccaaaattatgttttaccagttatctgggcacccttagcccagtcaagatgacacatgatattaaccatcacagaagccatgtctcatatactcactgagcatatatatgatcagcactcagtcaacacccaaatgattgtcagaaatctctcacaactccccctacaataatagggtcaagtgctacctcttctgggtgtcagaaataggcttggctttcctttctctttcttgtatttgtaccctctgtgatgaaagtcacgctgtctgattgcacattccttctgggcaagggctgatgtcttctcattatgtattgtcagtctccagcacagtctgtgctacaaagtaggtgtttggtaagtatttgatgaatgagcattttctagaaccaacttttaaattgaatttcttggtcctggagatgtttatttttcatgtgagttttccatctctgaaaaaaataggaaaagaaaagacaaggaaatgagaaagcaacttgaaaacaggaaaatattggtgaaagttattttcacagaagtcttagttgacctttctctgtagcattaaattccttccctgtagtattaaattcacaacctaagctatagctagctttccaaactagacaagcatcccacttaagcacaattgatctcatttcagtttgtgtctttgggcaatgaaataccgcaaagactttttctacctatgctttgatgctttttaaaaagtattttctaaatatttttaaaatgtttgaaatacacaatgataggataactccaaagctgtcatatttgtcaaataattcaagtcagaatttaatatatcctataactgagactcttttataaaattgagacaggcacctgaagaccatttttatttctgtattttcttggtgtcccaagcaaccccctttagagaaatcactaatatttcctgagcaattgaaccacaataaagaccgtggaaagaaaaaaaatgggtctgctcagacattcagagcacgcatccttacaaatgcattctactgacctgcaaaatgttagtgggaatttataaatgcctacaaaaagaatatccaagtcaacatttgacctgtcaaatctaatcagtttggttttgatcattgtaccgggttgctattcgcaaacactaattgaaagcaaaaacacaaacagcatttttaaagagtttctaggagaatatcccatttgcacacacgtcagattaattttccccagagttgagcaatttcaggatcaattgattactgatcccaaggaacaatcaaaaaagaaattccctgaaaaatttttttgactgtcaagactcagcatgggaaactatgccatgaaaatgcagtttgaatagcttgtcttttaatcccaagtgaaataaatcaatcatctattagacttttctagttccttgtgtagtcagggatagaagagttcgctgcagcaggattcggaggaactggggggatctgggtccaggaactcgtctgatcactagaatggggcagggagtgagcagaggagtttgcagcacacagtagaggaagctggtaggcacagaatagtaactggcaggcttacagctgggaccagaggggtccagcaatgataacagctcccggcactttctaagtgtattaattaactcatttattcacacaagaatccaataagggagatagttttaatagacccattttactaacatgaaaactgaggcattgataaattaagtagcttgctcaaagtgacccatctctttggcagagcaaggatttgaacatagacaattttgctctaacacctgtgcccttaaccactgacttgtaactgttccagggagaagatgagcctcttttgggcagcagggcagtggacagccactgaaaatgtgagagctggcaatattcaaagaggcacattgagatccttccaggaaagtctaactgcttgcaccagggtccaggctcaagggagggattcagggagcagcccctagaagtaagtgctttcacttgctaggcagtgcttccctgactcttaggctgcaaatttctaaaaggaaaaaaaacaatgttaaacacgagtgccagtttatatacctttatatattcagttatacattttgtaaatatattacagaattaatgtacatcataaaatacacacaaagggaaaaaaatcattcctttacatcaacaacctactataaatttacttcaaatagcattcatcagtactagcactagaaatgtgtgtccctgacgaaaaatatgtttttacataatttagatcttttattttgaaatttatcagaaatttcttgattagaacccagttttcctagaattattccctacttgttagattatttatccacatatagatgattccgtgaaaaaatgcaaagcaagacccttgatatattgtgtaatcctgaaactatatattaaaaacaaaatagtcttttagaaagcctgcagcagtaccccaaaataaaggtcacccaagaagaaaaattctccctagaataatgcctttaaatcccggaaacgaaagctcaagtgtttacccgttctttttaacattttcagagcaatacaacagagtcaatgtatgaaataaggcattggagttcagtgtaagctaccaccaatgacagaacatgtccattcagggcaaagatttatttttctgattataccaatgacccacacatacacaaagaaaaattaaattgaattaaaagaaagcatttcagcaatcttgacaggcttgagccctctgacagctcctagaattctatcagccgatcatcatcgtgttgctaaagccagctgcctcttgaaaccaaatttaatggaaagaggaggagctcaacaaagcagcttaaacatctcaccttcaaagctcattgaaaactaggcttcctatcagtcatgtgtcaaaggttcccctcatcctacaccatacagattagttcttcaagttccatttgtgtggtcatcctttgagtttccttgaagctctaaaaaggctaaaaggttatttccatctggagccactggagccttaatccatgtatcttttccctgcgcgaatctcaacatggcggaactggaaagtgagactcccaacttccatgtgaagggaacgatgtcaggcaggctgagaagcctgagggtggctggttccaaagggactgacccaagcctgtagcgagcaaggaggctgcctgctacccagagccaccaccccccatggcagcagatcacagcccctgttctttctcttttgaagcttcaggttagggatgggcaattcatagcaatttgtctttgaggtgataggtttggcaaaggggcatgatccaagaagtaagaaatgtgtgagaagtttcataaaggttgatggcgattgtgaccatgtgacctgtgcaatctttaactcatcgagtatctaatgtagattcttaactgccttgagtgcttttaagggactccttctgtgggggcttcatggggatttttcctaatggttaagctatgtaaatgtcttccacagctcctgtaaaatctcccatgctgaaataactacatccctgctctacagctatgaggattgtgaccgtatgtgtcccagcaagtggtagccaccatcataagctttggaggacactgtgttcttctagatactccctgggccatcttttcagatgtgccctttcagaagtggtcgccctttcagatatgtccttgtcttagcagttggttaaagcttcataggatatttgtattcaaggtgctagttcaaaaacatgaccttgaattcatagctgcgaagctcaactgagagaaaacatatttaggaggatggaatccacgcattgccgtagaaaactccttctcaccctggtggatacaacttttgaaaaatattgatacctgggccccatctagaaattagtctcatgtgggtgctcagagaacatagggaggtcattggggatggagtagaatgagcaaagaagagaagaaaatagggtgagagaaacaatggggtgtggaatggggagaagaggtgcagattagggagggcatggcaggccatggtaagggcttggcttttgcccagagggaggtggagttcatagagggttttgagcaaaggagtaacatgatatgacatatattataaaatgatcactctggctaaattaattccttttgccattgcatccttaaaataaacctaaaaatgcagaaaaactgaaaacaggaaatgattttccaagctgctactcaaatgtctaataacaagaagtgactagaatcctaaatcccagaatggtccacgtattatctccccagattcctgatagagatatgtagaaggcacatttcaagcaggcttatattgttttattctaagagggctgaactgggaatgtgaggtttcaagtccttctttgcttaggtgtatccagaggtaatacccagaaactcaaatttagtggtttgagatagactgtagacatcctgttgttaaaatgattccaatgcccatgtcgaaaacacgtctccaaaggctggaaaaatcaactgacattgacaaatgcttttagttttcctttcttggactctatatagctgtactgtctatacagtaaccacaagctacatgtggaggttgggcacttgaaacggggctagttcaaattgagattgtgctataagcataaaacactcagtagattttaaagacttagcatgaaacaataggtttatgtgttagtcaaggttctccaaagaaattgaaccagtaggatagagagagatacataagagggggtttcttaatggaaattggctcatgttattatagaggccaagaagtcccatcatatcccatctgcaagctggagaaccaggaaagccactggtataattcagtctgagcccaaaggcttcagaaccagggggacaactggtgtgagtcctggagtccaaaggctggagagctagaagcaccaacatctgagggcagaagaagacggatgtcccagcacaagagagggtgaattccccttcttctgcctttttattctttccaggtgctcaatggattgggtgatgcccactgacaattatgatcctctctattcagtcgactgactgagatgctaatctcctccaggaatgccctcatagacacactcagaaatcatgttttatcagccatgtgggcatctctcaggccagccacattgacacacgaaattaaccatcacaatgtaaaatgtctcaataatttttacatagattacatgttgataaaatattagatatactaaattaaatacaacatattattaaaattcatttcacttttttactttttaaatgtggctacaaaagaattaaaattacaaatgtgggtcccattacacttcttttctttctttctctctctttttttttttttaaagacctctgtctcccaggctagagtgcagtggcacaatcatggctcactggagcttcgaactcctgggctcaagcaatcctcccttcctagcctcctgagtagcagggattacaggcatgcaccaccaggcctggctttcacattatatttctactggacaggactgatgtagagcttttcaaagactcctcttacataggaatcatagccctctatgataaccttcaaaatacacctacgatgctaccattctccgcagtaatttttttaaagaaaaatgctaaattgcttttttagatctttcttgtaggcaagatataaatagaaggctttgaaaggcaatacaacatagtagttaatagtaagaacttggtagatgtgtgactgcaggcaggttgtttaccttctctgaatctccattccctcgcctgtagaatttgaataatatgtaccccatggtgttgtgagactaaataacatagtccttaatgctccataaatggtagagcctttgtaattggtgctgaaatttaaagacaatgtggagttatcttggattcaggtgatgagattcaacataagaagcaatgcctcaagtccttgcaccaacagaggtgcagaaattcatcatctccctaatgaatcttgagttttctttatacttctgtcatttgattagaaacaaactctcagcatgtcagatttatattcaaatctcagaataaaaataattacagaagcaaaatgtcatttggaaagggtgtgtttggtggtcagaattgtggttgccacgtgccttcgctaaatatcatgactaaaagggaaagacatgcagatctttgctaggaaggcaagagaaagaagaggtgaataaaaggcttgaagctcttgctactctaatcaaattgttttatttgtgagagttcgctttagcttgctctttatgtttgaacctaagtcttttcacctgtgacctcatcaccatttttctaatattgctcagctcattagccttgaaatttataatttagtttttacaccattttatcctatttcttcccattgccaagcacaaacatttactttgtaaaaaaacgtgactgaatttattaaaccagtttgtcttcaaaagtttcccttttttatagacatgggaagactcaaatagttggtttccctaattctcaggagacaaaccagtgaagctgaagccagttttgtatgcaactaaactttgtgccccgtcctttgggtctccaattagaataaaatcagggatgggcaggcagcgtgcattttaaatcaccatccatggtcactattatttccaaactcaaaggcaccattagaacagggaaacatttgcaggcatttcattacaccttgaactattaaaaaaaataagacattagaaagaagtgattactttaaaactttcacacactatggaacaaaagaaatggcaatacacagggagatattatagtaaacaaattgacgcacacggttgttgttagtgaaggacagtattacaagcagatgaggcaaatgaatgagttgggaagagagtcaatctcacttcctgaagcaggggcccttgagaagcctgtgccttttaggctgtttctttgtaggattggcctgggtgctgaaaatagcatagagccttttgcagaatcctttatttcaaggagttgcggtatttcatatgtggcacggcccctcccttcaatggcctctctcctgccactggaaggtgtttttacagttccccttgtgacaaaggacaggtcagagagcaaacctgtgagcaaatcaggcttggcacgcacatcactaagcaacagatgctttctggaaaaccatttgggagtgtttcagatagtagtatgtgtgtgtatatacaaacatatacataatttctggggaaaaaatacatacatacatgtgtacatccatactttctgaaaatcacacacacgcattttccagaaactcatttgaggttgattttatgtgtacggagacagagaaagccatccatccatatagaaagccttttgcaagtatttttaatttatttcatagaagcctgaatttatttcacacaacaatgaataaatccattcttttgccacagacgtggtgcaaaaagaggggtgtgcttgaagcatctacaaaggggaaaaagctgctgatacagggaaaaaatattaaagtaaaattttagttgtcagctttgtaattgaagctgtctcctcacttgaaaatattgtttccactgaagtagaagacaaagggggatctggcaaatgcccccacgatgttcatttccccagataaattacacacatcgtgtgtgcatgaagatgaccagaggctctcactgtgctggggatacagtccaatcattcattcaaggctctgtgtagtcatacaacaaacgcgtggcctaaatccattctttttcttctttttcctttctcttctcattttttcttttttcctccttcttctgccaaaagacagataaagtataataactttgatgacaacctcattttcaggatctctcgataaatcataatccttcagttgtattttccaaaacctgcagttagccaattacttcttggtttccttgaggtgaatctttgctttttaattatattttatcttcttcaaagaaaccactattgaaaaattatagctaatggtagaaatacatcactaagatgtcttggattttcttttggggaggagaggtgggggaataaaatgaaaaaaatatgtatatggccaaattggtctgtgataccattaattcatgttcattaattcaaacagtgtacattgcatacctactatgtgctaggagttgggttgtactccagaaataaaaagtcaaataaaacgtgtttccctcaaggaaactatgttctccagcatctgcacatgtaaactaccaattccagtttagtatgacaaactctttggaagtattatattttgaatgtatttcatcgagaaatgaatgtgggccaggcaaggtggctcacatctgtaatcccagcacttagggaggctgaggtgggtggatcacctgaggtcaggagttccagaccagcctggccaacaaggtgaaattctgtctctactaaaaatacaaaaattagctggaggtgttggcctgagcctgtaatcccagcttctcaggaggctgaagcacaagaatcgcttgaacccggtaggcagaggttgcagtgagccaaggtcgtgtactccagcctgggtggcccagcgagagtacatctcaaaaaaaagaaaaagaaagaaaagaaaaggaaaaaagaatttctaagtctggttttcatagaaacaagtgcaaaacaagccagaggggtcattgccaaactagaaagaagcccagggccagaatatgcagggttagtggagaagcccagtgctcctgggcctgaccacctcttggactcggtataccatcataaacagcattcagtaaacatcttttttgaagaggcatagtaaagaactacctgctaagagtccagaaaccctgtgaggcctcagataactttagtaggaaataaccaagctcttgagttgcttgaagtagaatcccattagcttctaatgcttcctgtatttgcgccccattcaaggaagcaactctagagaatttctttgaatcctgttacttccatttgatgagtgagactcagctgtgatagtctatctgctttaagactgccgatacgatgtggcatgttctctaaagaaggcagaaggcttgaggacggtttgtgttgattgaagaacatttcagtgatgagttggaatatttagacaaatttcaaggcttaattaatatatgaaataaagtagttgcagagataacgaggaaaaccaaagttataatctatagttcatttaccttccttggtcagggcaaatattacaaaagatatgtactgcttttacaataatcagcaaatgggaatgactttgaatttcagaacacatatgggaatgtcatcaacttcgactttgaaatgtggctttttaaaattaaaatataaatcattctattgttaacaaaagtttatcaaaagtaatagggcttttgtagatttttggtttttcttttctattaagatctttactggtagagaaaaataaaattttattaattcaaagattccattgtgtttttatgtttgtgagtaataatcagtggttcctggtatctcatttcgtttttaattcccaaagcaggagctaataagcaaatcgctttgtgggtttctgtgaaaacagctagagtttgcacaatcgtcgcctagacagagggaggagtgtgggctctgaagttcagcagatttgcatttgactcttgactctgtgattagctgggtgtccttgagtaaactactcctgtaagcctcagttacctcatctgtaaaatagggatgatgacatctgctcaaagcgttgctgttgagtaattaggttaaatgagataaaaagtgcccattggcacctattggaactcagtaggagctcatgtcttcatggtgtgtaaatatgtacctggctcccatccacaagagtcctcgctgaatcaacaaactcacaagtgcctcttttcactagactgagactaaaaccgcgaattaaaatggtgtttgtcctcaagaaccactagggtcaagaattctacatggctcaggcagatcagctgagcacgtgagaaaataaggaatatgcagtctaagtacagagctcagatgaagcaacttgctgcctatcaacagaaagggtggaaacaccctggtgtgtgcaacaggcacaaatcatgtaattcagtaagtctacaaatatgtagttaaagaaacaatataatttctaaaagcagtctcctcgcagcaaactgtgaagttagcagcacagaagcaaactgaggcagagtcactggattggagacaagctgatttgtgaaagctgcttgagtaattgaccaacctctgcacaactatgttgcagtttactaaaccagtataaaggagaaaaaaagcagtagaaattaagagcattcgttaagctgtaagtcctttcattcttttggatatattattctaaatgcatcttataacattttcattaataaactgctgttttaattaatgatgaggtctcagtcaactgaatgacatttctttcaagaagcccacttcatacgcacacaaaagaaccctgaaatttttcactaaaggaaaggccaatgtgatccaactagttgaagaatatactattgcaattaaaaaatcatttaattccattcggctcaactcaatgaacatttattgaatatctgctggaggccaggggctagctgggattagacacagttcttcctttcagaaactcacagtctagagagaagcctggtgcatgaataaggcattcacctttaacctccttatccctgttctgttccttcccttctcttcctggtaaggcacgcttatttgcaaaagactttctacatgaaaaaaatatatatatgcatataggcatatacacacacatgtataaatattcatatataccctcaaagtagtttcccaaaattacttgtgtgtatacaaatattcatgttcatatatatatttttttatagaaatgggactatggtgttgtattaatgttggtttcctgactccaacttgctctcacatggttcaggaattacatataatatatattataatatatttaatatactagatatgtaacattaaaaattattttaattatatataatataatgttaaatataaatatatttaaatttttaatatttatatttaaattttgactaccatttgtattatatctaaatataacatatttaatatgagagagaaaacaaatatagtgaaatgttaaaagttagggaatccagatatggatgatataggagttattcatactatttttacaacttttcaaaattatttcaaggtatattggtcttgtaaaaaattttaaaataagggattcaagaccttcctggcctcaatcctgcctttcttcagcagcacctgcagccgtacatcaccccacatttaataccaagttatgtccaacatcctcccgctgtcgttcctgacgctgactgcacattagactaatctgagaaaatgctgaaatatgccaataggcaggcctctccccagacaatcagatcaggactcctgggagtttgctccagccatggttttttccaaaaacatagcctaggttgggaagcctggaggcctgtttcccaaacaccatgctgctgcattcctcatgccttggtgcctgctgtttccagtacttggagggtccttgtccacctcttcagtactgtagattcctattattttgtcaggatccaactcagatgtcgccttccttagtgaaaccatccaggcatcccacgccccacccacaggtagatcccatccttcccgcctcctgctatttatttctacacactctccttctacaggtttcccacactgttgtaatgctgtgtttgctctgtctcccaacccaccgcaaactccgtttgggaaaagtatatatcatgtttgcttttgtcatcagcatgagcctcacatatagtaggagtctaagaaatgtttactaaattaaatgcaaacaaggttatacttgttggaataaagttataacaaggagctatgggacacttgaggatgtgcactcttacagtgcaggcggcacttgcggaaggagatggagctcacgcagaatcgaagagtgaataaatagctaagtagtcgggcaggagagggaaatgggaacagcccgcctcttaggctggctggagccacgtggagtacgcgaaggagaatggccgctgaggccaagaagggagccagtccagacgatgaaggggaccaagagcgttagtcactctggaagcagagtgagcacctcgcactgcgctggcacacagatgcctctcagtcaagcattttagagaaataatgagtgaattcttttttgctctttttctttacatttggcaggggagtcatgggaccggattgaaactaactttcttcccagaagaatgtatttgcacatactttcccgaaaatgtcagaagatttacaggttttctgaaatgtattcagtgacacttcccccaaaatgatatgccacattctaagaagagggatatattttaggtttaagaaggacatggttagactaggatgtaaggcgggtcactgaaagtctgtgaaggacagattataggaggtaagatgcccattggaggacaccctttaagaagtcatcacagcgtggtggctcacgcttgtaatcccagcactttgggaggccgaggcgggcggatcacgaggtcaggagatcgagaccacggtgaaaccccgtctctactaaaaatacaaaaaaaaattagccgggtgtggtggcgggggcctgtagtcccagctactcagagaggctgaggcaggagaatggcgtgaacccgggaggcggagcttgcagtgagccaagattacgccactgcgctccagcctgggcgacagagcgagactccgtgtcaaaaaaaaaaaaaaaagaggtcatcacaggtgccaaagtgaaacccaagtgcctgaaccagaggcatgacagagctgtgcccaagagagaacagatgcaaaaggttacgaggcaatgcaaacagagagcttagggtgtctctaggctttctgcctttgagtgaccatgcagatgcagtgtcattggtcaaactagaaaattcggggagaggatcagatttgtgggaaaggatgaattccattgtgtgaagcttgagtttgggtttcccatgaaagaacaaggcggagtttccctacagaaagttgcaggttgggagtgatggagatgaggctctcctgatgagtgagtatagagtgtgatggaagaggagcactggagggaaaacctcagtgccccaacattttcaggatacacggaggaaaaagagccaatgccttacagagaagctgaaagaggggaaaggaaaaccaaagagagtttccaaaggctccaagagttgagtaaatcaaataagggcagaagtggtctgttcactttggtaactacgaagttcatgaacacctcagtgacagcaacttcacttcagtgaatggagttcaggccaaaatcaatgattaggaagtgaaaatgaggagatgagaaggtttctagaatttccccagttagattgggaaaatctaactggacctctgaacagcattctaacctattggtcagctcctctttcttgaaaaaccctttttccttggcctcattcagacctcgtgttcaaggggtccccggggtgccctaattacttcctctctgttcttcctttgcaagctcatttccctgtcccagtttgaaaagggtgacttctcagggccctcctgtcttctctcttcacacacttctcccagggaattctatccatgcttgcattgtaaataccatcataaaaatgattttaaaatgaatatttcagcccagacttttttggctctttgacttctatgcttccctgacacaaaggcacctcaaacttgacctgttcaaagctgaactttgttgttgttgaaacagcatctcactctgttgccccagctggagtgcaatggtgccatgatgggtccttgcagccccgacctcctgcactcaaatgatcctcccgcctcagtagctgggactacaggcttgtgccaccacaccggctatttttttcttttcttccttttttttttttttttttagcgacagggtccccctatgttgtccaggccagtcttaaactccagggctcaagcgaccctcctgccttggccttccaaagtgctgggattaccgtgtgagccacagcacccagccaaagctgaactcttgatacctgccatatccccaaccccaccaagattgcctgcctctgtgttcccataatcagaaattgtcaccaccatctatccaaaaatccgagtctgtcttaacactctttccttcacctttttaattcctaaacatcatcagattctgtccactctactactccaaaccatcattatatttattctgtcccattgcatagcctattcaatggtctacctatattccctcttttctctttccaatgcattcaccaaaatgcagccagaatgagctttcaaaactgaaatcagattatgtcacctttgcttaaaacctttcaggagttacccgttgctttctgtgtaaaaaccaaaatcctcagaataccacgacctttctatctagcctcacttcctactatggtctcccctgagggtttgtcatcttggcctccactacgttcatcctcgacattctcttcttcctcagagcctttgcacatgctcttttctcttcctagaatactttccctacccccgttaccagcaaaatctcactggccttcaattattaacttaaatgtaatttacgacctgctaaatctctgtcagctcatagttcacagatggcagttattacatatttgaaagaatggattaaaaagactgagtgctagccagaggaaaatagaggttcagggtaggggggcctttaagatgagaatgatttaaagcccacagcaatgaaatgatttgcctggccaaggtcaaaaagcgagttggtggcaaagccagggctgcaatccacgacttttgattcttggcctccccatgtcccacactaatcctttattatatgtcttagatgaagttagctgtagtgaagccctcatctcatttgctgtccccaaaacattctaacctgttgaccaccatgcacaacaggaatacgtattaacacagtttcaggagcatgacccaggaaattctataatagatgcaaactatcttcctgtttaagaccctagtagagttgttcagtggtgctgctcttaaattccaatccaagaaggccacccggctcccacacagtcaagccatagctgattgatgtgtttacagtaatatacttcacacttgtgtcttgtgggccacacgtgccactcaggataaacttagagatttttctttggcattttttctccattgtacagattcagacacttaaagcttattacatagaaactgacctagaagtgaccgggcctttggagagaatggcaggaaattggttacaatagatatggacccacctggggaaacagaactagcagaggtgaacgttaacccatcccaggtccaatgttgttagtccaaaaagattacagtaagttgaagaaaacatcaaacaaacagaataaaaaattcagcaaggaaattcagagtggtacacttggggagaaaaagcagattttgccaatgtaagaccaggagaaaaactggttgtgtttcagcattgcagtatcttgggagaataacaaaacaagtttaagcagagttgtgccatgcagattgcctggaaggaaccaggcctgcctgatgcagaatcatgatgcatgcagaggatgatgtccaaggtccccgggagcagaactccataaaattcacttaactcttttactaggtgactaattaaaaagcagttaatgagagtgatcattctgggcaatggaattcagccatgaaagtggttaatgacctgaggctgcagctcagttctatgcctcctctagcatggttctggctcccaggagagcctcctagactttagcagaagctgcacagagcttcaagaatccaggatatctgggaagaggtaggagagcgcattgggcgacagaaaggagtaagcaaatattaaagggtttatttacagcagaaggtaaaaagaaagaagctcaccacaatgggagctcaataaatgtggtttgcttgagcgactaccttgctgactgaaggagtggatagagcacgtgcatgaggcagcttgcacagtctgggagacctcgcttctcagctccttatttaatgacatcatgttggtagcttgaagtcggacaaggtggcagtattgacatcatgggaaataggcaaaaactataaatcagaatttttccctccccctcaagccagttgcttaacatctaccaacttaccattgggtcacttcgttgaaatccctgtgggagcagagttccctggggttcttaccttaagaataaacctgaaggcgttttggttttgctttcctattttaattactaatatacagtggcactcttcagtaatcttttattacacaaccagagtggctcagcatttgtgaagtctcctggcaaactcaccatcatttaaaacattgtttctgtggggaagttttccaagttgcaagttactgagtctaaaataaatttttggaaaagagcccatttgcaagttgggagctttcaattctgagtcctgataggaaagttagaaaacaaaaagaatcatgccaattttaaaaatataggttgcaaaatataggttgcaaaatcctaagtgaaaaggcaaaaggaatagaattatttaacttggagaagagaaagatgaagagcaattgaataataggagtgagtgccagctgttgtttgcttttggtttctgttttttgtgggtttttttttttctcccactgtaagcctcggggatttggttaaacaaggagataaatatctttatgttattattctggaatgaataattggtggattttatgtcaaacatctgcaaacttcttttcctcaatcagggataatttacatataacctgtgatgaggaccaagaaatagttaagacaaggttatttgtctacttgaaggttaactgtcaactttgtgaccctgagtccacagatggcataatgtatttcaaaactttgagaaacatgatataattaagcaaatcctttttatatcatagaatatctaaatacagaatttattatttttctatcaaaaatgattataaaacttagactattagcattatctatagtagtattatattgtctatatctgttagtattgtctattactagtatctatattactagtacaaaaccttaaaccaagcattctaaatcaatactttttgataattttacgagggaaatgatgctattttgggcttgttaatttagagttattttcagttattcattcagaagagatgagagaattgctttcttttagaatatcttttagatattgcagtaccctgatttggcattttcttaaagagatgtgaaacaatgaaatggcagctgtaaatctgccacttggagccttagagggcttacatcactcccaggctttgctttaacagttggtttatgatgtggtttcagaataacacttttgaacatggtatatcccttcctgcaaaactgacataaatccataaagcttttaatgatgtctctaaaatacagccaaagtagtctctgaggcatatttttggattgtttatctgaaatctctagattgctgaatctcccttcatgatctgccttggaatggctgtctccagggcagctgataaacgcatcatgtctcacccaggcggggaccactcagcttcgtgccccatcaggtacactaccctgcctcagctttcaccccaagcatctcacacccttgtgcgcataagtatcacctggggacctgcgaaaaatgctgcttctccagaacccctgagctaaattctgggactaggcctggggaccagcattttaacaggctcccaggaaagtggtcacagaaatgatgtgagagtctcagctctacatgctctctgactccagttctggcttcgggatggagtaactggagagaggctgacaggtggaagctgaggttcttgccggtgacacgctgcacctgtcactcaggtgctggggtctctgctgcccagacccttccctccctaggccaggttctgtgctcctcagtcttgaatttcaagcgcctggtatgcgtgtcttctcttgcacatcatcctgcctgccccactgtgattcatttgaatgccccagcctccatctctagcctgcctcccaccctccctccaagtcccaggtccacctcttctcacccccgccagagcctgttctcaggtaatgaccccccacattctctagcagaacctctctctgtggcaaactgaactgctcagtgtgttttctccaggcggcccgccctgcctgcccttcctgactcctcctccctcccctgtcctctgttagacacatttacagaagcctgtcctaggagtgtccatctgccccatcagactctgaactactgagggcaggggtcacctgtgccttgctcacgggatccccaacacccagctgaaatgtggtgggagcctcgggggtctcaagtgaatgactgattcttaaaaagaagcacgtgaagtttgtccaggcggcatgatgcctcagacttcagaccctctcactgccaatacactgtgccttcagctagaaagctagtcttcatctccgccacctacctgtacttggctacccacctctggccctccaggtcccagcttagatgtcttttcccacagcaagtcttccaccacccctgtgttccagggggccctgtgtctacctgatcctgcacttacccctctgcattctaataatctgtttacctgaatcctcctccaggtccggagctccttcagagcaagagttgtcagcacccagcatcgtgcccagggtgcagtcagtgctcaatagatgtttgctgaaagctaactcagcacatttaggtagtgagatggggttctcatcacatagctgctaaataaaccgccataacattcactgtattgtactcacactgttgatgcgtctcctcccacaaccactgctagatggaaatcttctcatgggaagtgattgtattttgttcatcttcacacttcagtaagtcaggcagcaatgagcatggattaagtagctgttcaatcctatgttttccaagaaggatagttttggcatgtggagcaggagaattctttttttatttttatgtatttatttatttttgagatggagtctctctctgcggccaggctggaatgcagtggcggatctcggctcagtacaacctccgcctcccaggttcaagtgattctcctgcctcagcctcccgagtagctaggactacaggcacctaccaccacgcctggctaatttttgtatttttagtagagacggggtttcaccgtgttggccagaatggtctcagtctcctggcctcgtgatccgccagcctcgacctaccaaagtgctgggattacaggcgagagccaccgcgccccgcccaggagaattcttaattgcataagacagccccacacattgcaggacatgctgctgtccttgcccgtgcccactaaatttcattggtatcccaatcattttgacaactaccccacctacacacacagttacaaaagttttgggggtaagaggaccaggaggaaaattgcactgcacatagttgaaaagctatagttaagtcttttccttacaacttggtgagaagcaatggactccgtaacagtgccatggtggattatatgtgtcaacataattaacagaaagaggatctctgaaatataagatatttatctggaaataaagcattgcaatgggaatatgcatgccatagttaactacatgcatattcagggaggtgaagacaaaagtttttaaaggaaaaaaggaggaggattacataattgttttaaaataattatccttggctacaaagatcaataacaagggtgacaccagtccaagtttggacaggcaaattcagggcagttgttcttgtagaaccgtttttttgtgtaaggttgcaatggtgtttgggcaatgttgtgctttttgcagagtctctgtgatagttcttttgatcaggcatttattcatggccttccccagctccatttctcagggctttcttttttttttttttttaacattagtgacttcattttgattctgacaactttcacacatgtgtgtggtgatgtgaggtgggggccaggacatgtcaccctcaatatacaacggtaacctgtctttgtaataatagttcactaatctttcctgagcacttatatattccgggcactaagctgtgtattatatagtttacttaatcctcacaaccacctatgaggtcccattttttagggacgaaattgaggctgagaaagtttcaagacattgacccaagttaacacggctgctacagacaagggcaagatacacccccaggcgtcggacttcgctgctctgtgccgacctctttaacaagaacaaacatcaaaattcccagttggaagactcctattaaaaactgtcctctcccattaattataacgtagagcagttttgcacaatatattctgcatagtgttaatttagtgggatgtcaagtgttgtgagattaacggttgcatgggcgatggagtgtgggaaatgctttcagcaaggcccttgtagaaggccgtgaaacagaaaccgtgaagaccacaggatccctaaggtggcacagcccttcacagtgagtcggagtgatttagaacattgctgagcaaacagcagggagaccggcaacaggagcttgctggccatgaagtgcctaatatccagtaagcactgctcaggctctaggaaaaggctgatgcaggaagggtttctttcttctaatttctcaataataataaaaatagatactatttatggagtactaattactctccacttcatagatgaaataccaaggcctagaaaaatgtgttaagtaacttctcctaaggtcacacagctatttagtggcagagccaaatttgaacccagttctctctaacttcaagacatgtgattgtaaaccctatacacaaagtctctaaggacgtagggcttataaaggctttcctgtatgaatatccaagcaaattcagtctcaaagaggatgcccctatgggttccctgtaccagggatttatttttggcatatctcttcaacctgacaattcgttccttggtctgagtacatgaaatttttttcagggtatgtgaatttttttcttggtatgtgaaatttttttctggtataatgtaagtttcttaaattttactatttttttaattttatagatttctatatgatatggtttggctctgtccccaccctaatttcaaattgtagttcccataatcccctcatgttgtggaagggacctggttggaagtaatttaatcacaggaggaggtctttcttgtgctgttcttatgataatgaataagtctcacaagagctgatggttttataaatgggagttcccctgcacatgtgctctctcttgcctgccgccatgtaagacatgactttgctcctcctttgccttccaccattattgtgaggcctccccagccatatggagctgtgagtccactaaacttctttctctttataaatcacccagtctctggtatgtctttattagcagcgtgggaacagactaatacatcataccctgttacatgctttttttttttttgataagagtatttgtgttgatgcaatagcatctttctccatagaacttactcagatgcccttcctggagccagtgcctgcactccatgaactgctggagaggtcattgtagggtatcggcatcagacctctcctcatttttcaattctctctctcctttataacagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggtaaggacaaggatacccagcctctgccatttaacatttgggcagacagaatgttctagcaagagtctatagattgttcttggtttgttatttattccccataggcttttttaagcaagtcacataacttctttgaaccccatttctctccatgaatatcaggaaaacaacttgccagctgggtgtgttagagcaaggtgttagagtaataatgttggtgaggcatgttgcgttctttacaagaatgctgttgcatgaataagagatatgtttgcatgtgtaatgattattttttctccctactaaataaacacatttggctggacactgtggctcacgcctgtaatcccagcactttgggaggccaaggtgggcggatcacttgagctcaagaatttgagaccagcctggccaatatggcgaaaccccatctctacaaaaaatacaaaaattagctgggtgtgatggcacatgcctgtagtcccagctactcaggaggccaagatgggaggatcacttgagcccaagatgtcaaggcttatagtgagccatgatcgtgccactgcactccaggctgggcaacagagtgagaccctgtctcaaaagaaaaaaaagactaataagaaagactaataaaacataaatacattcactaaatgtgctaaacagagatgggctttgaatgagtaaaattaattttacataaattaattttatcctgatttatgatagtataccagtaggttgttacagaacatctgaactttcaataggagtagaaaatcagaaatgtcttcattcccaatcctctcagaactttaaattcacaaagtgtatccctgtcataaaggttgcttaaagcaggagtttattttaattttttttgaaacagggtcttgctttgttgcccaggcttgagtacagtagcaggatcacagctcacttcagccctaacctctcaggctcaagcgatcctcccacctcagcctcccaagtagccgggatcacaggcacataccaccactcccagctaatttttttaattatttgtagagttgggggtctcacgatgttgccaggcctggtcttgaactcctggactcaagcgatcctcctgccttggccaaagtgctgggatgacaggcatgagccaccatgcccggcccaggggtgtatttttacttgtaatatcctgggccatcttggtcgtcaaacacacattaagccagagaggatctgagtgcacctaaaattggcatcctgaggagaatatgcaaatgggcttgtgacccttcagcagtgacctctgagagacatctaagaagccctggagtgtacaaacttgctgaacttgagaagtccacttcctctctgaaaatgaactcatataccttagaattctaagatcactcttttttttttttttttttttttttggagatggagtctcgctccatcaccaggctggagtgcagtggcgcaatctcggctcactgcaacctccgcccctcgagttcaagcaattctcctgccttaacctcctgagtagctgtgattacaggcctgcaccaccacgcctggctaatttttgtatttttagtagagacagggtttcacatgttggccaagacaatctcaatctcttgacctcgtgatccacctgccttggcctcccaaagtgctgggattactggtgtgaaccactgcgtcagccctaagatcacttttttaatgaataaaaatattttaagagcatgcaggaacaaatctctctaactcacttcccattggagccgaaaatatggagactctctctcccactgcccattgtttcctgcccttcagtgattattccactgttatggcatcttaaagagcaagaattttggctgggcactgtggctcatgcctgtaatcccagcactatggaaggctgaggcaggaggattgcttgagaccagtagttcaagattagcctaggcgacatagcaagacaccatttctaccaaaaataatttaaaaattaactgggcatgaaggtgcacacttgtggtctcagctgctcaaaaggctgaggcaggatgattgcttgaggccagtagttcaagactagcctgggcaacatagcaagactccatctctaccaaaaataattttaaaattaactgggcatggtgaggcacacctgtggtcctagctactagaaggctgaggggggaggatcgctggagcccagaagttgctggagcccagaagtgcaaggctgcagtgagctatgatcacgccactgtactccagcctgtataacagagcaagaccctgtctctaaaataaaataatttaaaaaaaaagaaaaaaggagatcaagatttttcccatgggagctagaactgttattactaacttaattcagcttgagttttaaaaaaacagtaaattaaactccctctctaggaaatgcactgttgcttaaaaagatggaggaaaaagtatgttccctagtattttccccttctgaaattattcctaaagaaataagccaaaagtcaaagattcatcatgaagatgttcatcataatgtttcgttttgttttttgagacggagtctcgctctgtcgcccaggccggagtgcagtggcatgatctcggctcactgcaagctctgccttccaggttcacaccattctcctgcctcagcctcccgagtagctgggactacaggcgcctgccacaacgcccggctaattttttgtaattttagtagagatggggtttcaccgtgttagccaggatgatctcaatctcctgacctcgtgatccgcccgcctcggccttccaaagtgctgggattacaggcgtgagccatcgtgcctggccaacatcataatgttaactatgaaaataaaaattgaaaagaatctgaaagttcaacttttagtaaaatagtaaaagagggagttgccattttatggaatattatgtatctattaaaatatttatgaatcgtgattaatgatatggggaaattttatgtatgttaaaccaaaaaaacatgaacaagatccagccttgaatgtgaaatattagctccataaaaaatatagggatagaaaaaaaaaagcaataatgtgaacacaaaagtgtttggttggattgtggatgatttttttttctcctgagcagtacttttgtatgcatgtcaaatgctttaatcagaaagatgaaaacagtaagtaaaatcagaaagtgaggatgaaagagagagaagtatggagcccctggtcttcaggagttcatcagtttatttctcctggatcagggtcaataggtttttttgacccactgatgttcactacccacatggaccagcctcccactgggcagataagaaccttgggtttcttctcaggtccctccccaggaggagggctctcacccagagactgtcaagaagttggtgaacacattcccacacatacttttattgtctgctcctcgagtcactgccacactagatttggtcctcaactgtattcgctacctcacatgcccactgctacacacccaccgctgctgtgccttcatcacctgccactgctgtgccctcatgcctgtgtgaggactttcattgtcttcaagggcgttgatcaatggattctgtattaatggccaccatttaatgaagctcactttgtgcccaaagccatcctgaatggtgccatgcattaattcccatgagctgcacaactctatgaagtagatactattattatttcctttctactgatggcaacacatgagtgcatggaggttgagtgccttgcacactcagaggatgttgggccaggctggggtttctcagcctgggtgtccgattccagacccaaagctccccaccggctgtactctccagggcaggcatctctggaactctcagtgttcttggaaggcaaagctgggtgggttctgtctcactgttacaagactatcctcaaactgctggtgaaaattcagctttttcagacttcaaatacaacatgtttttattatttgaagtttaaagttagaaaaaaaaggaaatcattaggaaaaaacatcagtaaggtctacgccaaagtatcaggaaaaagctactagaaagtctccactaaacaccctggcatcactcacatttcacatatcgaaagctctgctcactgtcctccagaaccagctgcccccagcaccaccactgcccatcagacacttgtgttcccaaggtcagtgtcactcaccagtgctccgttcttccctgcttttgtgggtcacccaggcaaacaagtcctgtgaattgaactcatggtgtccttttcctccccaccactactctctgaggcaaatatcttttaattcccagtagtgtttacgtcatggtgtccatagaaaattattatatttgaatggtaccagggtaaatggatgaggtcatgttttggaggccacctgcccagtgactccagctgccatccccttcttcatgtctgccacggtgtgaggggagccttgctcctggtaccccatcacccatctgtaggacagccgtgggcttcagcttgttggctgggaaattctctcccaatccatctctctgcttccagattctccccctcaccctttttcaccacagccagcaccgcctgcctttatagggtgtcttattttctgttgcttgtaacagaatacgtgaaactgggtaatttataaagaaaaggaatttatttcttatagttatggaggctaagaagtctgaggccaaagggccaaacctggtgagggccttattactggtgggaactctctgcagttctgagacagtgcagggcatgacatggcgaggttaagctgccagctcaggcctctcttcctcttcttatagacagtcccactcccatgagaacctgttaatccattaacccattaatccatgaatctatgaatggatcattccatgaatcgatgaatggatcattccatgaatcgatgaatggatcattccatgaatctatgaatggatcattccattcatgaggacagagtcctcatgatccaatcacctcttaaagggctcacctctcaatatacccatattagggattaagtttcaacctgagttttggaggggatattcacaccatagcatagggatattgcttaaaagggatcttgtataatgtctttattaaacactcagtggtgccccactccagcaaaaccaggagagactcctcagtgccacaaacttttaagtttgagacccaccaagctcatgggtgagatggtggcctgtagagctggaccgtctgggtttgaggtcggctttgccttttgtcagttgtcttgggcaatcagttggcagctccatgcctctgtttgctcatccataaaatagtgtctccctcacaggagtgttgtgaaactcaaatgacaatatgcatgtgtcaacagttattatttcccaggtccacggattcaatctacattctaacgcatattcagcaacccctactcttcgttttgagaaactcattacccctcaagcactctgtggtcatatgtgcacctgactttatgcctgcaatactcccttacctagaaatgccccaacttcctctctagccagacacctgcctttcattctaggctgagatcaagtcccacctccttttgatgacttctccttgctttaaactcctattccacttactttcaatgtcatttgtttggcatttaatgtactgtattgttatctgtctctgtgataaatatgccctgtcttcccagagagatgaaaagctcccagcactacatctcctgcctacgatcagtaccctgtaagtgtgtgctgatgataatgatgatgaccaggagagaataaatctgttaagcatgttatttgctgcatccaataaaagagaagtcccttataactgctttaattcacttgggagatgaacatgagacacagaagtgaagcacctcagcatttgaataatgttttattttaatggacaaatactagcattcttcctaccatcatttagcggtcctcttctgctgttatctgaaaggaataaatacatcatttaaattggattattcaagaatatcaccattactgtttatagatagtcactatatataaatttaaagttccaactcatctttctttctcaaagccaataatttctgctgccattaagtgaagcagttataggaatttaaaatcatatttacaaagtccaagaaggacagaaaagaaaaaaaagagaaaacaatgctgattttaatagagctgaggaacataaaggggccagtgacaaagtgacagcagagaggaaaatgtccagcgttttgcataattgccggttcctccgacctctaggcctctgtgtgtttgtatcctcagagccacacacatattgcctgacccatgccaggggatgggcatggctgtatgtgttataagtggactctacacttgtaaccaggcagaaagcctattttcagacctttaaaaaaaaaaagctgtgctttgcacaggaactaaatatatgtgttctgaagaaatgaataagagatgaatcaaggcagctgtatatttaagaaaactggctgggatgatatgatgtcagagcaccagaaataaggcagagagtaaaaacctaagacaatcaacgtgttttttctgcgtgttgccaaacaactgcctgatcatctccgtcattcccaaacaatggactattttaatgctattgggtaaaggaaaaaccgagtaaacactgaggggtggagagagaagcagctcaagaagtaggagcagcatattcaaaggccctgaggtaggaggagatcgtattttctagggaataagagaagttcgtggtagtttgaatgtaaaaagtgacagtgagtggtatgacttgaaaataaagtagcaggaggaatgcacatcagacagggcattgcaaccgctatttggaaagtacatctttattctgtaaagaattggaaggctttgaaggattttaaatgacccaataaaataatcagttacacattttgaaaacatggggaagaagacggtacagaagcagggagactgtattcatctgttctcacgctgctatgaagaaatacctgagactgggcaatttataaacgaaagattttcattgactcgcagttccgcatggctggggaggcctcaggaaacttacagtaatggtggaaggggaagcaagcacgtccttcttcacatggcggcaggagggagaagtgcagagcaaaggagggaaaggccccttataaaaccatccgatctcatcacaactcagtcactatcatgagaacagcacagaggtaaccaccctcatgattcagttacctcccactgggtccctcccatggcacatggggattatgggaactacaatttaagatgacatttggatagggacacagccaaaccatatcagagaccattcagtcatttattcaacaaatatttattccactcctactgtgcatcaggcactattctagacattgggaatagtcataaagaatagaaacaaaaattcttgctctcatggagcttatctttgaataggagaagacagacaataaacaaattggtacaatctatagtatgttgtgtgctaagaactgttatggggaaaatatgaggcagaaaagggagggcctggccaaggggaaggagagggtaaattccacttttaatgaggaagtcacagaaatgatcactgagaagaggacatgagagcaaagacctgaaggagtgagggcatagccatgcagagacctggggaatgagcatcctgaacagaagaaccggtgactgcaaaggcccttgggtaggaacaggaagccaatgtggatggtgaggagtgagcaaggaggagagtaacaggaggttaggtcagcaataatgaggagatcatatggggcctggtgagccattgcaagaagtttgatttttactctgagacggggagttactgggattttgagcagaggatcactctgaccaccgtgtggtgaggacactgtgtatctcagggtcagaggcccagtgggatcagggaaggttggagaaaggacaaaagctagtataatcccagcaaaagacactggtggcttggtccagggggtagagatggagatggcgacaagtggtaagattcagggcatattttgaagatcaagccaagaagacttggtgtcagatgacacatgtcatataggagaaagaggacagtcaaggcttttggcaagaataactggaaggatgaattggcaattcactgaaatgtggaaaactgcaatggaatacttttggggagagaagatggatgttctgttgcatatgttatgtttggggttgccagtaagatatctgagggaaaatatcaagtagacagtttgtgaaagagtctcctcaatgccactgtgtctcctcaaatgaatgtgctgaaaagttatttaactcactcttagtaagaaactactcctagaatttattcattaattttcaaatgataatttcacacttcttgactggaatatcattttgaagattgctgataagtacaggtgtttctgtagcttattaataaaaatatgctattattaaaaaaaaagagtctggagttcaagagagaagtctgactagggtatgaatgtggtgtctgatgggcatacaccttattcaaaggtcctacataggataggattgttggagtaggtaggtagacacacgagcagggcagaagagggtgccccctcccaccaaccaccaagaatgtcagacaaccatcaggtgatggtcaggcagttgctaaactgtctctctctaaaatgataattggctgcagctggcaccaaggaacgaccgtctcccaatagatagaaaacatctggagctggtgatcagcagcttcccaatcagatctcaggagttgggcaagcgggcccaagcatgcacactaagaggcaaaatgatggagtttaacgggtatatgaccttcctctaggaacactcaactggaaaggggaaaaaaaatgcctcaaatgagcatgcgcactacttcagtaaacacctgtgcatgcagcccctcccacgtgctcgcaggccactgcgcatgcagacagcccgccccaagggaagaatcaggggagaagaaaccaaaccccagaactatgccaatgtataaaaccccaaatcaagggccaaacagggcacttggatctctcaagtcgcccgcttggccctcttccaagtgcacttcctttctaaaactttttaataaactttcactcctgctctactaaaacttgccgcagtctctccctctgccttaaacctacttctgcccctcaagccgcattctttcctctgaggaggcaaggatcaagtttgctgcagaccctttgggattttccttcagtaacaggatcaccatggaaacaggcctgaatacaaaagagaatatgcttcagggctggtctttggggactgcaagagtaaggtgccccaaaacgaggggaaaaacaggtagagaaggaaaaccgaaagagtgtgtgctggaagccaagtgttcccgggaggtgaatgaattctgtgccgagtgaagatgaggcctgagagggacaattgcctctacttccccaagggtcacgggcccagcaagagaccgtggagcagggaagacagaagtgagacagagggctcatgctaaaatagggacgggtttggaggcagcaagtgtacccatctcttttcatggggttcggagcaaagaaaagcaaaggataagaggcctcacttgagagtgaaatgaggtcaagagcagtaatttttaaagaggaggctgactaagacccaccatcttctgcaatccaggcagaagatggtgcaggtaaagcacaggtgaggatgaaccaggagctctgtgtggagctgcctcagccagggagcaggctccctctggaattcacacaaggacactgtgggtgccaacagaaagcctgtggttaccgaagtggaaaagagtgagggaatttagatagatttaggagacgaaaatccaatccacggtgcttagttgaaatgccaggggcaaaggagtctaggatgacattctaaggtaaaactcagaaatagtgaaggtttgttgaatttcgtttagaaaacaaatataggaaatgtaattagctcttgattattctaacaaatgttcctttgaaatccaggaacatggcaagtgtaatgttaggatgcctaaataaggaagagcacagcgtgtgtgtgtgtgtgtgtgtgtgtgtgtgtgtgtgtgtgtgtgtgtgtgtgaaagtctggaaggagctactcccaagatgtttagaaaaattatctttgggtggtgggatttcaggtgactttcttttattttttttctgtttactttctatgttttaattagcatgttttattttgtaacttaaaatcagaatatcagttttgttcccctaaaaaggaaatgaaaggtgacaaataatccattaggtgatttgcagttggtcaaattcttgctagattgctggctccatttttaagctctgagatatcaacatgaaaattccaatttgagtaacaaatgagataaaatattgatgtctttaaaactcataactaagatataatatttatgcttgcagattaactaaaagcaggatctacattgtcatattagttattttcaatattgttttttattgttgggacgaagcaaggaggaaaaaaagaatatactgttgaggcaaagtgaactatcattgagggcaaaaagggactcaggggaccagggaaagccatctttcctgttgatttgcatttgattagtctgtaagctaaaataaaatttattacttggtctcaatgaggccacccaaaatctcatctttaagaactatgtttggccaggagcgtcggctcacgcctgtaatcccagcactttgggaggctgaggctggcagatgacgaggtccggagatcgagatcatcctggctaatacggtgaaaccccgtctctactaaaaataccaaaaaaaaaattagcccagcgtggtagcgtgcgcctgtagtcccagctactggggatgctgagacaggagaatggcgtgaacccgggaggcggagcttacagtgagccgagatcgcgccactgcactccagcctgggcgacagagcgagactctgtttcaaaaaaaaaaaaaaaactatgtttatttttaatattgtatgctcatgattcttttatatgcccaatgtcacactttgctgacggggtgagaacatccctgcactctgcatttatttttttatttcacatagtgtttcgtgggacctgcagatgtctcctccctgcagtcctatattgtatatgctctcattctttgtgtccaggcataatcccaacttggatcatttaaactatttgcatcttcaactttgagacgacagtcactgaagttcactgtgggcagattgtaaatatgtgcgagcctggtgctgtcagccgatatgggtcagtaggcctctgagctcgtgaatccaaattcaaatattgaatgttatctgtggacatcaagggagggagtaaagtttaacagaaattggatgggcatggtggctcacgcctgtaatcccagcactttgggaggctgaggcgaacggatagcctgaggtcagaatttcgagaccagcctggccagcatggtgaaacccccatcactactgaaaatacaaaaattagccaggcgtggtggcaggtgcctgtaatgccagctactcaggaagctgaggcaggagaatcgcttgaacctgggaggcagaggttgcagtgagccaagatcgcaccattgcactccagcctgggcaagagcaagactccgtcaaaaaaaagaaagaaaagaaaagaaaggaagaaagaaagaatctaagagcaggaattgaggggatgtgacattaaaatgaaatttagggcaaacaaattactgagctttcttttttcttctataggaagcttacagattcgatacaacctgggtggcacccgagagccatacaatattgacgtagaccacaggaacatggccaatggacagccccacagtgtcaacatcacccgccacgagaagaccatctttctcaaggtatacatacatgtacatataaattacatataatatcgcattatagtccctgtccctataatgcttggccattggttttgttttgaggggatagaagtagaagagatgctttttacactttctcctacaagtgcataactagtgaagtagaaatatatataattctgacaaggaaagacaatgatgaagttgaagacatcttttagggggaaatagaataaatgtttattccgtatagtctttctggttttcccagttctagatccacatatctatcaatttactgcttttatccattgcaccatctttcttcgccaagctctcagacatctgaaacttaccgtgtttcccagcaaaggttattttggtttctccgacctacttctttcactgctccaacacaatacaaagagctgtatttttctctctctctctgcagagcctttgtcttaaaaatcctcaaaacagtctttccccagaatctcagactctgactgtgggctttcggcacacaaagggatggttttattatgacactcaaattttacttcaggttcattgacgaccccggccctcaccactgatttttacagtgaagaaaccagcttgggaaacaccatgaataaaacataatgtgaggaggtctccctgggagctaggccaagacatcaaggatgggaactgtcactgcattctctagaaggagttcaaaatagatgcctgtcaggagaaagaacagcaggaggatgctgttttgtcagtaaagtggagtgtcatttggcaggggttcagcagcctctcagacctcattctgattcggctggatgctgtgggaagttcaggttgcaaagaaaaggcacaagccctatctcttttgagcactggtggatgtcagattcataacttgatatggagtttgcgcgtggcctttagcagtaaatgctagagggcattttaaggagaggcctttcctaggaaactgacatgcactgtttcagcttactgcgccatcaatcaaaggtggcataataaggttctctcatcatggtcgacagagtcccagagcccagcacagtacctggcacacattaggggtgacaaattctttatggagtaaaccaagcccatctttaaccaagttttagtcagaaaagccagcaagtccaggagacagatcgttttacatcatttcatcaacattgtctccctcggcttttgattagagactttttccattttaagccacccaatttgtcacctcttttaaagaaagtgacttatcttgccattttaccattgcgaaataatactaaaacttaaaaagacctaaacaatggcttttcagacagtataacagcagagacccaccacagccatagaatcgtatacagtttaccctcactctctgccacagtgaattagagaaagacttgaggaaggggagaggagtggatgatttttaagacttggggctttggaggcacagaaagccagagatatagacagtggagcagccagagacctgcagagaatccaggggatgaatgggtttgggggagggtctggttctattgcccaagactattttggttgcaaatgatagaaaagcaattcagaagtaatttgttggggaaaattcctagggtaggtcatagaattatagaatttgaaaaagataaaaccaaactttgggaagagaatctagggagcctggagaattaaaactgtggactagaataccactaggtttctctctcccttccttccttccctccctctttttcattctcatctctgcctctctctgaagactggattaattacctcttactgcatgctccatctttcacatatcctaggccatagtcacaggagtactgggctcatgtcttcccaattttgttaccggaagaaggggtcctagtttcttgacactcattttaaaatcccagggaatctctgataggcctggtttgagtcacgtgctcaccttgttgggtggaagggggaacaaagacccatagtccctaatcacatctcttgattagagtggggaacttgggaaactccctcaaaagaacagaatgcagttccagaaaaaggaaggagataggacgacaggagtgaaaattttggatgcacgattctgaggtaggagaggagaaaaacctgggaagtgcttcctcgattccgccctaggttctgcacctggaagtgttgggagatccagctctccctccttctctgtcatgtaatgtaactgactgcagtaagatttctgaatgtcccaacccacgtgagggcaactaggaaagatgtcacggcctggggagctccaatctctcagcccagcctgtcccatctaccctgggacctgcccaccactgagggcaaaaagaaagtaaagatagaggtggtggaggaagacaagatgtagttcctccttatggaaaagcagatcccagggcttctcactcccatgccccactttctttcatgcagggaggccttgcagacgtggaagtaattcggaaagtgctttgcaacaccaaataacactgcaattttttcttaaaacaatctaaaaatccatcttgagaacttctacagcctcaactgtgtgtggaaagagatataataaaatgttcacagtgatcatctgtgtgtgaagggattatcaatggtttgatttcctctagagttttctatttccccattttctattataagcacatgctgcatttttataatcaaacagaaatatgaaacagccatatattctcaacctattctggtagtccccagttataataacatatgataacaaaggcatttcaataatttcaaattaatatttatttatttatagtcaaagaacaaaaataaggctaatgcaaagatgaatggtagatcacagtgctgtggaatgatgtctttggaattaaggtgaatgttgatgcatttatacatgctcaaacatataatttagatgatcctcatcagtgtttatggtgtctttaaaagcaggtttactttcgtagctgggtttggctaaagctaacattaaattaatctgcattccctcagcacacaccctgtgaaacagcactgagcacttgagggaaactgaccttggatgaaacatttgctgccaaaagacaaagtacccagtctccacatagataacagggaactgactgtagtagttatcagacaccagcgtgaaccagaacccatggcatacctccagtggcatcatttgtgaaaactcacagtcgcatcagggagaatagcttaaggcttaatgccagtcaaaatataaacaaacaaggtgcagccagagagcacctgaaaaagtctggcatgcagtgaaaaattatgtcaattagcatgaatccaaaagcgaaacattctaatcaacaattccaaagccttgtgcaactaaccctttcttcttcctttccttccttccgtcttgccatccatgtttcttttccttcctattttttcctttctctcttcccaaccacattgcacaagggatctaagggggtttacagggagaatattaaatgaaatagagagttaatggaagtcacaaaaagtaagtccccaagatcgagaaaatagaacatgattatcaggtcacaaggtcttaccacttggataaatttgactgtgaacttctcggcagccagaagtatgcaacccataaggatgaactaagccagttcctcttgagaattgaaccttttgttattatatcatttttattttatttaattccatggattgtatttactgacatagaaaatgcccatagcatactccacttatacaacatcacatacacgataacagctcacatgtattggtgcttactgtgtccaaggcaacgtgctaagcactttagacacattttctcatttagtcatcacaaaaactttatgaagtatgtgccatcattattcccatctgatgtgttttggaatgtgtccctgtccaaatctcatgtcaaattataatccccaatgttgaaggaggagcttggtgggaggtgattggaccatgggggtggatttccccctagatgttcttgtgatagtgagtgagttctcatgaggtctggttgtttaaaagtgtgtagcacctcctgctttgccctcttcctccttctcaggccatgtaagacatgcctgctacccctttgtcttctactatgattgtaagtttcctgaggtctccccagccatgcttcctgtacagcctgtagaactgtgagtcaattaaacctcttttctttataaattacccagtctcaggtagttctttatagcagtgcaagaatggactaatataccatcttagagatgtggaaattaaagttcataaagtaagatgcaacctgcccaaagttagaaagcggtaaatggccacagcatagtcgaacccaggtccgtcatacttcaaagtgtacacaggctcttaaccttgcttaatagacagatgtctggaaggatgttcacaaaattttagaagcagatacctctggctggtaagaaattaagtgatgttactgttattaccataagatagttcaaaatatgcaaaaacacagagaataataaaccatatgctatgtacccaccattgaaacattacaaatttcgacattttgccctatttcttcagatttttttaaacacagcaacaattaagagtctgttgtcctcctggttacatagtgggccccaataaaagtcagagtcaatgccctcagcagcatttctgcaaatgtatttgttacaaggctgttagatgctgaagctccttgggaaagtaaagcttcccattttgaattcagcccaaacaagtctgtagagagtgaggtagagcaggatgatggacagatgaagaggccaaaggctgagatgatgcagctttctgaaattttgaactgatcctaggataaaactagctggaaaatgataatgaataaactacatgttctttgaataattatccatgacaatcacacatttttgggtttagatgtgagttagacaatagagagttcagggatatattctctggcacagatactcggaatccatattctctacaaatcaaatgaacagatggtaaggatgtatcattttggctttcatctaactagagggccatcttatctttgccaagaagaagctaacagattttctgcaagcaaaataaggcctttcttagaaaataattctaggtcctcaggaacaaatgatgattagatccccaagttcttacaccaaaaagaggatgactttgattattttcactgggaattttcaaaacaaatgttcaaaaatatcactgaattctgttctttaaaataatataagcacggtaatttcttacctgctactaatctgaatttcaaccaaattgtataaaaacaattgcatcaattgttaattgaactaggtcctgtatataaatcttaagaactgtcagagaagtgtcaaaaacattagcaacatgtagtgtgctaggtgctagaagtagaagaaaggatacaaatattaggatgatgccagttgctatacaaattagccctcaaatgtccatgttttaacccaataaaagtctgtcttacatcagatatattttcagaaaaggaaagttctctggtctccagcagtgatgaaattgtgctgggcaggcactctgaggacctgccactgccaccaacttccctgcttccccaaccctggattaggccaaattattgtccattattcttgaagccctcctgggctccatcctctgggaggctcttccttgtgtgtgttcagccatggcctcccctgaattatgtgccggataatgtgctccttacagctgtgcagcaattatttttttttttttttttttgagacggagtcttgctctgtcaccaggctggagtgcagcggcacgatcttggctcattgcaacttccacctcccgggttcaagtgaatctcctgtgtcagtctcccaagtagctgggagtacaggcgtgtgccaccacgcccagctaattttttgtaattttagtagagacagggtttcactgtgttagccaggatggtctcgatctcctgacctcgtgatccaccctccttggcctcccaaagtgctggaattacaggtgtgagccaccgcgcctggctacagctgtgcagctttaaggcccatttcctgcaggttcaaattacactaagggttttttacactcataagccttttgtggactagatctgtgctttcttttccaatacaattccctcaaaacccaaggtggcttctgatcaatttgcttctggtaagtttcatgtgctggtaaatgcaccctaagctcttccctagacatcaatcttagacttactcaatcatttgcctccaggcgcccatgcctctctctctcaaggtaatggcagctactttggggccagtggacacaaaaggcttgggtgggaagtaaagacccttaatttaaatgttacccgtgaggctaagtcagtttgctaaacagaaatcttactgccccattgttggtcaaagcggtttgcagtgttatttcttactctctagtgtaaggctctaaatatctagacttttttctattcttttcattgattattgggaactggtcaattctttcctgaactcatctgctccatgacatgaggagcaaaaagcaactgacacacacgaccattctgtctcttttgaagaactttccttaaagctacttaggcatttagtctgccttccaggttatgtgaggtgacagttttacaaaatattttattgcatactatattagtctgtcttgcactgctataaagaaatacctgagactgagtaattcataaagaaaaaaaaggtttagttggctcacagttctgcaggctgtacaagacgcatagcagcttctgcttctggggagacctcaggaagcttagatggcagacagcaaagggaaagtaggcttgtcttacatggcaggagcaggactgagagagagtgaaggtgctacgcactttcaaacaaccagatctcatgagaactcacatattatcaggagaacagcaccaagagggtggtgctaaaccgttcatagagctctgcttccatgatcccatcaactcccaccatgacctcattttggacactgggaattacaactcaacatgagatttgagcagggacacatatccaaaccatatcacataccattcttcctctgtctttcaagtccctaatattcattcctgcaccacctgccaccttaccacaaagccaatgctacatgtgttaggtttctgttatagcagcaccctgccttaagataccaatgtatgtattcgttagggttgtattcgctgctataacaaaaaatcagaggcttaatacaaataactttctttcccacataatagtaaaatgatttctagttggaaatcgtaagcaatatataaataggctgataaaaaaggtgtttgtactaatgtccaaaaataatagagtaaaagacattgtggttctatgctataactataaggctttgaaggaaggataagatgttaacctgtgaatggggggcaagagaggacatggaagaatatttattatggaagagggagaaggagagggaagatgtgtgttccaaaagagaacatgatgttaaacaaagatgctagcagagtgactatttcatagatttcatcctgtctctatctcatgaatagaaaagaccactggagaagactcagtaaaaagtcttacctggagaaattctcactctgaaatatgtaacatcaaatggtctgaagtcatttatgaatattgaatgctgtaaagtcagtagtctgaggcacatgcagagtggtgtcaaaaattgttggaagaattttatcagcagcaaaatgagagtaattcaattatggactcctagggcagcaccaaatgttaattgacgtgaaacattggtggccgggggagccctagttcaccactttctatatgtggaaaagtgtacaattgtaaggactttcacataacctcctcaagcccagagaaaaatctctgtagacttgagagggccttaatgatcatgttaggtagtgctcaaagccctttcttacatatcgaaatgcttgcccacattgccattctcagccttatgaactggaaatagctggtgctattagtcccattatatacatgagaaaacagagattaagaagtcccaggccaggcgcggtggctcacgcctgtaatcccagcacttcgggaggccgaggcgggtggatcatgatgtcaagagatcgagaccatcctgaccaacatggtgaaaccccatctctactaaaaatacaaaaattagctggacatgggggtgcacgcctgtagtcccagctactcagggggctgagacaggagaatcgcttgaacccgggaggcagaggttgcagtgagctgagatcgtgccactgcactccagcctggtgacagagcgaaactccatctcaaaaaaaaagaagtcccaatgatgaataaggtcccagtgctcacaagagacatgatcttctctagaacccagctaaccagaccccgtttccccacttagtttgctctttgttgtctttgcaagtgggcaagagaagcaagctcactcctgttcatttgccttataaacttttgaaattttttaaaaatgtttacgcaaaattaagtcttttgaggatttgtgttttctttggagtcactaaaagcaatgactttatagcgtttcgtagggggtcataaaaccctaatttttataatcaaagagaactacaaggtccaacgttaaggctagtgtttttacagcacacagtatcatacacccataaaaattccatctcattctttaagtaaatatgaacataacctcttgtctgtccattttaggatccttcttttctgtagaaacatggagcccagactgaaattagatactgaagctcaaataaattatttaaaaatgtgtgcctttattacccttgaactttctgccaataaagaacaatactaacaagcatatggatgtaaacactcctaaaaattttactatcagaagttgttcatgcctttattaaggaaaataacacagtttggaagcactaaattttttagggatgtcagaacaaataaagaaagttgacctagctagcctagggcactgctcttgaaattacatttactgtaactccttccctttggctaatttagtttttatctactctggatgataaactcacagcctgggttgtgcaatacaagcatgcttgacagaaggcaggcaattgcaagaataatgatgagccatttgaacactctggcttcttcccttccagaagaacttttacctattatagcactggctctctattgggattcttagcaagtgtattagcacttaactttccactttaatgaacgactgacatgtataattctatggagagcataggccaatattttattagtttctgatagtattacaatggtttgagtctattgaactgatatagaagatctatgggaagagaagagagagggctacatatattgggaagttgcccattaatttggtctgtatatgagtcagaattcattttttcttctatatttctatgtatccagagaagcctgttcatgattgagagacacatcaaaaacctcatgacctcattagcttttgtaatgtcgcctctggttttgggttgagctatggctcctcggcccctgagaaagtatttgagcacgttttcattatttggttcagaaagtagcagtatttgacaaaatgtttctgaaaagaggaaacaagatgcccaactaccagagcctcagattcctctccctcccagtaccttcaaaccagcttgaagttttaaactcaggccacctccacactgagaggtctggccagcccgtatgcaaggacatggttcctaggagtgtggtggaggcgtgtggtgaagatcctgctgaagaagacagaaggttctcaagatgtccaggactcttctgttatcaatgtacttctcttctacttaaagccacatggggtccctaagaatttaacatgatgatatctaattgacattctctcttacccctgcctaccactaaacccaccacatggtgagaaagttccaaacagcaatcgtttctgaagcctgatttggataaaaccagatggtcaccaaaaccattccattaggccatttactgatgtggaatgcaattaaaattgattccactttaatcaaaataactttgaggagaacaaatatgtgctgagtatctacaatataaaagaaatttggatagataatgatgagttggtggaacagtaggtgactcatacagggatgaataaaatgtatcttttacaactcaaggagtttatattctgggaggggagaaaagatgtgtccagtcactaggcattttgtcagataatagaaacctgttccacctacttctcctctagaagacagtttgacaagtctccttatcaacatgtaaataataaaaagggtatccagcaaaagagaatattagcagtttggggtggtgataaggacacagcacgtaacgagatttccccttgaggacaatgtcagtgtaaacagagaccccacggattacaaactgttgaattcagaggttattattaagacataaatttaaaagggtctttattgataggctaccttactatattagggctctctagcaggacagaactaataggatagatgcatatataaaggggagtgtattaaggaatattgactcacacgatcacaagctgagatcccacagtagaccgtctacaagctgaggaccaaggaagccagtcagattcctaaaacctcaaaagtagggaagccaacagtacagccttcagtctgtggtcgaaggtccaagagtaccaaagctgacgaatttggagtccaatgtttgagggcaggaagcatcccagcatgggagaaagatgaaggccagaagatgcagccagtccagtccttccacgttcccctacctgcttttatcctagctgcactggcagctgattagatggtgcccacccagattgagggtgggtctgcctttcccagtctactgactcaaatggtaatctcctctggcaacaccctcacagacacacccaggaacaatactttgcatccttcaattcaaccaagttgacagtcagtattaaccatcacacttacttaatagctctgtgttctctagcaagttaatgaaatctctgttgacttaatttctaaaattggagtaagtccatcttttctaatgcagtttgtgtatgttaaatggaaatacaaaaaaaaatctagcatagtctatgacccaataaaacggtagttttcttccttcattcccaattcccttctctttcttaaaagcaaaaaataaaatagcagatgtcaggatcagtaccaacaggctctttgggactatggtttctttccattgatttgtagttcaacccattaagcatattctcagcacctagtatattcccagcatgcagcatggctgttgcctccatgagcccagtccagtagaagaaagaccatcagtcatacagatatgaaccaagtgcccattgaagtataagcttgtgctgtgggagcacagaaaagtaggggaatgaataatcctgaggaggaaagagtggatcagagcagtctcacaaaggcatttgagctgttccttcaaggtttccatggtggaggggggaggatcacattagcttatttattttttactacagagattcaacatttgcccttcataaaaattatacagaaaatatgttaagaaaataagttctaagccatcaagcccatctgatctgaaacagaaaaagactcataatgaatatgtcaacacttccacatttttcatttgttttctaaagcaatttcatctgcaaatgaattatgcactccagggctagacagtacctccattcctacactccagaaaaatgtgtttacttcgttttacatttcatgcagctcagtgggaaggcagttgcaatgcaatttctgatccagtttagggtttgagatgtcagtcctctctttctttctccagaatacggctaaagcttgtaagaccaaggttgggagttcacttttttttcctccaagtgcattaaatacataaatcacctctcaagaaagaacataaggttcctggatttctattttgtctggcatgaaaactaaagtccaatctgcaaagcatcatactgttatatccatctgcagtgcactaaaatcactctcaaagattgtaactcttggagcaaatttttagcacaatgggcagagcgggttgtttcttgcccaggtaactgaagcaggttcttatctcacctaaattcatcttctgtctgaaaagtaagtgtatctcaacatgcggtttgaggttctgaagggttccacgctgcccttccactcaggcagggagaagtcagtcctgggattgagtctgaagattttgatggacatggtcctggagcgagttcggagctagtgttaaaatgccctctagtggtcattagctgtaaccagtgagcgtagggaagggaaaatcttgtgaaactggcttgggtgtggttttctataaacaccgaccaaaaccagagtcctaggttatagcgcgggttacttgcatctgtcgcggataccgcgatggcggtaggacttggtattacttatagaaatggaagcttgccgttgcattcaaagggtacaatccagggatttttcttacgctttcacatctcactgctctgtccctgagccctgggcacacacgagagtttcaagaagtgttgactgagtgactgaatacgtgaaggaatccagtttatgaatcatggattctgtgcacattcaatgagcttggctatttgaaagtgcacaaattcttcctgctttctgaagtattaaatatatttgatttgcatcctttccccagtggtcgcttggtgagctaataattgcctttcctcttatatctttgagctgaggaaatataatcaaaatgttaaggagaggggcaacaaaccccccctttgtgggtagaagagaaggtctgggctggcagctcaagagaaaagatgaagaaaggacatccaaaaagaagtggaagtcagagaatgaataaaacacatgagcgaatggctgccatcctatccgagcatccttcctgatattgtcacccagggccaccagcagaggttacatggtgagaacagacagtagaaatcagcccactccaccgatctgactcctggtctcctggggaaatggcattaggatctaggttaccaacatcatagcttctgccagggcttgtgtgcttaaccccaacagtggaacaccacaaatgcacaggggcagtagcctccaacatcctgaccatctctgagaacctgtcctgctagcagaggggacagaggctgtacaaatcagaaagttgacgtattagtccattttcacgctgctgataaagacgtacctgagactgcgtaatttacaaaagaaaagggtttaatggaaaagtcacggttccacatggctggggaagtctcacaatcatggtggaaggcaaggaggagcaagtcacatcttacgtggatggaggcaggcaagagagagagcgcttgtggaggggaatgcctctttttaaacccgtcagatctcgtgagacttattcactatcacaagaacagcatgagaaagactggcccccatgattcgattacttcccaccaggtctctcccacaacacttgggaattcaaaatgagatttgggtagagacacagccaaaccatatcaatggataaaaggaaatgtaatgtcaactaaagacaaaaaaaaaagaaaaaagaaaaaaaaaacttttgaagaattaaagttggttttatttagaagtcttattggggactgtagactgaggcctacaacccacaagcagtcttttacagaggttttatgagactgcgccagcacagtattttagcccactgtgtatatataggtgctaggggtttagcatgtgcaaagttatatgaaacttgtttagacattatattaaagtagaactacgttaaggtttgggtgtaagggtatatctggttctagattatagaagtgtcatcactaatctccccagatgttattttatgcgtaggagaaggtaaggactaggttcatttgtcttttaaggaatatagtgacttaggtaggagagatgggggccaggtgttctgttttattttgtcgttttggagagctgtatgtcatcacagagttggggctttgtgaaattatgttggcacagagacaagcaaacttagctgcttatgtatgtgattttgtctcacaagttctctctttaggtcacaaattaactctggccatatttataaaaacaatattgattgtgttatgtagctgagaaggctgttttttaggaaggttggtaatctttagttgtagttgtaaggaatgagtattgagcccagtgtgtatatttatttattcattggaaaatatgttttggattatatttatgttttaattactaggatttgttagggtttttgatgttgcctttttgggggttttgtgtgtgtgtgttttgggtttttttttttttcaatacagggtttcactctgtcccccaggctggagtgtagtggcatgatctcagctcactgcagcctccgcctcctgggctcaagcgatcctcctgcctcagcctcccgagtagctgggaccacaggcatgagccaccacacccggctaatttttgtattttttgtagagatggggtttcaccatgttgcctaggctggtctcaaactcctgagctcaggcaatctgcccacctcagcttcccaaagtgcaggggttacaggcatgagccaccatgccaggctgttgcctttttttttaatctaatataacattttaataggacattataaggatattatagattacatatagtagtctatatttaatagtaatatgatttatagattttgaaaaaataaaaccaataaaatcagaatatgcatttgtatttttttactaattgtaccttttgtatttatatttactagtattttttatgaaaagcaattttggactggagttgattgagaatacttttagagaagaatttggaataacaactgggttgtcttgtgcatttcctgtgggcatgatgccagccttgctcttctatggcaaaggatacaggttggcacatggaggagcttggcctctgcaagcccacagacctctgggctagctactcagcaactatgtgtcctctagacacagtaacttaatctctgtgcctcagtttcctcaactgtaacatggggcgaataagagtatgtgccgacagagttgtgtgcaattaaaaaaataatatgtgtaaagtacttatggtgggatcccacctgcagttcgcctccaggaaatgttagatgctgatgtggaggaggatgaaggggaggaccagatgtttttcctgctgctggcatattctgcgcgctgctcttccttctcccaaatcctttcagcagcattttctttcttcccgagattgccaagggaacccaggcagaatgccaggaactaaacctctctggaagattgacggaagaagagctgggatttgagcaagatagagcgggctcagggtcaccatgaggttcaaggtctgcagactcccccaagctttctctcgagtagatttgaacacacaatccaagtccaaatccaaatttaataggcttctgtactgagaattcagctcagccaattgtgttagagccttaatgcacatgggtacacacacacacacactcagtgcacacaatgagcactcgtacagggccgggtcacaaaagaagcgaatgtccatcatctcccttcacttcccctggtcttttctagtctccattcctcaccatttctactgaattctcccatccctctccaccttctacttctggaacgagctccaaacatagcattaaaaagcttcagtgtttccagggaacagagcattgctgctttccataaactggcagaactggtcgttaaatggaactttcaggcattcccccacattctgaagtcactctctatgtaatgatcttcctgatacacctttctgctctttcacctggaaaagaatttgaaggatgtggttatcagtcctctgatgatgccaatgtttcgactccatcctgaatattgttattgctgccaaaacctactggtaaagtaatatcaatagagccaccgtactaaaaaggatgtgtctgctacgttgttttctttaatatcaaggactttaactatattacagttaaaatcaatagaaatgtaaccttttcaaccacataaaatgagttcatttttattattattctttttctgctgttacagtgctgtgattgcaaaagcaaccgggtcaacttaagctttattgaaagaccattaaagaaacaaactcaaactcatttaaatactgaagctggtgcattaaaaagatcaataaagtaaaagcaactggggttgctttacttaaacaccccacatacgagaatcattccacaatcacaatttgagcaaacctataaaactaggagaccagccaataaagaagaaaacgctgtttcattactaggtttagacccataaagcccttaactttagtctgattagacatactgcatttaaattttctctcagtattttaaaacatcatccagcaaagacttattgatcaatgaatgtcatttacttaggaaagccattagctccctgagttaggggaatgactcagtggtagaaagtgcagtttcatttatttaaaaataaacacaagattaggctacagtgaagggaagttctagactcacagggagtcaggaaattttctttctatccttgctgagcgtggtatcttgaacatagttatttgtattcaattgaatgtttactaccaattctgtggccatggattagacacaaacctctttgtgtgtgcctcagtttccccagaggtagaacgcattaatatccttttctccctctttctctggataagaaaacaaaaatgattgacacaaacctcttcaagttcttccttaaaaactataatacaaactataaaccttagtggtaatatgtacttagaataattttagaatcagattggtccttattggccatgagtccaacccttgaccagtctctgcttatattactagttatggaaaacatgctatttttcttcttaaaataccatttattgtgtttttctaattatacatttaaatatatttattatagaaagtacagaagagaacacagaggaaaatcaggtttgcttgtgagtcccatttaaaatcagccctcgacccttctccaccaaacccgtcttgcttactccagggcattgctgagcagttctctgtcttcgttctctactgactcattcccatcagcaaataagcatgcagatatttctcttactttaaaacaaaaatttctcctgagaccactttccccacatctttgtttttctttgcaataaaacgcccggcaatagttatctatgcttgctgtttcgggtcagcttctcccattctctctctctctctctctctctctctctctatttatttatttatttatttatttatttatttatttatttttttggagatagagtcccactctgtcgcccaggctggagtgtagttgtgcaatctcagctcactgctacctccacctcccaggttcaagcgattctcctgcctcagcctccccagtagctggaattacaggtgtgtgccaccacgcctggctaatttttgtatttttagtagagatgaagtttcatcatgctggccaggctggtctcggacccctgacctcaagcaatctgcccacctcagcctcccaaagtgctgggattacaggtgtgaaccaccatgctcagcctctttcttcagtcaactttactgaaatgtaaattgcatgcaatgaaatttacacactttaaatgtacagactgatgagttttgacagacgtgcacacccatgtagccaccaccacactcaaaatttggaatatttctaatatcccagaaggttcccctgggcccctttcccacccaccattgcccccaagcatttactgatcaaatttctatttctataaagtcacagattagttttacctgttctataatttttttttttttgagacagagtcccgccctgtcatctaggctggagtgcaatggcacagtctcagttcactgcaacctccacctcccagattcaaatgattctcctgcctcagcctcccaagtagctgggactacaggcacatggcactacacccggctaatttttgtatttttagtagagatgaggtttcactatgttgaccaggctggtcttgaactcctgacctcatgatctgcctgcctcggccttccaaagtgctgggattacaggcgtgagctaccacgcccggcctacttgttctataattttaaacaaatgtccagctcctttcattctgcataatgattctgaggttccttcttcttgtcgtgtgtatctgtggttgtttttttaattgctgggtggtaatacacttatgaatatacccccatgcatttattcattcacctcttgatggatatgtggatcattttggggatattatgactacacctgttaggaacatttgcatacacatgtatagagcagacttttttttatttctttcaagtaaatatctaggaatgaaatcaatgagtttatggtaagtgtatctttaactgttttttgatgtaatattccctctaggaagacagcagaattccagtgactccacgtagtcactagcacttgatattgtcagtctttttaattatagccattcaactggtgtgtggtagtatctcattttgggtttaattttcatttccctgatgactgatgatgtttagcgacttttcaagtgcttattgaccactggtaaatcttctttcgtgaagtgtctgttcaagcctttggcccctttttaaaattggattgtttgccttattattatgttataaggattctttacgtattctggatacaactcctttgccagatgcatgtactgtgaatattttatcctcattttttcttattcccaatcccagctgggctgctgtccaccactgcttaaagctactcttatggatactatcaatgaccttctcaccaccaaacccactggctacttcacagttctcctgctgctccacttaaaggcagcatctgaaaccagggagcccttggcttttagggaacactgctcctgtcctccttctccctcatgggccccttttgctctgtctccttcactgtttctctccttcctgacctccttcagtgggcgtgcttccagtgctttaccatttgtattcactcctgtgatgatctcatccaatgtcgtgctcttaaattttatctctgtgcctcaaactccaaattattatctcaacccaaacctcgccatgaactgccgactcacacaccaaactgactcccagatatctaactgattcttgatgtctgataaacactccgaacacaatatctccaaatctgacctcctgatctgccccttcccacaacctgccctgcttatagcctttccaatttcagctgatggcaactccatccttccagctggtcaggattaaaaccttggaatatcactagaacatcactcactggttctcacagctcacatccggtttttcagaacctcatgctggttctaccctgaaaacatccaaattctgaccagcctcccaccttgcacatctgctgctcgggctccagactccatcctgttctgcagaggcctcctgacgggtctccaagcttcctcccttgcccttgcaggagcgtctctgacatcactaccccatctgtttaaagtacgagttctctgctcaacacccactgacagtcctcgtttctctgaggacaagccaaagtctttccagtgacctgcaggactccacaggaactagccccgtgaccctccccttttcatgctacttgagcctcactggcttcatgccgggaattctcccgccttggctgctctctctgcctgagtgttctttccctgggtttctgcagggctaacccctcgaatccctcaagtcttcattgaatctccttttctcagtgaggctaccctgaccgccttatttagggttgcagtctgacttttacaccaggcctcttattgggctctaatttgagggaaaagacttcgaatttatcccctcctaccatattacatcatttactttttctctgtgtctctctatactaggaaggaagcgatatgagggttaggatttggggctttttgttcactgatgtatcctaagtacctagaacagtcagttcaaggcaccttatgggcacttgacaaacgtttcttgaatgaataaacggacctgtgatgtgactacagattccttcccacacgatgcactcggaggcccctttcttcccacccagccagtgccaggcattctgcagcaacactgctccatcatcctcttttctctgcccctgcagattgacatcttcagctccctggccaccagattatggttgggttcagctagcagaacactgcaggaaaacacagggggaggcacgagagatcggggtctgtcctgtcctcacctctatcctgcttcttcccaaagtgctgggattacaggagtgaaccaccgtacccggcctcattttacttattatagccacaggttcaaatctattcatatttttgttttgctttgttttttctgctctgtttagagtcggagtctcactctgtcatgcagactggagtgcagtcacacaatcacagctcactgcaatcttgaactcctaggctcaagcaatcctcctgcctcagcctcccaaagtgctgagatgacaggtgtgcaccaccatgctcagcccatatttattttttaacccttgttctattattacctcactctctgcaaagacttctagaaccaactacttggagttaggccaaactttacagctccaagggcacagtcctccacaagactggtctcacgtcaaaccccagctgcaagcccaggggtctccaggtgaccctcatttacaagcagctggctacaaattcagaggttcccactactccctcaggtcaataatttgctagaatgatttgcagaactcgggaaagcactatacttatgatcaagttttactataaaggatacaatccagaccggccaaagggagagatgcaggtggcaagatttgtcccaaatgcaaagcttctttgtcctaaggacacactaccctccctgcacatcagtgtgtgacaatgcccagagtattacaaaccagggacatttactgagcttcggtgtccaaagttttttttagaggtttcattacacaggcttggttgattgaatcattggccacaaaggtgaactcaatctccagtccctctgccttatctggggtttgggctcaatgctcccaactctaattgcatgtttgatgaaaagaagggagaaggaaaacataaaaaccctcctccttacatgaatgcccttctctcctcagttctcatcactgctcttctagctagctttctcttggcccaaagtacacaaatggtggctccagcaggttccctattcctggacattttcaattctaagcagcagcctcaggcattggtgatcctattggatgatccagtcacatgttcttcctaaatgccaagggtatgattatgctacattgcttggaggagtgtgcagccttgcctcattctgcagaagttcccagccatgctgtagccccagttccatatacgtaccacagccaccaacacaggagcctgtagggcacagtcagaatccatcttctttacctcttgggttcagataaccaagcaaagttctcctccaggccattttcatgttctctctgtcttcaatacacattctcctatacatgcctcatagtcctgattaggttagcaggccctgtggttgagcagacttccaatttgggaattgaatgtcagtttcttcctacatttaggcccagaatcaccctactcttgcccaatgtctttgaactgtttcttcatccagatcttttcatcccttaatacattctttctctcaagaagaatatcagtttctcaaggagagagatcctggggtctctccagacacaccgacatgtgcttgagtcccaacgtagctacacatgaactaattcgtcagccccttagggtcttgatcaggtcaccttgagccacaattttcaccaacctttcctctctgatggaaatctgaagtcctccctgggatttccaagggttctttctgcttccaggtgctttcttctgtgggtgatctctctgatccagagaatatccacccagaatgaagctcagcacttcctttggttcacaaacacacaaccgcccaaagcattcactgagcagtagcctctattgactatttcagggtcggggagaggggtacacagcacattaacaaatcactgcaagtcatagagtagatattcatgccctcaatagttcctttacccatccttctatagaggcttctcatagcccttcacgccaggcagtgccagtctttctgctttcaccccaggcagtgccaggattttgatttctcctgattcatgctccctggctccccacctgcttcctcactcatctccaggtctcccccactattatatacaataacaagctgactcttcccaaaacagggtccaagcttgctggcccagagtagtcaggtgctcaacagatgcaaaaacttggatttgaccccctttaaaggagttgtggttacaaataacaacaacaatgagaatttgggggtgatcctatgccagaataacagagatagatagatacatagatagatagatagatagatagatagatagatagatagacagatgatagatagatagatagatattgattgatagatgaaaaactgtaaccccagttttgtatagatcaatccaaactttgcatcctagcattcaaagcccttcacaacgtatcttccatttaccttctattgtcttctaccattcttttccaaaacacatcctaaggaccagcatggctggtgtcgtctaccattttttttccaaaacacatcctaaagatcaatgaggctagtgacctcaacacccttagagaaatttggtttattattcctccttcaaaacgcctccactctgccaatctactgtaccatgatgacacttattctccatattacatattttagaattaggggtaacattttacatttaattttagtagattgtcttagaatattattccttcattgtttcatgtcatgttttccaaacaagaatctaaagcgccttgagcccagctgggaacatctgcacgtcatcagctggactccagtcccagtgctcaaggtggctggaccacaaaaccacatggaagcccttgcataatgttaggaggtgtcagcaagatgatttgagtcttacgccgaggcctctctcttcccacagggggtctgcaccacccccagcagccaagttaccctgtgacagtcattcatctgtgctctgggtggcccatgggatgagtgtactactgggcaggtgtaacttcaggggcacacacagcagacatccccagctgacatgacaacctactggcttctcaagatttgactaatcatatatagtcatcccacaatatcctcggggtatcggtttcaggacccccaagtacatcaaacctcatgcatactcaaatcttgtggtcagctctgaggaacctgcatctagcaagggccgactttgcatatacgcaggtcctgcatcccaagaatactgtatttttgatccgcatttggttgaaaaaaaaatccacttgtaagcagtgcagttcaagcccatgttgtttaagggtgaactacatttctgtgaggggatcatcttcaaataaagtccttgtttctgtaccagttacagcaaaggccctgctttgagaatttaacagtcagagtagccacccacttcaaaactgaccagtcccatccgtggcaagcagacgatgtgacatcaacggctcttaccgcaccaggctaatacagttatcctggtcgtagtttcattttactgaaggccttattaaagcgcccccacacaactcagccaggaattcaccaggaaccaaatttaaacaaatcaaaccccgaaaacgtgctcaacaattcaagattacagaagggaataaagacgaaaataagaaaagcctcaatcatatttgtcatatctccatcgtttctcataataattctcaaagttctttattcctttcatttatttaattaaaaacttaggccatgcacgttggctcatacctataatcccagcactttgggaggccgaggtgggcaaatcacgaggtcaggagatcgagaccatcctggctaacacggtgaaaccccgtctcaactaaaaatacaaaaaattagccaggcttggtggcgggcacctgtagtcccagctactcaggaggctgaggcaggagaatcgcttgaacccaggaggcggaagttgcagtgagtcaagatcgtgccactgcacttcagcctgggcaacagagcaagactccatctcaaaaaaaaaaaaaaaaaaaacttaaccataacattatacaatttaagcagcatcatatttgttaatatctattttcaaaagcgactcttcctaattttattgttttcttcctcccttttccacgcatttgtttgtttttcttcctcctagaaagtcatgttctaagttatcaaaatgtgtttttcctcgagctcttcagggaaaaaatgccatataaaattaattcatgattattttatgtaaattattatctaaagtactcactatgtgtaacggttaaagttgattgttactaaagtgattctaaatatgaaagtgtataaaaccatgaactattctcacactacatctcaaagaaatttgaaatttctagtaaatttcaaatttactagaagactagttcagatattgtttttaatgatttacaatcatcttctgaattttcatttgcaagtcaaagtcacaaaactaaaagtgctacatgttttctgaccagattctctgaaataattatatagtgcttgagccattgtgctataaatatctttgaaatcaatgctattaaagaaatgctatatcagctgtgaaatgagaatttctcctcctgtccgttgacatttacaaaaattatacgaacttattgatagaaaatccgtttgcttggtttctttttaaacatcttatgctttaaataatattcagtgtttttccagtaggtggagtattagtctagataaagtaaatcactgtgtgaaagctaattttttcttcctactattttgagaaatttttgatataaaacataaatcacctaatagtttcactaattcttttaattgcatcaatatggtatgatttcaattactctagaccttaagaggcagatatattttactgattacattaccataataacaatggcataatgacaatagcagtaagtacttattatacctctcattttaaaattgcttatcaagccattagagaaacctcctgacatctctgaaacagaaattacacaacaaagaaagatctgtctcttaaatcctttctctctcgagccttaagcatttctgggaaactgcgttccttgtgagttgaatattggttcaaggctgatgctaccacttccagtccaggaatctgagacgatcactacctctccctgggattctgcttccccttctaagtttgtgaaaagatggtgataaactacatctctgaggcccctccctacctgaaaatccccaaatgaacctgaaattgacaatcttatggctgaatgtcgggagccaagtctgccgagatgttttagtacatacggcaaagatggcacttgttatacggtctggatctcaaaatggaaagtgagagaatgatgcctttccagggcaggtggacgcttcctcccaccctccatccatcaccaaaaccggtcgaagttgaatagtgccctgaaaagacaccttcaagtggtaccctagagttgtatcttcacagatgattctgctcaaagcccccagagacatgggaaaatactattccttagggccatggtagcagaacatcttcaaagaaacctcacagaactggttcaacctcctcactttacaaatgaggaaactgaagtccaagaaggcttcctaacttgataaacatccatttaacacgtggcagagccagggcccatctcctggccccattctcatccccccaggccacctctcctctcttacactggaagtctagaagctggtttgcaaggggtccctgaatgaccttccatagaggacagtgccttaccgagaagaggaaacacatactgaaaccagccacttttctctttttgccttctcacagtcaggtgattcgggtttggagagagccccagctcccatgcgcaggggattttctgtcctagaaaggcttaggcacagtggattcacctggatctcttctagttttgcagccagtttttctttcttgctcttggaccggagagcccccagacccaggcgtaggcttaggtaaagggggctcaggagacaaatctgtctgctttggccctaggctaggccacctctggccttgccaacaattaattaatacattagttaattaattaattaagtcaaagtcctccaacgtggttgagcccagctggggactggtaataaagtgagtggtttagagaataattcccagaagaagcacaaattgattattgtatttggtgaaaggacagcagaagagcattctgggcaaaagatacagctggtctaaagccctgagcacacctgggagtgcacagtgcctccccaggtgtgagagtcaggtcacagcacaggggcaaggtctaggcgagggcactgcattctcgcctctccattctacgaagatgccccctacccctctgatctccccagggccatttaatctctcccaaagaggcaaaggctccctgacttatccatctgcagttacctgcaggattcggttaactttcccttcgtaaaggcatccgccgtgaaacacaccaggcacctccaggaccggcatgcatcgctaacccagtgacaaaagcatggctgttgctcgtttattccagagttctgttaggggagagtgtttcttggcctctttcttcttcttgagtatctctataagtcggcaggatttatgagtagctcaaccaaaaacaaattaaggtagacaacgtgacctctaaatgggtcagcctcccaaatggtgtcctctcatctgcacccatggctgttcttgggattggagggatggccgcagggcttggcaatgtaggttgggagggggctggcctgctgaccctcaccctgatgggcttgtggctctcagcaatgtggtcccaaaaacaagttgcactgaaatcaagactctcagagcagagcaggggcaagtgtctcttgcatgaaaattcggagtcccagattcacgatcagccagtctccccatcgatgtggtctgggaggatggagccaagctcactcactcaaactcgatgtcaataaaatgctatgagggcttcagtccactgagtcattcacagagattcctccctctacaaacagaagttctaatggaagtaaaagctaggaatccacaccttaaacacacacacacacacacacacacagacagatttacatacagatacatacacgaacatggctcagccagtgctgacccatttaacacatgttaaatgagcaccttgcatatcacaggcccttttcatgtggatcgtaaattaactggaaggtttattagataacactacagagaaagaaatagccgaaagtccagaggtgaggtgttagccacggagctctgacaaccaggtggatttccactgcacctgctgagcccactgatcagtgtttaacaagcgtgtgttatgccacgctcctggggcaggagtggtaactgaggcagcgtccttgaacccacagggttacggtctcaccaagggaggatcaggaacagagctgcaaccctggactagcaggagagtcacacctaatcctacttctttatctcccacacatctacatttgctccatgtcctctccattatcaggaacaaagtgattctagggttaggaaggggcagaaaacatttagatgaacgtatccttgatactggggtcaaggcctgcttgttcgtattttcaattgcaaatggccctaggcttgtgtatacccttcatagaatggagattccgatggggagaaagagatggtctccactcttcaaaccctctcttctttgaagtctgtgggaatttctagtttagaaggacgggtagacacagataaggggtgcgagttgagctgataattgtttctcctacctgaagtctatctgcatcagcctcttcttatcttcagccttgggcttcaacttggagtaaataaaacattcatcagatgatatgctctaggctgggcgtggtggcctacaatcccagcatgttgggaggttgaggtgggaggatcacttgagcccaggaatttgagacaagcctggacaacatagtgagaccccatctctcctaaaaataattttaaaaattagccaggcagccaggcacggtggctcacacctgtaatcccagcactttgggaggctgaggcaggcagatcacgaggtcaggagttcaagaccagcctggccaacatggtgaaaccccatctctactaaaaatacaaaaattagctgggcatggtggcatgtgcctgtaatcccagctacttgggagactgcagcagaactgcttgaaccagaacttgggaggcagaggttgcagtgagccaagatcacaccactgcacttcagcttgggcaacaaaagcaaaactccgtcttaaaaaaaaaaaaaaaaaaaaaaaaaaaaaagccaggcatggtggtatgcacctgtggtcccagctactcggtaggctaaggtggaaggatcacttgagcctgagaagtggagtctgcagtgagctgtgactgcgccactgcactctagcctggatgacagaataagaccctgcctcaaaaaaaaaaaaaagaaactccttagtcatacacctaaagccaatctctccataatcactttattgggaataaaatgatattttgaagaaaaaagatgatatattctaaattcaatatcgctgagctaattccaagtattccctaaaattaacgattaggaaaaacagcaagaaatcctaggcctttgtctaggccatggaaaaagcgggatctgccttgaaattgtgtccttcatctcaggagatggggcccggcccctccaccggtccaggagaacccacgccatttaggtatttcttctttagcttctccactgcatccccaaagcgtaaacggctgatgaaatcccttcaaactctgccaacgcaaactgtggcttaaaaatggaaatgaatggatattgcaaaataatacctgaatagacgttaaagctttaagctccacgtgtaagacacaaggtcctgcctaaatcagtatgcttctaatggcttcatggcaaatgttgaacaagttagtgttcactcaaggttgtcctggggtacatggagtcacagtctttaattttaatgagcctctattacacaatctcttatcgcctcttaactgccagtgaaatgaccaccagctaaatgtacagcaaaatacatttctacaaaagagctcacttggaccccaaagaaattaccttgaaattattacacttaaccgtggcaaatgcaccagggttcatttgaaaagaggtggccacctggcaatacgagtgaaatcatataatatgtcatttccttaggcttttcatgttaagcttttctcgctatatctgatttaaagtattttctcttttaaatgtaaatatttaaaatgtagctgatcctctccctctcctaattgaggtgactgggctagttcaagagactgtggcctgcagctcaccgttttgtctctggagtcagagtgccagccttggtacttactctgtgactggacactttataatatcaaagatacgagatcatacctatctaatatctattcaataagacaatacatattaaaagatcagcacaaagccttgtacacagcagttgctcaatatgtgcttcctcctttttcctactattgaatcccaccagccaagaccagaactatatctgcagttggacaaagttgggtttatcccttgttgcagtgagggcttagcagtttgagtcaaacgggagctggaaaccacagtcggttaaaatggggtgataaatagaagcattaactatggcaaacagcaactccaagatgtaaggaaatccgtgcagtttcctagtggccccctagggctgagggagcccatccagggacaacctcggtgggtgtctgaccgtaatggaggcaaagctgcccctgtctcctctgacagtctccagctgggcctgagagttaagttgacgtaggagagactaacagaggaaacgcaagccaatgtttacaggcatgtgagggccttcacaggacaccaagatccaaaagcagccaggcctaagtgcttatgcaacagggtgaacaaaaagtagtaattttgaaaaagtaactaactatatggagatactaaagacaagggttattttaacaagagctttttaactgtcaaaacactttttgtttgtaccgatttccctcggcctcaactccccgcctctggagagaagaatgttcttttcttcctggtagagagaagccatcttccatatgaaagtttcatctcctgctttcaggaagaaaaggggaggtcagagtgtcctttgtgcatctgttgtttttctttttttctttgagatggagtctcactctcacccaggctggagtgcagtggcaccatctcggctcactgcaacctctgcctcccgggttcaagcgagtctcctgcttcagcctctcaagtagctgggaccacaggcgtgcaccaccatgcccggctaatttttgtcttttagtagagatggggtttcaccatgttggccaggctggtctcgaactcctgaccacaggtgatccgcccactttgccccccaaagtgctgggattataggcgtgagccaccacgcccaacgcatctgttgtttttcaagtgcctttagctcaaaattgtccccatctcaagccagcatatctggaggtggcgtgttctgaagcccttcaggaccttgctggagaaggtgtgtctgcctggcagagagcagagacccctgcttagccaagctggagctggtccggaattgctgggggagcgacaggctggctgccctctggagtgcaggtgggggagcaggcaatagcaatggcggtgggggtgagagtgaggggctaccagggcggttcagacacacgtccagaggtctgtgggcaggttgccatggctgagacgctagggtcacagagggttctcttaaaaggcctgcgactcagacaggcttcacctcatgtcctcgcactctgggcagagcctctgctatccccctcctcgagcctgtgctggaaattgcagtaagccccttcctcttgcagtgtccctccagagcacgctactgagaaagcttgacattgtgctcaccttaaaagcaaaatctttaaggaattccattgtttatcatagagcttatattgaagggtgcattgggagccaggaagcaacgagttgattgataattgacgcaaagggacccatataccttagagaatgacggggtggctctaagagtcaggaagggcttattttaggaatcaggcttatggtggggagggttcaaggaagcaggtgtctctaatcaactgggtgctctcagaaaagcagggctaattcagttattgggcctcttaatgcatttcatctgggaggcaggaagaatggagaacactaacgttgttattgaagaaattgccgggagaaagagatgttttggttttgggttgtacaaggtctgttattttttaatttcttgtattagtttcccagtgttgctgtaacaaattgccacaaacttaaggacttaaaacaacatgcatttactatctcacagttccagaggccagaagtgcaaagtcagcgcaaacggctgaagtcaatcagaaaggctggtgccttccgcaggctctgagaggagaatctgtttccttgcctttctcagcttctaagagtctcctgcgttccttgggcccttcctcacgtcactctaacttctgcttccgttgtcacatcttctctccactgcgaccctcttgcctccctcctataaagaccctggtggggacctgagacccacccagggaatccaggagaattcccctattatcttaatcacatctgtaaagcccctcttgccaaggaaggtgacgcgctctcaggtcctgagaattaggatgttatctttgggaggcatgattccgcccaccatatctccatattcagacaaaattgcagaatggtctcgtgtcacatggtcaggtcctggagagccctgatccgatgctgctgttctgaattatgttcggcagggggacagcaccacctggtggtaacactcggcaaagcatccgccgtcagctgcagagctgcttttcctttggggtcctcttgctttaacccaccttccccacaatcccactcatcccttccggccacagcccgccttcttagacacaaggcaggcaggagtatgcgagagagaagacgtaaggacgccttgctcgtggtaagatcagagactgatcggagaacgctttcctccttccctcctttgagaatttcctcaggcactgcagcttcacctttgtgaatgttgaaggctttctggatatcctcgtcacttctcatattttcctaactgagcaggtaatttggattagaactgtacagcatgacccatttaggttcctgttcactgttttgaaattaatgacttcatcaatgagttaaggctaggagtgttcattatgttttttagaaaagtcaaaaccgagcaggatcaccgagaagcaagatgacacaatcaacaatcaaaaacctctgagtagaggctattactgtgtttcaaaacaaaatatataaaagtggccgggtgcggtggctcacgcctgtaatcccagcactttgggaggccgaggtgggcggaacacaaggtcaagagttcgagaccatcctggccaacatagtgaaaccccgtctctactaaaaatacaaaaattagccgggcgtggtggcgggcgcctggagtcccagctactagggaggctgaggcaggagaatggcgtgaacccgggaggcggagcttgcagtgaaccgagatggtgcctctgcactccagcctgggcgacagagcgagactcagtcccaaaaaaaaaaaaaagaaagaaagaaaagtttatataaataaatgtaaaatttagcatttttggttaaagccatcaaccacgcagacataggaagggaatacacttatagagatcaactaggaattttattttactgtagctcagcaaaaataatataaaatggctgccaaaaagccaaggccgtctagtctggatctgcagaaacaattcaggaaaaggaaggtacctccactgtgtgggtcatgccaaacctgaggacggatttcccttcggtgctcgcgactttaaaagttgcattaacaactgttaatgtcaattatcaagatcccaccatgtattgtattgggctgtattgggcctgaggacacagaaatgtaaaaacctaaacatggaaatttaatctttaaaactgtgtactatgtatccatagaacgaaatactagtcatccatgacaaatgatttttgttgtatatttattgagacagaagacattcataatatatcgtcaagttaaaaaatatacaaaacataatatgtgttagttgggttccatccctttttacttaaaaagttgaaagaatatacattaaaagttaacattgactatcagctggcagtttttttctgcaaatctatatcattttttctataacgaacgtatattacttgtatccatttttaaagctaagaaaatagaattttgttgtatttttatcgacacagagcgacattcataatatatcatcaagttaaaaaatatacaaaacaatgtgttacttgggttccatcccttttttatttaaaaagttgaaagaaaatacattagaaattaacatttattattagcaggcaactttttttccggcaaatctgtgtttttctataatgaacatatattatttgtatccatttttaaaattctttaagaaaatagaactttgttacaaatttagttttttgttttgttttttttgttctgagatggaatcttgctgtcaccaggctggagtgcagtggcgcgatctcggctcactggaacctccacctcccaggttcaagccattcccatgctacaatctcctgagtagctgggactataggggagtgccaccacacccagctactttttgtatttttagtagagacagggtttcatcatgttggccaggatggtctcgatctcttgatctcatgatccacccacctcggcctcccaaagtgttgggattacaggcgtaagccactgccctgatcacaaatttagtttttaaattgtaagaagtatgaggtggagattatcacctcctaaggcattgccaggtaggctattggttaacaatggcattttgcatttaaccatttaacaaaagagagtaagtaaacagaagtgcggtggcagttacccatgggtgtcattagatggcagcaaagcagctagctaatatttaagagcagaaactgaagagcttttgctccaaagaaacatatatatgagattttaaatatttaagattatctgaacggaataagtgtttttgtttgtttgtttgcttccagacagggtctcactctgtcacctaggctggagcacagtggcatgaccacagctcactgcaggcttgacctcctggcctcaagctatcctcccacctcagcctctcgagtagctgtgactaccggtgcacaccaccacacccagctactttttaaaatttttatagagataatggtctcactatattgcccaggctggtcttgtactcctggactcgagagatccacaagcttcagcctcccaaaatgctgggattacaggcatgagccaccacacctggtttgttttgttaatgatgcatttgacgttatagaaaacttttcaaaatgatagccaagcatgcaaatgtttactttaatagtttttgggggtggggtgcttttggatttttgtggcaatactactcatgcacaaaaacctactgtaccagttctgtgggtcaaaaatctaaaatgttcttgagatgtgaggaccctttgactcttaaccgtgactgtgcaatgatctctaagtttctaggaagcagtttcaagattctgctgcagacagtcattaataatgaatgactattcatcgtagtatgatgtggtgatgccatttgatcacttgcctgccctctttcttcactgccactctctccttcctcccaagagcacagctagcttccagcatctttgctcatctgaaggacagttttttgcctaatcaggcccagtttgagcaaggactctggatcgtatctgcttctgagtctgtgctgctgccttcaacaagttgctgcttgttctgtctccttcctctacacaattgacgtggcccccatgggaatgcccatgtcggaaagcaatgctgtgctttcttataacccgcacctctcgtcatgctgaccttagcacgtattaaactcacttcagaaaaatgaatgcttacaaaagaatgttttccaccggggtggggggcccaaaaaaggcccagaaagctctaagagctcacagttggagaaacacatctagactgtataggtggtaaaaagacagctgagaagataaggcaggaaaagccacacagggacacaaagggcaaggccagtgattctgacaccaccattggcactttgtccacgggcaacaggatcagaaacgtgcgtcgcttccgtggttactgtctgtgcaccgttcccaacagcttcatttctctccctctgctgccaactcgcccaaccacccctgcctgtggcaggagaaatcattctcattgggataaccgagaaaactacaactgtttaccccacttgaccctcagcatttgagtgtgtgtgtgtgtatgtgtgtgtgtgtgatcatgtcacaaaataaaatgtttccgcaaaacttcattgctgtagatgtggcatattccctatcagaggctgacactggagattggatcaagcagatgttactccattaaaaagaacatggatcttaatcctgtaggtaaatcatccacagaaaatgtacatcacctggagagccgttcataaaggatcttcacttaccatcctcagattttttcaaagaaccccagcaaaggaagacatgggtttccattttctcggggtggtgttttagagtcagtgctgatgaaataagatatcagaaaaccagggttcaaagagtgatgtcatccccacagggaagatttggttccacacagggtagagacgtgcttctaaaagtgtctcttgttttcctcctgcagctcgatcattatccttctgtgagttaccatctgccaagttcatccgacaccctcttcaattctcccaagtcgctctttctgggaaaagttataggtaagaatgtggttcgttaggtataaatgcgtgctacaaatacatttgggtaatgtgagtttggattttaaaactatcaggtaaatttctcttactggggccagtcacgaatatcttctctgtacaggaaagttacgtggttgttctcggtgttgcacaagcaaagcgtcaacaaattatctttgggggaaattgctcatgtaactcattctaaagctaattcgcctttgaaatacattgtgattaggctgggcatggtgggtcacgcctgtaatcccagcactttgggaggctaaggctggtggatcacttgaggtcaggagttcgagaccagcctggccaacatggcaaaaccccgtctctactaaaaatacaaaaattagccatgcatggtggcaggtgcctgtaatcccagctactcgggaggctgaggcaggagaattgcttgaaccccggaggtggaggttgcagtgagccaagatcgtgccaccacactccagcctgggtggcagagcgagactctgtctcaaaaaaaaaaaaaaaaaacaaccaaacaaacaaaaaacacattgtgattggtaatgggggcttctaagtcagcgatggtaatggaacaaacgttgtttggtgcgtggcataaactacaacccaagcgaaggcaaatctgctccaggcttctctatgtagaatttggtctattacagacctctacctactagcaatatgtaatttaacgtttcctttgtcaaagcatatcaacatgattctatcttcctctcactcgtaagaaagcaccttgatattatttgcagataagaaggccaataaggaatttgacagtgtgacagaacacccttccccatgtgcgactgtgaattccagagtctccttgtccctctcttcaccagaggagattagcactgtgcaaagctaaaaaatgtaccatgagccacagatatgtgaagattacaccctaaatttttaaaatatcgatatgattggtgaagtattttaaaatatttaatgtgaagccaatgaattttgttcatatgaggctgtgtactgtgaactgcaatgaaaacagtaagatggtggtgatgtacaggtgggagggaggtcactcggcggccagtgtgtagaagtgatcagaatagcattaatggtaaaaatgctcacttaaaaacatgcggcaggggtcacaaaatgaggagtgagtaggagactgaacctataataaaaataatagactgggcgtggcggctcatgtctgtaatcccagcactttgggaggctgaggcaggcagatcacgaggtcaggagatcaagaccatcctggctaacacggtgaaaccccgtctctacaaaaaaatttaaaaaaattagacgggcgtggtggtgggcgtctgtagtcccagctacttgggaggctgaggcaggagaatggcgtgaacccgggaggcggagcttacagtgagccgagatcacgccactgcaccccagcctgggcgacagagggagactctgtcttaataataataataataataataatgtgcacttatgtaagatttactgtaggccaggctccagtttaagcacttgacagatattagcccattcaatcttcgtcacaattgtatgaggtagttaagattatgatctccactttttagatgagaaaactgaaccatgaagagattaaataaccgggccacctggctaatcagtggcagaaccaaaatttgaactcaggcaatcagacaccaagggagctctttactgtgctgtaatccctgtggcagttaatctagaatgcaaagagaaagacagagaggaaagattgggcaggtgataaatgctgaggctgtccaggtaagggataaagcctatatcttgtgccaggaagtggtcaagaacaaaaaggattcctgggtttagaaccaggaacacaccagtccggctggagagggaggcatccagaagagagggggaaagcaggtgtgtgcatgaagcccaagaccacacacctggtgaacaagacagtggggagtggcaagtgataaatcaaagggtggaactggaaaacaaaagagggctaacatgtattgatcactgagccttagatattgtacgatatgaaagataattaaatagcttctgcttaatcctttgcatcctgaaaacagcactcaggcacagtctcaaatctagctttggattacctcaccctgatgtccttatctgaattttctccaacactttctatagttgatgtatttttacagatcttatcaccacttttatgttctgtgaacaagaagagactttgtgacatcacatgttacacgtgtaaatataagaaacaaacgtcacaacaatccaatgaaatgagatccctgattatgaacctcattttgcagatgagaaaactgaagcagaagaaggtcaatttgacaaaagttactcaactaatactggcaaagcagagtttggaagcgaggtctctctgaagacagtccagactcttaagtgggtcaaacaatcttgtcattcatggtgaagctccagaagagggatgtatttgaaagttgagcgatgccatcagttagcaacaaaaagtggctgtttagtggagtagggccttggcattcatgagtcatggatctgagactttggtgagtacccgctttctaccagaggtactcccacggttcagttgagaatactttaaaatgttaagtgctccttcagaaccatatgattccatcaaaacaaacgctacactatgatatggtgatgttcctaaagatactacactatgatattcgtaaagtaacatcaactataaacatacccgaaaataatagactttttattactttgtggaacctgcaaagtcaaattttgatgggaatgttggatgatttctaggttctgtcactatgagtaatattctctggttcctctgttttccaggtcatgtaactagttcacatttcagcacaattccaatatactgtatggcatggaccttcaaggtcgtgaacaaataacatcataaaggccacattttctacaactaagaatgtaccttgacatcaatctgtgcaaagctaaaagtgtaccatgagcctcagatacatgaaggttacaccctgtattttttgtacacccaagaaaaatgttgctgcatacacaaactaggtaactgtgcatgtggcagtgagttacagaaagtacacataaatacctgtaaggaggtccacaattccaagatggaaatggtgttatgcaggtgagagtagttagggctccagcaatgggtccttggtgcactgacttctagtggagattatctctcatccctacaagcctgtgacctccctgcagaccaagaaagcatctcatagttccaccatatactaacaaggagcaagtgctcaataaatatttgttgaattaataaagagtaaaaggggaaggaaacagaaagatatcattgtagacgtatactgcagggtgaaagggtatggatgatcatcctaacagaatcagtaagattcgcacagaggtgagagctgcaatcctcacatatctcacagcctaaaagtaggcatctgacgatcatgaagtagaaagaatgtggacttcggaatcaggcagagcttgttagactggaatccagttctacctctgttagcattgaaatcttgaccatgttgctttcttagttgaacctctcagagcctaggttctctcctttgcaaaatggggaacacaaatgcctacttgcaggttgttaactccctgagggcagaaggcagagactttttttgaaactaatctatttacagcaggctgatcagtgcctagtatacagaaagggctcaaaaaatacttgtggagtaaatgaactactcttttaatattaagctaataacgtcttaagacatacacaacacaatgcctaatacataaataattaccatttttgatgctagctacatgccggttattatgctatatgctgtaagtacaatactgtctgcgtttctcacaacaccacagaccattgttaccctcgttgtatagaataaggagctaaggctcaaaactattaagttttcttcttaaagtggggtttcccaacagcagaactattgacattttggatcagaaaattctttattatggggctgtcttgttcattgcagaatgtttagcattctccctggcctttacccactagatataagtagcaccccaagttgtgacaaccaaaaatgtcttctaacattgctaaatgttccccaggagggaaaaattaccaccccagttgaaaaccacaggcttcaagctactcagcgagtcagcggtgacgctgagatttgaaaagcgtgatttgtgacctaagacctatgctttgcttcctgatgacacctgcaccttccagaatggtgaggaagcaaggacgaggttcttgctactctgaagctaaaattctgttaataaaattgaaggagtctcagtgaagaccccaagaagacatgtaagtgcttgagaagctaatcactggccaccccttcaagccaatactcctttgatatttgatcatttcacaggggcaggaatatgcttaaatgtctctttgaaaacaacatatacttcagtgagagacaacccatttgcattccccagttgtgtaaaaatccatctgtacagacatacagtattgaacttgcaactgatatgtactccggccaggttttgaaaccccctggagtttcatgctccaaagttgttgctttacttttataggatcagtttctgctactcagaaactgattctataaaagaaagagaagaagatggctctaaatacctaaaatgacttcacactgagctctttgatgagcactcctcaaaaagggacacagaaaaaggatgaaagaaaggctacctaatcaaggacaagtgtgatctttataaaggggatggaggatatatattcaagaaatagtagtgtgatcactgccaaccaacagcaaacttttagaacggattcttacataattctgaatgcttctagaaggaattcagaatcactagcaatcagcaaaggttcacaaaggagaaatctcactagacatagttatgtccatctttcatccctcatatccatccatcttttaccagccgagtgatgtcatagactttatctttcagcaacaaatttaatggtctctcaagaaatcttcaaggaagagaaatataacttgaagccgaaagtggggtgttctgtttgctcatgtccttttcaacatctctattaatgccttggagaaagacacaagtagcatgtttattaagtttgcaaatgtcacgaagctgagagggatggtttaatatgatggattataaaaagcatttcaaaaccatcttgacaggctagaaagatgggataaaaataataagatgaaatgtaatagaaataaacttaattgcagcacttagataaaaaaaatatatacaatcacctaaatagaagatgggagacccccagcatcatgaaaaaacttaggaaattggtttgatggaaagtctggtacaagcaatgttacatggtgatggattcttaaatgaatgtgattctgagccacactagtatgagaatcatgtccagagcgagggtattagtcatctgaggagaaaaccagataaacacaagacccgtaaaggaaatgtcagaagacctgggaatgtctgatcagaaaaaaatatgatttgagagacgagagaatcaattttcagtctttggtaactgccacatgcagggtggattagacttagttgaggcttactcagcaagactgacatggaccaaaagcagaagatatgaagaggaaaatctcagctccatataagaaagaacttcctaacaattagagcttttcaaaagtgagtggtctctactttgaggtaatgaactctctattattgagaatattcaacaaaggctaaacggaaatgtgccctgtatattaaggagttgtctggattgagtaaaaccagattagatatagcctaaataaactttgaaactttaagatttgtggtgggagtaattttcttaattaaaaaggtgaaaatgcaatattatagtagagcagggtctcctgttccattggcaactagggggataacatttagggttccttgatataaaacactgttatgatgcatgatgatagatatgaatttagaagaatatcaatgtacagcgatcaccacatcactgtgagttgtgtaattacatacacgacctgtttccaaggtggcaatatgcattttaattttatttctgagccctctttaattaatcgtttttcaaattaactatttctgccatcgctgtaaatcagagtaatataaaaccgtaatgaagtagatctattctgaaataaaaagacggtagcttctctgtgtaaacttgagaagctgtgcttagaaagaagctgaatactaatgcagtgtcgttgttgcttggctgatcattgctgttgtcagtggcgatgtctggggtggtaaaaataaagcgaacttctatccatttgaactaactagagtttgtaagtcatattggtctcagatcctcatatttcccaaactaccattatccaaagcaattccaatagaagtggctagtagcccctatattatttctattataatctaaattgtgaatatcatgatcctacacgactttttattgattaaaaagtcttattctaaggctttctaaaactttctggagctttggcaaagcctcttcacacagaaggaactgacatacttagatcttcatttgttggtgaaatcatatactgtgataaccatgctgctcacagaatatttctggccagagttatgaatggaaaagatttgtgtgatttccaggctagaacatttaagtgctcatgcaagaccctctagagtccttttatccctttggcatggtgactgacaagcctaagacagtgattttttccgtaagcctgggtccctctgtgactacagtgaacagaaaactcttgacttgtgatgaacatatagcatgagataaaaaaaactccttgctttgttaagccaccgagactatagggctgtttgttactgtggcagagccttggcctgtcctgactgaggcataaggactgacttaagggcagactttgctctcgcacccttgggtttgatctctgatatagtttggatatttgtccccaccaaaatctcatgttgaaatgtaatccccagtgttggaggtggggcctggtgggaggtgtttggatcatggtggtggaagcctcatgaatggcttgggccatctccttggtgataagtgagctctcactctgagttcacacaaaacctggatgtttaagtatgtagcacctccccccaacactcttcctctggatcctgcttttgccatgtaccctgcctgctccaccttcaccttctgccataatcataagcttcctgaggcctccccagaagcagatgccagtgctgtgcctcctataaagcctgcagaactgtgagccaattaaacctctttccttataaattacccagtctcagatgtttctttatagcagtgcaagaacagcctaatacaatctcttactctaccatttgccgattgtatgactttgtcgggttacttaacattgtgtgtatctgttttgtcatgtgtaaaataggaatagtaatggtctctgtgtcacgggattcagcaaaataatacatgtttagcggttagcacagtctctgctgcatagtatgtgtgtaatacatattagttttttactttgcataatcagcaaatgtatactcatcatatgtcagatgccaggcattgtataagtccctggaacatcattagggtccaagacaggcacagtttctgcctttggaaactttatatattcaaatccagttctcagaggtttctcttgggagaacccaaagcaagataggggatcatacaatgtatcaatatgcactgggtcacatctttagagcttcagtttctggaaaagaaggtaatggaaagtcaattagaagtaaaaagacaagagggtgggataaatgaaaagaagtatagaattctttgggagcaagtagggagggcacttgagccagtccaggagtgagggaaggcatactagaggaagtaacacagaagctgggaccctaatgaagagttagaatgatctgggtaaagcaatgggctgaagtagaggccataagggcgggggaggtcagttctccattctgcacagcagtccacccaaaactgtgtggctcaaaacagtagtttattatttctggcaattctgtggattggcagggtggttgttctgcttcatgactccaggcagggtgtaagaatgactggatagcccgaaatagcctcattcatgtggctggcagcaagtgctggctgcccaggagctctttggggccacgagccaggggctgagttctcccccaagggttccaaatcatggctgcttgggctacctcatggcatggtggctgggctccaagaaggagctttccaaacagcaaatgtagaagctgaaggtctctaagagccaccattcttgccatatgctattgaccaaaatctgggttccagcccatgttccaagagagaggaagcagaccctacctcttggtggcatcgtagccaggtcacattgcaaagaaacatgccatgggagttacggttgtgacatctttggaaacacagtgtgctatgagagaaatttgaggaaccacaagttgcattcagaatggtggaaagtcggatgtgaagatgcaagtgataaaaatgctgcagcataagcagggttcagatcaaaggcggctttaccagcagggccacatgtcctgctttgcctgggacagacccaagctactcctgccaggacaagagtacattattagcagtgcccacttttactctaaaaataggactacgcagttgtatgatcacctatcttatttgggtgttcccaggagaaaccctgcagaattcgatttgaatataagaagtttacctgggagacaatcccataaaacaagcaggaaagtagagacatgaaacagggaaagggatggagcattatcaagccactcaccactgtgggcacctggaacataatcccaccaggacactctggaagacagtgcgagacatgcctccgagtgtcccaaccaaggcaggaggaagccagggcatctcgccacctcctcccatcctgcagtgatgagggctgcttcctgcggtactaactccccagcacttccagcttgtcccgtgtttacacccaacacactgctgaggccagaggaaagtgcagatgacagcgaatcgcagtcagtggttcctggagcaggactgaggtgaatgccgggcactgacagcatctgccatattacggatctatttataagccatgttaaggttttaatgttatcttaggggttaaaggaagtcaaggaaggatgttttttaatccatagaataacgtgatcagattgacactttagccagataataccatctgcagagtgcaaaatgcataacaggaagtgagaagctgcagggagaccaaattggaggttgccatggttatcacagaattgcacattgtaatgcacaaagcagctcacatatgtggagaaaatgcaatgtctttatctgtgtctgatgatgtcgtattccttctgggtagcaaaggcaaataagctaaacatccaggctggtttaaagctgattctgacttaatcatttcaaaattccttcctggttgtgctctgtccctcatgaataaaaatgttcagtttctcgaagagcctttcccgtcctctgcttctttctataaggtggggaccaggtgtacagaatataaaaggagacaggcagcaacatgtctagctttagcattctaatgataccgtgggcagggagagacctggatgcatgctggtccttgagtttgcatggccaggcatctgctggcctccagcccagtgtcctgtgtccctgagtgctcttctggccttggagcttaaatctgtggttgatgaacttagagtccctttctttgactcaggcagtgttcccagggagcacctgccatcctgccctttgcttacttgctgtgccctcaatctcccacttgagagacccctaagccctaagtctctttcgcatcctccgtctccccatggcaggttgtcgtcagctatcaagcagtgagggctttcatctaaggcttcatgctgcacgagaatgagatgatgcacgtgaggaccagagaccctgtcggcttactcttcttccctctctacatgaggcttggctgccccatgttagtacaggaccgccccccaccaccaccgaccccctacacagcaacctctccccagagccccagactgggaagcaaggcaagagccctaaacccttggtcccatccgtcatcctttagaaacccacttctgctctctgggccaaagcttagctctcgtctctcctgctgtatctcctccttttctcatagtcttctagggcattaagaaagaaaaaagaaaaaaagaaaaaaagctttgcttttacttcctacaaaaaaaaaaagcaccatctaacaaatagctccaaaactcaattgcttaaaacaacaattctatttttatcactaatctgcgggtcagctaagggccgaagtttctcttgtacacctctcgtcttcctcctgggaccagggagttagcatgggcatgtttttctctggcagagacacgagagaacaagccactcacacaagcactttccaggcctttggtcttgtcacatccactaacatctgattatctaaactaagtcatgtggccaaatccatagtcgaggagaagagaaacttgctttcccttcagtgaagaaaacagcaaagtcacatggcaaaggccacggatacagggaagggtaaagaattaggggccgccaatgccatcttccatacttaggaggtggatgcaggagaactctgtgacctcctcgatgtactaaaaagcctgagtaggcccggctcggtggctcacgcctgtaatcccagcactttggaaagccgaggcaggcagatcacgaggtcaggagattgtgaccatcctggctaacatggcgaaaccctgtcgctactaaaaaatacaaaaaaaaattagccgggcgtggtggtggtcacctgtagtcccagctactcgggaggctgaggcaggagaatggcgtgaacccaggaggtggagcttgcagtaagccgagatcgcgccactgcactccagcctgggcaacagagtgagactacatctcaaaaaaaaaaaaaaaaaaagcctgagcaaaggaacttggggaaatcattttattcactcaaaagtatgttcagtgctcacatgtaccaggtgctaggcacagaacaatggataaaacagaaatctcttatctttatgaaccatgtactctcatgagcatagacagaatgagaaaagagttgtgtaatataaatgttagcaataagtgctatgaagaaaagtaaaagaggcttagcaggaaagcatgttacaatggccaggaaagtcgtctttgagaaggcaatatttaagcagtggccttaacaaagtgagaaagctggctgtgtggacatctgctggaaaagccttccaggaagagagaatggcagtccaaaggctgtgaggtagggacacgcctggcttgttcaaggacaggaagaaaaccaacatggctggaatacagccatcaagggacagagtggcaggagacagatgaagtcagagggttagccagcagccaattgcacagatggagaccatcatggagagtctgcattttattctaaatgagatgagaaacagtagaaggttttgagcacataagtaacacaatccaatttacatattagaaaggtcattccagctgtgggatgctgtattaactgcagaaggggtgggctgatataggggcaggatggacactaagagaccatttcaaatacagttgtggagtccatgtgagagttagaggcacgtgcaccaacgcaacagcagtgatggtgatggagaaatctttggactaggaacacactgaagtcagagcccatagtatttggtgatcaaccggatgtggtgggtgagagaaagagaagtcaaagagcgtttcccaaggtattggcctgaatagctggcccagtggtggggctgcctactacaatgaggtaccctgggagagaagtagtttaggaactgtggaataaaaattaagacttccattctagccacattcaaggctattccatggatgcatagcactgaggtgcatatcagaaaccgaacaccacctgtaacacggccttttcctgtctttatctcccatctcctcctcaggcagatagatgtcttggcttgactaggacattgatcgttactgggaaaggcaaaaaagaaaaaagcctattgataaatgtcagaatatatctccattataaagtcattcaggtgttgcatatgaacgcaatgatgaagaagaacaaattactgatacacaaaacagcttggatgaatctctagagaatcgtgccaatggaaaaaaagccagtcccaaaaggttacatacccaatgatcccatttatgcaacatttttgaaatgacaaaattttacaattgaggacagattagtgagtgccaagggttagtgactaggacaggagggaaggggaaggaagagaggtgtggttagaaaaggaaaacaaggaggccgggcatggtggctgactcctgcaatctcagcactttgggaggctgaggcaggaagatcacttgaggtcaggagttcgagaccagcctggccaacatggtgaaatctgtctctactaaaaatataaaaattagccaggcatggtggcccatgcctgtagtcccagctactcgggaggctgaggcaggagaattgcttgagcccgggagacagagaagttgcagtgagccaagatcatgctactgtactgcatctaggtgacagagctagactccatctcaaaaatttaaaaataaaaaagagagattcttctgcagtgggaattattcattatcctgactatggtggtggatgcacagacctacacagatgataaaattgtgcagaatcacatttgcacacatacaagagtacaaaatctgaaataagatcattggatcatatcaatgttaatatcctgatggtgacactgtactcctgatttgcaaaatgtctccaatggggaaactgggcaaaatacacaggggatctctctgtacaatttcttacaactacatgtgattctacaatggactcaattaaagtttcaattagaaaaagcaataaaaagccgggcacggtggctcatgcttgtaatcccagcactttggaaggctgaggcaggtggatcgcctcaggtcaggagtttcagaccagcctagtcaacacggcaaaaccccgtctctactaaaaatacaaaaattagccaggcaagatggcgggagcctgtaatctcagctacttgggaggctgaggcaggagaatcgcttgaacctaggagacggaagttgcagtgagcagagatcacaccactggactccagcctgggcaacagagggagactccatctcaaaaaaaaaagaaaaaagaaaaggaaaagcaataaaagtaaaagaagaccaagtccaccttcttctgtggagccatttattcatgggatatttagtcagtgtctcctaggggctagtgccatccaccctgggggagcgtgagggacaggagagggacctgcagcgattaagccaccggttctacccattccctctttactttcctgcgctagccagtagagattaggaaatatgtgggaattattatttatttacagcttagaattttgtagttcttttagagtcattattgaagagaatgattaatataatacatttctttaaaaaggagctagagaaaatggggtagattaaactgcctgcaacttctctcaaggaaagtccccgatggcagcttatcgccttgtgatttatctctacctcctaagagtagaatgcagcaaaattgataaatgaacaaatggcaaatagttaattgaaatttctggtcagttgcctttgcgttttactataaggacagaagcagcaggaaagcactgatgagaaagctcattgaagtgataggtgagaaataatatttaaactgaagagaagaaattatgtcctgtttttcatatcctaaagaacatatagcgtagtcttaatgtccagaatcttctcaaggctgaaggaaatctattttaaaagaattcactcagggagttctagttcaaggctggcttctcattcttttttaattgcattgactttcattcttagacatttattgggctttattattattattgccttatagaatcataggaggccctaagaaataatttgttgaaactttgtcacattacagctgaggaaaatgaggcccagaaaggttaaatgaagccaaggtcacatagctggtacttcacaacgtttcctttttttttttttttttttgagacggagtctcactctgtcaccaggttggagtgcaatggcgtgatctcagctcactgcaacctccacctcccgggttcaagcaattctcctgtgagtagctgagactacaggctcacaccaccacacccggctaatttttgtatttttagtagagacagggttttaccacatgagccaggatggtctcgatctcctgacctcatgatccacccacctcggcctcctaaagttctgggattacagtcataagccaccacacccagccttcaacgatattttcaatataatatactgtcaatatcagaataatctttgcttatcacccaaatgtgtctttaacaaggacaataaataattaatacatcataacctgcaaacatactctcaatatctagataaaacagctgcaaaggcaaatcttgtcataagtgtaggctggaagaggatattttgaacattgagggtcaggctcaatacaggctctgtgtcagaacacctgcaattccagttgcctcacctgctcgaggagctttaacaggtttcttacaaatctcagcttcagttttcttaaccgtgaaatgagaatgatagtagtgccaatatcataagctttgttaggaagatgaaagatgctatcatgaatgtaaagggcttatcacacagcctggcacacagtgagtgtccagtacgtcttaggcagtatcattacatctaatctttgacttttagctaatacaaataaagaatggctgactccaatcctgggtcactcataaaaagaacactcaaacaatgaaaaactgaaaaaaacttttgattgaaaaccaattggtatcatcatctttccatggtttccaaaattaaattatttttaattaacaaaagcaacccccaccaaaaaaaatcatttattgttaaaatgtgatgagagatcagaagttctgttttaatcacatttttagtatttggttaaagaagattgtcaaaacacttatttctgtcccaaatcttcaactcacctgtctttgacacacaacatacttttgcatacccaattgttttgaaataaacaaacatttgaaagccaaaattctaggctgggctcggtagctcacacctgtaatcccagcactttgggaggccaaggcaggtggatcacctgaggtcaggagttcgagaccagcctggccaacatggtgaaatcccatctctactttaaaaaactacaaaaattagccaggtatggtggcaggcacctgtaagctcagctacttgggaggctgaggcaggagaattgcttaaacccaggaggtggagttgcagtgagccaccaagatcatgccattgcactccagcctgggcaacaaaagcaactctgtctcaaaaaaaaaaaaaaaaaaagaaagaaagaaagaaagaaagaaagaaagaaagaaagaaagaaagaaaggaaggaaggaaggaaagaaagaaagaattcttattattataacattccaaagtattccagaaggcatggaaaatttttgaatttcttatttatatacagttgatcattattattatacatttcatatttacaaattcacctactctctaaaatttatttagaacctcaaaagtagtattcttggtgcttttgtggttatttgcagacatgtgctgtgcagcaaacaatttgtcatcaatgtgtacattctcatttgaagtcaaacaaggtgatgcccttgccttctagtttcagctcttataccataaacaagtatcatttttgtagtctattcagtgccattttttttgcattcttgtgtttttattggtgattttactgtataaaatggcccctaagtggagtgctgaaatgctatctattgctcctaagcacaagacgctgcgatctgtcctgtggagaaaatacatctgttagatgagctgtctttaggcatgactgattgtgctggcagccatgagctcaatgttaataaatcaacaacatttatttcaaaactgaatattaaataagatacacacataaagcaaggtaatgtattggttggttgataaaatgttatgaccagatgcttgcaggaacctaaccctgtatttactttaggaacaatgttttagtattcactaattgagtgttagcagcaactgtatgaaacatagctactgcaaatagtgacaattgactgaattatttttaacctgcatcacatgaatatgatgatacattatgtttttatattattttgcagtttaaacagctcttccacagctattatcacacatgatgttcatggagcgttacagtttggctgtgtccccacccaaatctcatcttgaattgtagctcccataattcccacttgttgtgggagggacccgatgggagataattgaatcatgggggggtttcccccatactgttctcatggtagtgaagaagtctcatgagatctgatggttttataaggggtttccctttcagttggctctcattctctcttgcctgctgccatgtaagatgtgcctttcaccttctgccatgattatgaggcctccccagccatgtggaactgtgagtccattaaacctctttttctctgtaaattacccagtctcaggtacgtctttatcagcaaagtgaaaacagactaatacatggaggtaagaggagagtggttactgctcagcacactagattaacaagtccaactaaggctacccaggtagagcctggtcttctccttctggtttgtgaaatctcatggtgcttcctatagcataaagactggctgtcactcaacaccactgcatcttaaggtccgtggaaggggaacataacatgtttcgaagaaaaaggtctgggctacaaagaccctttatgtaatcttgctaacgacctggaatttaaactttggagagcttgaaggttaacaaattggaataaaaagaaatcaagtcactccttgtttgaatgctctgaagaacaaaacagaaaaacacaatgaaatggtaacagaagaagcagatttggcccaataagtctatgctttgaatgttcctccggcactaacatggccacatttgggaagactggcatccccacagacttttctgtagcactttgaaggaagaatagagcagttgtagaaaaacaaatgtttgcatgaaagaattattcacctcttaaaaatctatagggtgtgaataatcctgctataaaaagcattaaatgtttataacagatatttaatgggactgttatgttttttggcagcaagcatggctagattttgaatgtcacagctctgtgctctggtgataagacagactctgtggtctaagtaagaattattttcctgcttttaaatgtagctgttaaaaaacaataaagtgtatttatctaaggaagataatcttctaaaagaagtgtttaataatttttaattcacaatttatactacttctccaaggtaaattcattttccaactgttactccatctttattgactgggaggaattagcattcaaaatacaaactcagaggttaaagcaaagccatacacagaagtgagccttattccattgtcttttatcacgggtgccagatttatttaacagactgtctttcagtctcacttacagtaactagacaggtactatggaggacagtgtatgttgaatgccttccaagtgtgaaacacctgcctggcactacattatcactaattctaaccttgcaagtaagtgcctacttaaatctgcacttgacatgtgaggaaagaggctctgaagttttaaagtgacatgtgccaagtcatatagctagtaagtggtagaaccatgattccagggtgggtctttctgtgcttgttggtttatttactgtctgtgtttgttttatgaaagagaaaagaccctgagagataggcatagtacaggtgacccttgaacaacaggagaattaggggtgctgaccccctatgcagtcaaaattttgcatacaacttttggcttttcagaaacttactgccaatagcttactgttgaccagaagccttactgataacatgaacagttgataaagacatattttgtatatgtattatatactgtattcttataataaattaagctagagaaaagaaaacattattaggaaaatcataggaaagataaaatacatttattattccttaaatggaagtggaacatcataaaggtcttcatcctcatcttcttcacattgagtaggctgaggaggaggaagaggggttagtcttactgtctcagggttggcagaggcaggagaaaatctacatataagtagactcatgcagtttaaaaccatattgttcaagggtcaactgtgtatttatttgatgcttcagaaaggggaccatgtcaattcctgataaggttctctcctctttccttttcctccatctctctgtgtcgatcctagtgctctcatcggcttttaaccagtagaggtctccaaactgtcttgtggcagcctgggctccctatacacagaaagacctggcttcaaaattctggttaatatgggaagtgcattaggaagtagaaaggaaagaaaagtcaaacaataaggaaaggattaatataaatcataaattaattttgtgggcctaattactattttttaaaacactgtaagttttagtagattttcttactctaagttatagaagtcaaaccctaaaacacgttaaaaaaaatctttttgttatttcttaactattacggttattttatcaaaattaattaatatcaaattaatgataatacaaaggaagtcacattattaattaaacaaagtgacttagccttgcaaataaaacactatcgtgtggattaatagtttgaaggtttaactttacagccttttcaattgactgtaatttagagcatttttaggttcacagaaaaatggagcaaaaagtacagagagtttccatatactccctcacccctccccacgttatacatagtttctcttcttattaacatctttctacgtcatgtttttggtgttacatacttgccacacatagtaccctaataatctcttgggccgtacattctctgggtttggacaaatgtgtaatgacacagatccaccattacagtatcatagagagtggttcccctgccctaaaagtcctctgtctccacctgttcatccctccctcccctctgctccttgcccggtccccaggcaactactgatctttttcctgcctctatagctttgccttttccagaatgtcatataattggaatcatacaatatgtacccttttcagattagcttctttcactttgtaaaatacatctaagtttccttcaggtcatggcttgatagatcatttcttttgattgataaataatatttcagccttatttttgtaaggaaaaaatcaaatcaagaaactaaagtttgaacagccactatagaaaaaaaggcaaaagtcaataaacaaaaacaattgttcagcttcgctcataattgtatacacctcccagctcttggactaggtaacatcagtggccagcaagatgccaccgattgagtgattgtttttatttcatgccatgtgacccattggccctccttttcctgacacatttataatcatcttaatcccaaagcaactgtttttaacaaatatgcatatatcctctgattttctgttgctataacagaatacccaagagtgggtaatttataaagaaaatgactttatttcattcatgcttctggaggctgggaagtccaaggtccaggggccacttctggtgaggactttcttgctgtgtcatggcatggtggagggcatcacatggtgagaaggcaagaccaggtcaactcaggtctctcttcctctttctttctttctttttttctttttttttttttgaattggagtttcactcttgttgcccaggctggagtgcaatggcatgatgttggctcactgcaacctccacctcccgggttcaattgattctcctacttcagcctccggagtagctgggattacaggcacgtgccaccacgcccagctaatttttgtatttttactagagatggggtttcaccatgttggccaggatggtctcaatctcttgacttcgtgatcggcccgccttggccccccaaagtgcggggattacaggcgtgagccaccgcgcccaacctttttttttttcttttcttttttttttttaaagacagtctcacactgtcgcccgggctggagtgcaatggcacaatcttggctcactgcaagctccgcctcccagcttcaagtgattctcctgcctcagcctcccaagtagctgggattacaggcgcccaccaccatgcccagctacttttttgtatttttagtagaggcggggtttcactatgttggccaagctggtctcaaactcctgacttcgtgatctgcccgcctcatcctcccaaagtgctgggattaaaggcatgagccaccgcgccccgcctctcttcctctttctttaaagccaccagccccatcatagggacccaccgcgatgaccttatctaattctaattacctcccaaaggccccacctccaaataccatcaacatatgaatttagagattaagtgtccaacacatgaaatttgggggacacattcaaaccatagcatcttctttaagataatgtaaaactattaaattaaataatagagtagaaatcacactaataatttgtgggtctattcagattatatattacctaataatttttacctattttttgaaaattgttccaatcattccccctgcttccttttcaaaagagtcaaacatagccagttaatttaaggtatctgcaaaacctttccaccaagacttttatggtacagagaagtgactcataagccacaattcaattaaatttagcaaatatttcttggacaacaactacatgcttgaggttggcatggggacctgtttttaaacctcctgttcattctactttgactttttaattacaacagattaaaatatcttattcagcaaaaaaaaaaaaaaaaaaaaaaaaagagagaaaaacccactttgtatattgaatttttgaatacacaagagaagtgcaactcagggtggtgggattcctacctagcaggcctgtctccctttgattaccccaatattccaaaggtgcaggttttgtgcaccaggcactctaataggaccctatcagctcagcgctctcagaaatttcagttgtctcccagcccctagaaagtcacaatagctccagggttgtgcttaacgggccatagtgggaggatttggaaaggagaaggtgaatcttttctgtgaaaagcaggtggaggaaactgaagagtggggagaagagaggtggatgctgacctgaattgtgttttcaggagcaggaagagtgtgctctctgcttaagagatgacctgaatggcaagactacatgtcactcggatggtacacagatactgtcttgatgggagttttcggaacagatttgtcctcccagggtgaaatagcagagagatttgaggcagccctcaactagagtatgaccaataaacaccaacttacttggtttttttcattcctttttccctgtgtccaagaagcaaaatgataatgtaaatgaatacacacacactcacactcacacacacacacacacacaccccatgttggggaggcgggtaaaggaacagaattgctctcagcaaacactggtggcatcaaaatagccaatcatgctgatggctgccacacagctcatggaagccttccacaggccagctctcttgctgttggctggctggacttcccagctcagtccctcacctctttacaggacaaggcacaccagaaaccaaggctgttgggggaggcagcaacagagaccagacgttccctctgcacacacatgatgtcatcaatagaaactctgctgatgatgaacccactttcacacaaaccttttaaagcctgagttattttttgcaatgacaaaaataacaaaccacatttttttaaatagcttccttaataataatggaaattcaggtgacattaatgaaaattgtagcacatgttcaaatcagaatctatgttcagtgttatatgcagaatataaagggatttcttttctcaattgatagaaaagggaagtcatatttaagtagtcacggtatcctagatttttaatatagcaacataattgaataatattttgatgtatctggttttagtatttaaggtgataaaatattaaatttaagcttaaaattaaaaatagaggaaaaagaaaaacaaattgaactgaagtgaaaatgtttcttgttttttaaaaaatcattgtacataacagttttcaccttcacttttagaaatcaaagcacaaccctctatcacatggtaaagagagtcagccatacggaaaaccaagctgattgttctattcctgtgcaaattctaaccctaaaatatttctctataatgctttaagaaagaaagtaaatctggaaaacattttttatcattttgaaagctgcctttgttttgattctcattgtgaaggtcaaggataggagaatttccagagatgggaatttatcttcactttatgctatcatttcagaatgaatagtgatcaggttctaaataatgcattccacaggtgtgagcaaccaccctatcactttctatcttcatgtggctggtgcctacaacactaaatttctgcggcagattcattaaggtagttgttcattccctgtcgtaattagacctcccatttcagccttttatgtcaaatccatcactcaccctggcactcaggctcacctctttacaaagcccttccctggtgctattctggctctaaacacaggtgataaatgtgtcagcatggggcacattcctgtccctgaggaccatcaatcgttaagtacagagagctttttccagcagccttctaagatttatacccatgaggatattatttttgtggctgcatgaaggagaattattacttgaaatgggttttgtgaaaggatggttttggtgttgctttggcaccattttaagcttcttttcacaaaattgaccggcgcaagtcagaatttatacttctatgaatgtagatcttcaccatctgatggtgctgagtcctacagagaagaggatttgagactttccagtttttagagatctctacgatgtgcaagaatctagatattcagaggccgtactgacttcaatcacatggtaaattagtatatgagagttcgcagtaataaaagaagtatgtaagtgatcagcatgtgttttagtcagggttctctagagggacagaactaatggaatatatatataatatatatatatataaaatatggaatttattattaagtaataactcacacgatcacaaggtcccacaatagaccatctgcaggctgaagagcaaggagagacagtccgagttccaaaactgaagaacttggagtccaatgttccagggcaggaagcatccagcacaagagaaagatgtaggctgggaggctaggccaagtctccctcttcacatttttctgcctgcttgtattctagccgtgctggcagctgattagatggtgcccacccagattaagggtaggtctgcctttcccagcccactgactcaaatggtaatctcctttggcaacaccctcacagatacacccaggaccaatactttgcatccttcagtccaatcaagttgacagttagtattaaccctcacagcatgggaggtaatgcgtatgttaaatagtttcatttagccatttcacaaggtatacagattccaaaacgtcatgttgtataccacaaatatatgaaatttctacttgtcaatttttgaaaaaaaatgtttaaaagaagtgtgtaaataacttcttactttagatataaaatcttaagggccaggaaaagggcaccaaaatccagcctttgacatctcagaagaagcgatgattaatttcatttcattctgttggtttccatggagtggtgctgggtggtgaggcaaacacagcagcaggaatgttaacatttcatattttagccctaggagtaaagaaaaaaaacatgtcccagatcagcactagctagaaccaggaaaccccaaaagcaaaggtttttttgttttgttttgttttgttctgttttttgtaaaagacaggttttcacaaaggaagttttccaaattctatgtataagagagttgagaaggaagatttttctctcttcttgcccaggaggacaaagggaagagtaccacattaagccattcaggtaaagtgaagcttattgaacgctgtggattaggataaaactaatagagttttcatttttaagccagttcagatattcagattaattatggacgtaatgtagaaaataccaatttctgcaagttctacatttcatgtgaaatcccaaagaggttaaagctgatgggttttaactgatgaaaacacgtgcctctgattaaaaatgtttgtagtgatgaaaacaaagcatgctagagttacagtgtgtagcatgctgaagccaccagcagagcttaggggacaaaaacaactgtttcctaagagaaaaagaggctgagtatcttaagcctggggaagggaaaagacagtagttagcaagctcaggttagccactggtattactctacctttcatgagactcttcactggggaggttggggagattcggtctcacctaaaggagagatggctcgtgaacccaaggatgctgcagggaccctggccaccacttgcagcccaaacactagaatgaggaccagagaacacaatctagctgcttcccatccatcccctccaccccaacatctggtctcagcaacttcctctgccctacactgggatgccctccttagttgatctgaaccatgcagcagatgaaacatgttggcctgacaagtagcagatggctataattgcctgagccatctacaccggcaaatttttcttctttatttgcatatgagtaaaatttttcccagtgttaaattatggtgtgagtagagattttttgagggagcacagcgcagttgtatagacatcgtgattgacaaaaaataaataaaataaaataaaataaatgaccaaaatctgctaaatgaatttgaattaaattgttctaatgctttctttttctttgtaactcttcaccaccacctcaatacatgcattcctggacattcacgcatacactcacacaaacacaagcatggtattttttgtgtgtgagacactgaaggtagcatgaaatagcaaccaaaaaatctgcagtattaaagttagatatgacttggtttgacttgcaaatcaactgcctcactagtaagatgacttctggtatatggatatgtctctcagttttacaggcttgttttcggattaatggtaatagatgtaaagaattgggcacggtaagtcaatagtcaaagctattcaacaaattgaggacaaacaaggaaatgggttaggaattggtctgtagccagtctcagaaatgttgtattaacctttgggatataatcccccaaaattaaagtatagtgattcatccaaaagtacaaagtgttactagcaagatggatgaggatttccatctaacatttttcatcttcttatccctgacacattattaaaacacctagattttggtaaaagaggagaagtcatgtcttggacaggattgaaggttgtgtcaacattccctatgctttcaagtttcagctttagaatccaaaacccccgggcacagtggctcacatctgtaatcccagcactttgggaggtcgaggcaggcacatcacttgaggtcaggagttcaagacaagcctagccaacatggtgaaacctcatttctactaaaaatatggaaattagccagtcatggtggcgcattactataatcgcagctactcgggaggctgaggcaggagaaccgcttgaacccgggaggcagaggctgcaataagccgagattgcattgcaccactgcattccagcctgggcagcagagcgaggctccatctcaaaaaaaaaaaaaaaaaaaaaaaaaaaagaatctaaaccctttggttcacagatggaaggaaaaagcaggcggtgtttcctattctatgtgtatgccatgcctcgagccctgaacaggctactcatctgtggccaatattatattataacctctccattctcagaaggcacgctggcacccatctctgcaagaaaggcatcaaattgtctgtaagtcacagaaatgttattgtattgtcctttattcattcattcagaatatactctctaagcatctatgtaattaaacattactaagcttacatataattaacctcgaaataataactaagcattgttagttttatgtacggctaacttaagaaataaactcactttctagttatcagttttggaaaacaaaagagctctataacaattttgaattaatcaaaaattggagaattctgtgcaaacctataatccttccctctttagggtgaaggagcaacgctttgtgttacttaaagacacactttgccattgtgattaactataataacttttaaaataatcaaaaaatcagtccactttcttgtctatttgtgtattgatcactaaaattattgtacctagtatgatcaactttgtatattactgtatttcattaaagcagctaacttctcttgtccagacataagagaacactagaagacaaaaaacaaaaaacttttatgaatctcttttccttacgaacactaattttataccattttaacatacttgaggtggcaaaaataaacatatatatattatatcatccaaaagtatttgcatattttattaatctattgccattctaagaattcagggtaagttaaaattgtgttaccaaccagcatttattttgcatctgtttcactcttgaaattgtctaggtttcaaagattattaactaattaacttcaccatttgtctaaggtcttaaagttagttaaggatcgagaaatcacaatttttgcaaacataatgaatcctgacacccagcacttaaaaattttacaaaacttaattcttttaaaaatccattaccttttcatttaattgactataattatatgtatgtatgtgtatacattttaaacaagttataaaatttgtgatgatccacttataaaaacaatgtaggaaatttaggaacttaaatgataagaaatttatcattggtctcgtacaaaccaaagtattattctgatattatttttatatgataaatgaaattgtaaagaccctaagtcgtgctcaaggctcttcttctatcttgaactaaggttttcttcttatcttgtaactatagtaacaagggctacaaaagaagcacagcttaatatttttccttttagacatttttgactactaatatggtacagatattcctaatgtgcactcataatgatagagtgaatattttaatcaattttttttttttttgagacggagtctcgctctgtcgcccaggcgggagtgctgtggcgcagtctcggctcactgcaagctccgcctcccgggttcaccccattctcctgcctcagcctcccgagtagctgggactaccggtgcccgccaccgcgcctggctaattttttgtatttttagtagagacagggtttcaccgtgttagccaggatggtctccatctcctgacctcgtgatccatccgcctcggcctcccaaagtgctgggattccagacatgagccaacgcgcccggcctcaattaatttttaaagcttcccaaaagaggataaaagaggaggaaaggaatagaaaaaaaagcagtgatagggacccaccttcagacacttaagacattatcgctgtaaaaagcaagggtcttccctctgcaagaagaggcactaaatgtttagattcaggaaaacccactgtgacatatatacatgcaaaagataactcttacagctggtataaacaattatttgggccttgaaattcttatcaagtaacatgtttaaaagccagactttattaatcctcaaagaacagaaatgtagaaaacagcatttacaatgagccaaaaactctctctttttagattgcaagacaggtatctcttcatgaagctttctccaatttttgttctcaggcaccactcaaatgaacaatcttgttcatgtcaaaaaggtccccaaaatagccactgcagttcaaaattatcctgtgaaattggctaggcatggtagctcacatctgtaatcctagcactgaggtgggcagattgcctgagatcaggagtttgagaccagcctgggcaacacagtgagaccccccccgcccaccatctctactaaaatacaaaaaattatccaggcatagtggcatacgcctgtagtcccagctactcgggaggctgaggcatgagaattgcttgcacccgggggtggagttcgcagtgagccaagatcacgctgctgcacttcagcctgggaaacagagcaagactctgtctcaaaaaaaaaaaaaaaaaaaaaaattatcccgtgaaattctgccagttaaagacacaagcatgtcagttaaggtgatgtgagaaagcaggtatttgtttcatagaaaatgcccagttttaggatggatcagacactatgagcactgcaatagatcctcccacacgatggtgcccgtgcagcctactttcgtcaggacttggccaaagcccattccagggtcagacaatcccttctgatttcaagaagcctaatctaaacaaagcagctctcaggaaaagaacaagaccgacgaaaaagttcttctaagggttcgaaatcatgacccaagtcaaagtttattcaaagaatgttgattgtaggagaacttctgaactcctaggcccctgagccagctcaagaactgacttacctggcttatgctcattgtctccctagagaccttttgttttagagataaagaacactcaagacactgtacaagcagacagtccataggaacatatatctgtagactggtaaacagtatcaccaaagaacaataaaaatcagatcagataaccaaaaagtcactggtaaccttattcctaggggaagaaaaaaaaagagagggagatagagaaaaggaaggaaggaaggaaggaaggaaggaaggaaggaaggaaaaacacctaaagtggaaggacctcagcagaatatggaagctcagttcagcatgaacttctcctagcacgggcagtgtggttacatcagacagctagagacacaaagggtctcaaataagcacactaaaattggtgagtggagggttcccatccaagactgtagggctcacagatgaatattgatggatcttcaaatgcagagattaattacagccactgaccactaggagcccacctgtagtagaacaaatgtgggattcttcactcattgcatcatgggagattgctcattatggagaaccatagaggcatctcagtaagaggatgctggaaagagggtgctagaaagtgctattcggttttcagtaggtgatttggggagagttaaaaaaagtaggggtttgttctagattggatactgtcaggaagcaggtaattctgtgattgaatatcttaatttttttttatcttgaagacagtagagaaaaacagctgtagttggtaaagaagtagaaatgatgtgtattaggctgagaaggggtatgttggatcattttcgtgttctggccagttttcttttttcagtgctgagacatgtctcatggagtgacctcttctttgcctttccccatgaaggtcacggaatgaccttgtctgatgttgagttctgtgaaatggatcaccccaaacagaagcacacatggcctggctgtgagttcccaaacagctccccacgctcaagagctgcttttctttctcattctcaattaaggattgaaggaggacacaaaaacacgatcaccaaaggaaaatgaaacaaatttaaagtaaataaaactcagcaaaaagaaaaactacaggaaaagaaaagtaactgtaggaaacaataatgacttagccctaaatggcatttacgtggtcttaatcatatgtgaccttaatcctataaaaaccaaattgtgatctaactccaagtccaacctgcctattttagaagggtagttggatggtgctagtggatggtggggaggagagtagaagctaactcatcatcatccgtattggtaagtgaatagataatgcctaaaaacatgtcatgaaattgcaatgtcaccacatcatttggagatacgtttttaagtcagcctaaagggttgaaaatgcttctaggctggggcaacgggagggcagagcatagaagatggtaatgattcctgaccatccttcaagaactatctttctaattttttccatcttctcctccctgctttattctagccacactggcagctgattagatggtgcccacccagattgagggtgggtctgcctctcccagcccactgactcaaatgctaatttcctttggcaacaccctcacagacacacccaggaacaatactttacatccaaccaagttccaaggattggaacaatacaatcaagttgacactgaatattaaccatcacacacagacatatatacatatatatatattttttagacagggtctcactctgtcacccaggctggagtcgagtggtacaatcatggcttactgcagcctgaagcctcaacctcctcagctcaggtgatcctcccacctcagcctcccaagtaactgggactacaggcacacaccactacaccttgctaatttttgtattttttgtaaagatggggtctcactaagttgtctatggctggtctcgaactcctgggctcaagtgatccacccactgtggtctcctaaagtaagtcatggcacctggccaactttttttttttttctttttttttgagatggagtcttgctctgtcgcctaggctggagtgcagtggcacgatctcagctcaccacaatctctgcctcccaggttcacgcctttctcccacctcagcctcctgagtagctgggactacaggcgcccacgaccacgcctggctaatgttttgtatttttagtagagacagggcttcaccgtgttagccagaatggtctcaatctcccgaccttgtgatgtgccctcctcagcctcccaaaatgctggtattacagatgtgagccaccacacccggccccaactttttaaaaatattttttaaagaatgagtagaagtagccaggtgaagaaaagaaaaggaaacagagctgggaaaaggtgtgttgcatcagaaactagaggagggcatttcgcctggaccagagaaagttctgatgagccaggaaggctgggcagagccagctcaggccaggcaggcgcgattctgcacaggacaggatgcacctccaatgaccacgtgtttctaggttgtttccaagggcacacagataacagtcaacgatttttttctgactagccactgtagtgatcgctgctgtgtgaccctccacactttgcttccctcgggcctcagctccgcctcattccactggcctaataattaactcagccttattttcccaacctaattgtttcacagaccaaaagaaatattggatgtaaggtacaatttgaaaagtgtaatgtgctctagaaatgcataaaatgatgattagtctttgcccagtaggctttttagcttaataagctcctgataatacagaaatcactgtgagcaactggcagagaaagatttttccatttctcttaactaagaaaagagatttaaagtcactttggagagctaacactaaataataataactgccaaaggaattgatttgatgctgaatataggcttgtgtaaggaggtaaaaaactgtccactaaagttaatgctcatagtaagaggcctctgtccttgaattcaccttgagagagttgaacagggataacggattttcaaggacacacatctacagagaaagggcgtatggaaatggaaaagggaaagctgctcctagtgtttttgctgaattgttctctttctctaacccagcaggagagatgctaaaggagattttgtcaaagaaaatccttgacattggattcttaaaagccttatggtttcatgataggccctttaccaaggattcttaagggacaaccttatgttagagagaaacaaagtcctgaatcatatttcctcctctctggaatatatgtagaaatacaagtgagaagataaatacatgtgtaaaaagaaaattcatactttcatactcgttatatgttatgattaaatgttgattgcatttggagagcatcagcatatgaactatattacagaaaggatagtcttttgtttcatggcttaaatcttcttttctcaataagattaaggggctagctaagattataatcataacaattttttttttttcactgagtttccaccctgtgaggaacactaggctaagcaggaaaaaaaaaaaaaaaagtcactaaaagaccctaggctatttgtacaccaatgttcatagcagcattattcacaatagcaaaaaggtggaaagaaccaagtgtccatagatggacagataaacaaaatgtggtctatacgtacaacatgggtgaaccttaacattgtgttaagggaaataagccagttacaaaaggacaaatactgtatgattccatttctatgagatacttagaggagttgaaatcatagacacagaaagtcagatggtgactgccaggggctgggaggagggacaatggggagttgttgtttaatgggtatagagtttcaattttgcaagacaaagaatttccagagatgggtggtggtgatggtgcacaacaatgtgaatacacttaatgccactgacttgtacatttaaaagtaggttaaaatgggccaggcatggtggctcacacctgtaatcccagcactttgggaggccgaggtgggtggatcacgaggtcaggagtttgagaccagcctgactaacatggtgaaaccgcgtctgtactaaaaatacaaaaattggctgggcatggtggcatgcgcctgtaatcccagctactcaggaggctgaggcaggagaatcactggaacccgggatgcggaggttgtagttagccaagatcatgccacttcacttcagcctgggtgacaaggcgagactccgtctaaaaaaaaaaaaaaatatatatatatatataggttaaaatgtccattttatgttaggtacattttactgcataaaaaaaaaaaagactatgggcaagccatttccttcctctgtgcctcagtgacattatctgtgaaataaatgtgtagaaacagatggactccaaggatgcattcaactctgcaagtctgtgtgtctaaacatcccctctgtcctcatggggtttagcagcaagttggagagatgaaatgcagtaataaaatgtaaaatacttctagttaatgttttaagtacccaattagtgattttttaaaaaggaatatgtattcccttgagaagggatagagcagaaatctggaggacagctttgtggagatagaactggaccatgcccacttcaagaagtatgtagctcggatgtggatctgtgccagtgggatggccttaacaaaggtgagcaggcttcaccacaccagggggtccgtagaacagcaagaagatgagcctgttggtggtagaaggcttctgcgtcaaagtgaagcattgaggaggacccatgggtgactttgagggactctgaatggaagagagtggatggacgagacacctggcctatccacaaactggccctatagccttgaataatcactgggacctcagttcctgctgtatgacaccaaggctagctcctttacaagacggaagcacagcctagctgatcttgctcttcctgctggaaaactccatgattctctttgccttccaggcaacagacacataagattcctgctgccaggtcactgctggatgctggactccagcagtgacaggccccgaacctgcccttgtgaaggccactttcttagtggtggtggctcatctagcaggctgaggaatgtacaaaggatgtgtaagaaaatctacctagcagtagggtatataatgagttaaagaactgagcttctactggcaatgagaccagccagggtaatgttgcaaaagtttagatgtacattaagacccagaagggctgaacttggttaggggagaggaacatgaaatgaaaagtctaatgcatgaaccctagaaccacatgaatattaaagctcacactgaagtatctgtgcctccttctcccttgccctgccctttttcagcctcccaaagctgcacccattcctcctgtgtccccaatatcccctatgccatgtgatgtggtttgactctgtgtccccacccaaatctcatctcgaactgtaatccccatgtgtcaaggggggacctggtgggagatggttggatcatgagggtggtttgccccgcgctgttctcaggatagtgagtgagttctcacaagatctgatggttttataaggggctcttctcccttagctttcgcttctctcgcctgcctacttccccttccccatgattgtaagtttcatgagacctccccagccatgtggaactgtgaatcaattaaacctctttcctttataaattactcagtctcgattattctttttttttttttttttttttttgagattgagtctctctctgtcacccaggctggagtgcagtggcaggatctcggctcactgcaacctctgcctcccaggttcaagcaattctcctgcctcagcttcctgagtagcttggattacaggcgcctactactgtgtctggctaatttttgtatttttagtagaggcagagtttcacatgttggccatagttgatcctgatctctcaggagatctgcccaccttggcctcccaaagcacttggattacaggcatgagccttgggtatttctttatagcagtgtgaaaatggactaatacaccatggtaactgggtcccatacatcctgaaaatactaatagaacaaatattcccactcctgaaatttaacttgatcctgaagacgaaggatttccttgagctcataaatggaagtggttcatcttccaggtagagaatgcaaggtagattggttttgttcacaggggtcatgcagagctaagcacatagaaggtgctcagtaagcacctgctgaacatactgaagtgacatagccaggcagagacgggtaggtggacagccaacacgccatgagagctggaagggcgcatcctctcttaggagcttgggccctggccagctgactcagcttcaagctctgctagtacataagtccctcggggcctataagcttggccgtgttgcagctgaaatttctgctgaataaggtcatacatactaagctgagaatgcaatagtgagaatggctccttctttttcgcatcccagaccccagaatagaaatatttaccatcacgtctggatgataatatcaataaattatcagacattgcacgtattaagaaaagctcattttctggaaattgtccttattgtcctaattgggaattatcttgaagccgtggatagaaaatgacctttcagattgctgggacaaagcccaagtctaaattggaaacgtgtttaatggctaagacagcccacttccagattaattatggatgcttttccatttcaagattacattaggaaggaaagttgtcactgggtggaatgtgagtctccactgcatccttttaagataaataagttgaagtttgaagaaaatttgagattacttttggttaagtgaataaaatctgtttagcgaactctttgaagttgtggattgcctgggaatctacaaatctgcaacctccctccctctagatacattcagagggtagaagagaagtcatttaaaaccttatgcttgacttcttgcttcctgccttggtttttaaccaaaactaaaaataaaaaagccaaaagagaggaaacttgataggttcaaaacaggaaattagattgtaagcaaagaaattgtccaaacatcgaaaaaaggaacacatcaaagaagggaggtgctttgtttttatactttgttatcgtcctggaaaaaaatgtctgctgcctctgataatacatattaacacttcttttttacttagcttttatttttatcaaagtaataaaatcatcttgtttaaagtgtcaaatagttctatatggcttattaggataaacaaccatccaattttcaagatttttttttcctttggcatttgtctttaattctctaaatatattcacctgctacttgaggggtcagcagacttttcctgtaaagagcaaaacaatgagtattttaggctttgagagccatagagtctctgttgcagttactcacctctgctgttgtagcacaaaagcagctgtgggcaatatgtaaatgagtgggtgtagctgggtgctgaaaaaactttatctacaaacacaggtggctgcacagtgggctgtcctttaccgtctcctaggctactccttgagtttctgtttttagtcagtcactgttaggtgactcctgactatggaagatgaggattaggctctttcacagccaacaactctcctccatggcctcctcccctccatgtttttcctttaccttcacccttccaataggatggtttactggctttggatagatccgtatgcagtgtttacatcatcatgcttttcataactgaaccatataatagagctgtgtttccagccaggcatggtggttcattcctataatcccagtgctttgggaggcacaggtgagggattgcttgaggccaggagttcaagatcaacctgggcaacatagtgtgagatcctgtctctacaaaaaaaaaaaaaaaagacattaacttggtattatggtgcacacctgtagtcccagctacttgggaggctgaagtgggaggatcacttgagcccaggaattggagactgcagcgagctatgatagcaacactgcactccagcctgggtgaaagaccaaggccctgtctcaaaaaaaaaaaaaaaaaaaaaaaaaaaaaagtttcctttcctacacactattttgttttccttaatcattatattgttttcttcatttgcttaattttttgtgaactaattatgaattgaaactcaagctctctctcaattttaaaatcttccctcaacatattgcagccaatataagaggaactcaccatttcattttcttggaaacttctaccccagagcattctggctggataggccttgggcatctgtattagtctgtcttccttctgctataaagaactacatgagactgggtaatttatgaagaaaagaggtttaattgactcgcagttctgcagggttaacaggaagtctggctaagacgcctcaggaaacttataatcacagcagaaggtgaaggggaagtaagcatgtcttacctctgcaaagcaggagaaagcgagtgagctgggatctgccacatacttttaaaccatcagatctcttgagaacccactcacactatcatgagaacagcaagggagaaatccgcccccatgatccaatcatctcccaccaggaccctcccctgacacatgggattacaattcaaggtgagatttgcgggggggacacagagccaagccgtatcaccatccttgcatctctcttctccatcatcatagataacctgggcctccggatggcatgagatccccctcctacccggcttccatgactttctctttgttgatctagtcccttttttaaaaatggagccatccttctgtagcttcctgagaaagaatgaacgggaatcacattttctgaaacattgcaagtctgaaaatgtctttattctccctcatgcttaattgaaatcagactgaatacagaattctcatttagaaattatttcccttcacaagtttgaaggaatttgtctattgtcaatagtattgctctcaagaaattcaatgccattttcattctcaattctttatttgaactcggtgtttttctctctggaagattttaggttcttattcttctttgttttctgaaatctcatgaatattatttgatgtgggtctattttgactctttctgttggaacacacatggggccttttaatctggaaagccgttcttgaactctaggaatagattttgggggacaatttcttctttcatttcctgttctctcttcccagaatttgttattcagctatcagaccccatggactgatctgttattttcttatattttctttcatttgttcaatttctttggctgttgtttcccctattctctgaacaatgttctcaaatttacatttcataaactctcattgagtttttcacttctttttttatgttctgaatttccaagagctctattttttgttctttgaatgttcctttttttaaatcatctgttctcatttcatgaaagcaatatgttatctctcagaaggtattaatgacggttttctcccaagtgtttcttttcctactcagcctctttttccttcaagtagctttctttggttggttggttggtgtgtgtgtgtgtgtgtgtatatgtgtattttcgtttgtttttcttttttcttctcctgtgtttgagacatgtcctcaaatgcctggttcccctttagctgacacccacatttaagattgaggcactacaaatatgactgaaagttctgtgcacacaaatggggcctgtcacccgtgggcttcagtggctgagttgtttcatcgggaagcccctgatgttgcatcactgagatttttgtcttgggctgattgaaagctccagagaagaattttctgccctgttgcctggagggtagacacctggctgtcactgttctcacagctaagaaggaagaggactgcgaggttcaagattcagtgtgtaaatgttgactgaagatccctgttttcagtacagagcccctgccgtcctatgcctagagtcctccaactgagagtctctgtgtccttcccagagaatacatcgttcctcttctgccagagtgaggggaggacagatgcctggggtagggatctggggatataaatgttcttcacgagcttccagtgagttcttctgtttttagcttcacataaacacacatatccagtggaaactcttgccatcaactgcacaaataatgggcggctttgcagtgccaaccgggctacttctcagcactctccacctcagtgcaagcatctgtccttggatatgctgccacttaagatggttctgctgtttttcagctctaaaaaggttgttatcatcccctgcctcatgatttgttcttacaccttcgtatatcttaacacttcattccccttttcacgggctttatgaagaagcagtggtaaatgtaggtgctcaatccaccatctttaatgggaatccttcagcacttctattttagaaaaaatgtgaagaatatacatagagactgggcatggtagcgcatgccggtaatcccagcaatttgggaggcggaggtgggcagatcacctgagttccggagtttgagatcagcctgggcaacatgacaaaacccacccatctctacaaaaaaaacacaaaaattgcccaggcatcgtggcacacacctgtagtcccagctaatggggatgctgaggcaggagaattgcttgagcctgggagatggaggttgcagtgagctgagatcacaccactgcactctaacctgtttgacagagtgagaccctgtctcaaaaaaaagaatatactaaacactcatttcacaatattcttgacttattaaagctggagtcatggcataatttccaatttgcttttcaaaagaattaattgatcagctaagaaatttacaagtaatttttttcaaatagtgaggtcccttagtattaaaatgaatttcatgttttaatactaggtttttcctcccacgcagtgaattttcttcttgctttaagaagaaatgctctggagagaatataaaattatatatagttgtgtatgaattatatgtcataggattacatataattatatgtaaatataattacaattataacattaatacatgttcactgcagaaaacttggaaaaaaacaaagagtttaagagaaacttcataatcaactgtattctcaacaactacagaaagcttaaccaatgatttgtccgtatccatggctaagaacgaatgtacctacacatctgtgccatttttaaattggcattttttaaaaagtagatccaattttagaagtttgaaatctagtttaaaagcctagattttatttttttccattttaacctatttatgtatttatttatttatttatttatttatttatttatttattatactttaagttctggggtacatgtacggaacgtgcagttttgttacataggtatacacgtgccatggtggtttgctgtacccatcaacctgtcatctacattaggtatttctcctaatgctatccctcccctagccctcccaccccccaataggccccggtgtgtgatgtccccctccctatgtccatgtgttctcattgttcagctcccacctgtgagtgagaacatgcagtgtttggttttctgttcttgggttagtttgctgagaatgatggtttccagcttcatccaagtccctgcaaaggacgtgaactcatccttttttatggctgcatagtgttccatggtgtatatgtgccacattttctttatccattctatcattgatgggcatttgggttggttccaactctttgctattgtgaatagtgccgcaataaacatacatgtgcatgtgtctttatagtagaatgacttataatcctttgggtatatagccagtaatgggattgctgggtcaaatggtatttctggttctagattcttgaggaatctccacaaagcctagattttctagaggaattcttctctatacagggaaacattgcagtaatgagtttaagtgcattgattctttaagcacatttgtttgttgaatgataagactattgtatgtagttcacatccagccccctacacaactgtcacacacaatgaccttcacagtgattcatgcctgaacaacattgtttcctttgcctttaggcttgcaattgggaactcattttatttgaaccaaagccttcagtcgagatgaaaattttcactcacgtctgtgtgaagagaccaccaaacaggctttgtgtgagcaacaaggctgtttatttcacctgggtgcaggcgggctgagtccaaaaagagagtcagcaaagggagatggggtggggccattttataagattcgggtaagtaaaggaaaattacagtcaaaggggggttattcgctggtggcaggagtgggggtcacagggtgctcagtaggggagcttttgagccaggatgagccaggagaaggaatttcacacgataatgtcatcagttaaggcatgaacaggccattttcacttcttttgtggtggaatgtcatgagttaaggcaggaaccggccatctggatgtatacgtgcaggtcacaggggatatgatggcttagccttgggctcagaggcctgacattcctgtcttcttatattagtaagaaaaataaaatgaaatagtggtaaagtgttgggacggcaaaaattttggggggtggtatggagagataatgggcgatgtttcttagggctgcttcgagcgggattaggggcggcatgggaacctagagtgggagagattaagctgaaggaagattttgtggtaaggggtgatattgtggggttgttagaagaaacatttgtagtgtagaattattggtgatggcctggatacgattttgtataaattgaaaaactatacggaataagagaaggagaaaaacaggtattaaaagactaagaattgggaggacctaggacatctaactagagagtgtccaagggggttcagcataattacttacttggttggcaagtttttgggctctatccttgagttttttatgttgtcatacaccaggccagattgatttaggtaaaaacaacactcttcatttaagaatatacagagtcctcctttttcagcagtgagtaagtcaaggcctcagcggttttggaggacaactgcagctaaagagtcaacttgggcctggaggactgataaagtttgtgatatgtctgtgatgctagcagagaagtcattagagaggctacggaaggtcgtgacagaggttgaaatgcctgctattccagtaccgagagcaatagtagaggcagaaagtcctaaaccgacaagcaagggaattagtggaataactcttttttgtcgtgtcggtgtcatgaggggaacagggagctcttcggtcctatttgcaaattgaattttgggggtaaggaagactagtgtgcatgtgcctgtccaattagcaggtagacacatgtaggtagaggatccacagacgaagagaccttgtgcgaggcaaaactggagatgcaaagtaaagagaagcagtgctgaaaggggtgtcttgtacccagactcctaggtatccagctagggtggcagccgtcagaggttgtaatggggattgatgaagtaactgcgtagagggggaggttcgatttacatggtgtgtgagaaaacgttgagtatctacgagcaacctttcactgttattttcggggctgggtataagtaaacaagaagagggctttggagatgaagagtaaaggaacatcgagaaggtgaaagattacctaagggaattccagtaggtctttgctgagagatacataaaggagcggccacaggaatagtagtttgtgttgtgagaggtctaaatatggggggagtagagttgatataaggagaaaggtttttcaagtaagtgtggaggagggtggcagcttgctgatgtgaaatgtctggggaggtcttgctggacctgtctagaaagtaaatgagttcttcaggagggtaaaagtgagggctgttaaaggaagtctggaggtgtagggagacaggaggtgttgcctagtctgcatgtaaggtggggacaactgtgtaggccctggaagaaagggaaatgcaaagccagtggttgtttgctaaggagggattagaaacggctaggagagaatgagtaaggttgatagcgtggtggagatagctggggagaggtagagggtggcagaggaatgggaatgagaataaaagtgagtataaaagtaaagaatagaacttcgtcagggtgaaagtactggagggtcccctgccagcaaagatcatctatccactctaagagggagttaagagttgccagtcctgggcgggggcaaatcctcgagcttgatgtgtagggaagggagggggcctgaataatccctgaagagtagcagaatagcagatggaagaagttacttccttgaggatagatttccacgatggaaagaaaatgagaggttctaagaggcaggctagtggcttgtactatagcatagcctgcctttgctggtgtgtggcgattaggcctggtggaactgccatcaataaaccaagtgtgttcagggtgaggaacaggaaagaaggaaatacggggaaatggggtgaatgtcaagtggatcagagagatacagtcataggggtcaggtgtggtatctggaatactgtgtgaggccggattgaagtctgggccaggaacaatggtaattgtgggagattcaacaaagagtgagtacacctgaaggagccggggagcagaaagtatatgcatcaggtgggagaaagaaaatagatcttggaagttatgagaactgtagacagtgagtttaacacagtttgtgattttttgggcctctaaaagtattaaagcagtggcagcagctgcatgcagacatgagggctaggctaaaacagtaaggtcatagttgtttggacagaaaggctacagggtgctgtcccggctcttgtgtaagaattctgaccgcactaaccatgcctaggaaggaaaggaattgttgttttgtagaagggattggggtttgggagattagccagacacgatcagcagggaaagcacgtgtgtttttatgataattatgctgagacaggtaacagatgaggaagaaatttgggcttgactgaagtaatgggagctgtctgtgaagccttgcggcagtacagcccaggtaatttgctgagcctgatgggtgtgagggtcagtccaagtgaaagcaaagagaggctgggatgaagggtgcaaaggaatagtaaagaaagcatgtttgagatccagaacagaataatgggttgtggagggaagtattgaggataggagagtatatgggtttggcaccacagggtggataggcaaaacaatttggttgataaggcgcagatcctgaactaacctgtaagccttgtctggttttaggacaggtaaaatgggggaattgtaaggggagtttataggctttaaaaggccatgctgtaacaggcaagtgataacagactttaatccttttaaagcatgctgtgggatgggatattggcattgagggggtaagggtgattaggttttaatgggatggtaaggggtgcatgatcggtcgctaaggagggagtagtggtgtcctatacttgtgggttaaggtggggagatacaagtgggggggatgtgaaggaggcgttgaactgggggaaaaggtggcaatgaggtgtggctgtagcccaggaatagtcagggaagcagataatttagttaaagtgtctcggcctaataagggaactgggcaggttggggataactaaaaaggagtgcttaaaagagtattgtctaagttggcaccagagttggggagttttaagaggtttagaagcctggccatcaatacccacaacagttacggaggcaagggaaacaggcccttgaaaagaaggtaatgtggagtgggtagcctccatattgattaagaaggggacagacttgctctccactgtgagaattaccagaagatcggcatccgtgatagtctagggggcttccgaggtgatcgggcagcgtccgtcttcagccactaagccaagaagatctgggaaggagtcagagagccttaggccagagttccaggggctctgggagtggctgccaggtgagttgaacagtccgattttcagtggggtcccgcacagatgggacatggcttaggaggaatcctgggctgcgggcattccttggcccagtggccagatttccagcacttgtagcaagctcccgggggagaaggttctggaggaatccctggcagctgcagttcaggcgtttggagttcttgtgtgctggagatatggctggggtttgtctcacagtggaggcaaggaattgcaactcagaaatacattgctacttggctgcctctactctattattgtacaccttgaaggcaaggttaattaagtcctgttgtggggtctgagcaccggaatttaatttttggagtttatttaatgtcgggagcagattgggtaataaaatgtatattgagaataagacggccttttgaccttttagggtctagggctataaagcgtctcagggttgctgccaaacaagccatgaactggactgggtttttatatttgatgaaaaagagcctaaatgctatctgatttgggataaggaaaaggagcattaaccttgactatgcctttagctccagccacctttttaagaggaaattgctgggcaggttggggagagcttgtcactgaacgaaactgtaagccggactgggtgtgaggaggggagatgataaaaggattgtagggtggaggagtggaggctgaggaagaattggaacctagctcgacctggcaaggaggggagaggtcagatgggtctgtagaaaaggaagattagaaagactcagcgacacttggggttgggactaaggggacaggtgggagggaaagaaggaagatttgggacaagttgcattgggaacagagactagggagggaccgatgtgtaaaagagtgcctggatgtcaggcacctcagaccatttgcctattttatgacaagaattatttagatcttgtaggatggaaaaattgaaagtgccattttctggctatttggaaccactgtcaagtttgtactggggtcaagcggcattgcagaagaaaataaggcatttaggttttaggtcaggtgtgagttgaagaggttttaggtttttaagaacacaggctaagggagaagaagggggaatggagggtggaagcttgcccatagtgaaggaggcaagcccagagaaaagagcaagtagagacatggagagaaggggtcggggggttcttgccccctagaaaagcggtacttgccgctgagggtgaaggagaaggagttggggggttcttgccccccagaaaagcagagaaggggtagagacatggagagaaggggttagggggttcttgccctccagaaaagcggtacttgccactaagggtgaaggaccaaggcaggcgtccccgtgtggtcagatgcctctgaaatgtgggtgaataatcaggcaggcgtccccatgtgattaaacaccaagggaagactgtcttccccagtccgtgaccggtgccggagttttgggtccacagataaaacgtgtctccttcgtctctaccagaaaaggaaaggaactgaaattaagagaagggagagattgaagtgtggcaccaagattgaaaggagaaagaggttgagggatagtgagagaggttggagaagagagtaaaaagaggccgcttactggatttaaaattggtgagatgttccttgggctggttggtctgaggaccagaggtcgtaggtggatctttctcacagaccaaagagcaggaggacaggggattgatctcctaaggaagatcccctgattcgagtcacagcaccaaatttcacttgcgtccatgtgaagagaccaccaaacaggctttgtgtgagcaacaaggctgtttatttcacctgggtgcaggcaggctgagtccaaaaagagagtcagcaaagggagataggggtgaggccgttttataagatttgggtaggtaaaggaaaattacagtcaaaggggggttgttctctggcgggcaggagtgggggtcacagggtgctcagtaggggagcttttgagccaggatgagccaggagaaggaatttcacaagataatgtcatcagttaaggcaggaacaggccattttcacttcttttgtagtggaatgtcatgagttaaggcaggaaccggccatctggatgtgtacatgcaggtcacaggaaatgatggcttagcttgggctcagaggcctgacaaaaatgttgttaattgctctggttatagacagaatagtagcaggaataaataatcagaaacatttatggattatatctttgttgatattttaaacctatcagttacctttctagcctaatgagaatgccttgataaagccacattcttggaaattttggttttcataaatgtgcttgggttttataagtcctgctttgcctaccacttgaccaaattccctacagacttttttatataaacacctatggttaagacaaaatgtgttctttcaacaatgtacagcttctgagagtaatgtctaggctggagtatattcatatatattatttatgctttcatttaacaaacacatgctgagatcctactttttgccggacttagtactgattgctctctcctgagcatccttcttaagtcaaagagaatattcattgttagggaaggaaaaaaagatagagggaaaaaaaatagatggcaagaacatggcaggaacccagtcctgaacacccaggggttttcagaataagggagaggttaacaatctacatagagcaactgggattaaaaatgggaagctggcttcatggggggaggaatagcattaggagatatacctaatgtaaatgacaagttaatgggtgcagcacaccaacatagcacatgtatacatatgtaacaaacctgcacgttgtgcacatgtaccttagaacttaaagtataataaaaatatattaaaaaaaaaagaaatgggaagctggctgccaagactgcaggaagactgtgtcagattcagagcatgaccatcagcaaggtaaatccctactgcccacagtcataattggcaccagactctaggaaggaattatatatttacgtggtgcctaatggggatgtgaggatctcagagggagaaaactaggtaggcacaaataatacccgcacaggccttatttacacctattttatgcaaagttctaatagaaatcattaactggtttcctagcccttgcaagatccaacacaaattagtagaatgttctagaaggaatagaagtaaaaatatcaatcacagtaagaacaggcagctagatgcatattggcaagagggcagataaatagaaagatgtgagaagtcaaaaatcctattgcgatctcattttgcagggaaccaaagatcccaaatagctctctctggaggcaccagtgtatatattattaaagactcagcgagaaaagacaattcactttaagacagcaaataaacaaataaacaatgtggagctgccattcccaatccatttatctggaatagttcagcctcatttggcaatctgtattttttctgaagccccacggggtcattaaaaactccataggtcccaaatgtatttgcataatgatagatgccatccccctgcctgacagtaaagaagcagcaatttaaaaagtatgatgccagccaggcacagtggctctcgcctgtaatcccagcactttgggaggccgaggtgggcagatcacctgaggtcaggagtttgagaccatcctgaccaacatggtgaaactctgtctctacaaaaaatacagaattagccaggcgtggtggcacatgccagtaatcccagctactcgggagactgaggcaggagaattacttgaacccaggaggcagagtttgcaatgggctgagatcatgccattgcacttcagcctgggcaacaagaatgaaactccatctcaaaaaaaaaaaattcatggtattattcttttgaggaagcatactagaaatcaagaatcaggccaagtgctgaggctcatgcctgtaatcctaatgctttggaaggctgagatgggagggctacttgaggccaggagttcaagatcagcctgggcaggacagcaagactccagtctccaaaaaaatatttttaattaaaaaaggaccagtcttattaaagtaaactgcagtcctgttactgatcttagtatcaaagcaatgttagagcccacgtgggattcacacctcctagagttcacagcacaagtttgctgtaacagtagataaggtcttggttgccctgagctcatttcttttttttttttagacggagtcttgctctttcgcccaggctgaagtgcagtggtgcgatctcggctcactgcaagctccgcctcccgggttcatgccattgtcctgcctcagcctcctgagtagctggaactacaggcaccacgcccggctaattttttgtatttttagtagagacggggattcaccatggtctcaatctcctgacctcgtgatccgcctaactcggcctcccaaagtgctgggattacaggcgtgagcctccgtgcccggccctgccctgagctcatttctaaatccatcttcctccaaggtggtggcaagcatgcttctttatcccggagagatggccctttcatcaaagtctcattcagacccttctccttttggaatgcttttcttgggaggttggctgggatgcctactactcttgaggatctgcctctgatagagcctagatcttagaatcaggagagtttcttgcaggcccatcagttactgtgaaagatacctgagctagttggctcacaatccacatccatcaaaccgccccctgcagagaagtcacccggctgtcgcctgcttggcttgccctgcctctcgccattctcatttcattagcaatgcgaatgttcacacccttcaatgtgcatatgatgggtgttaatgagcataacacatctgtgaagcgtgtgtgatttttttgcctaataaataggcagtaaacaagaggaagggaagagctactatctgggggcatctgagaaaacaaaaagcaagcaaggtatgagtcagattgattgttcagtgaatcccaaagggccaaaaacttcctaaactggttttggtgtttctcactaggtgtttggacagcttggaacctggatagtcccacctacccaaaagcattcaaattaggcatgcttttaacaaagcaggtggcatggcatgtaaattgtaggaacactgttaacctttgcaaatgagtttcgtggtccgaatggataattacatatttccctccattaggagctacaaactcatcaagattctacaaccaaccggctcttgagtttcaatctccatgtgacaaggggatttattatgagagggcagagagaaaagaggaacaccgctctctttctctgcaatggaatgatggtcagaaaagaacagatcaaaggaataaacctgctctcctattaactcagcttaccaattctggcctacattttcaaagttatcagtaatcaaaacattgggaaaggaattacaacctcttctcctgaaagtttaacaacttccccatgaagcactgcttttgattgcattacaagctattcctgaagaatttatgacctaagatactctttgtcaatgtaggccatttgtccatgagtggagtgactgataaatcagctattaacatagataagaaagcatatcgattgagtcaactttgtgtttaataatatgctagacagtaatgatgcctggaaaatacactctgtaattaagtacttttccctttatatttcatgaagactcttgtatattttattctggcaaaatagattgtgactaacatctcatagaaaagatcatcatattgtgatcctatatctttatcataaaagtgaatttgagggaaatttttataatttttcaatataaaaattattaagatatcaaaactctttgttttttcactactccaaggtttatttcatcatcttaaaaaccttgtgaatacaatcagtctgctaggtcaggggtcaccaacctagggccatggacacctaccgtggcctgttaggaaccaggccacacagcaggaggtgaatggcagacacgcaattgaagcttcatatgtgtttacaactgctccccatggctcgcattaccacctgagctccaccttctgtcagctcggcagcaacactagattctcataggagcacaaacccgattgtgtactgtgcatgcgagggatctaggttgcacactccttatgagaatctaatgcttgatgatctgtcagtatctcccatcacccctgagatgggaccatctagttgcaggataacaagctcagggctccccttgattctgcattatagtaagttgtatagttatttcattatatattacaatgtaataataataatagaaataaagtgcataataaatgcaatgtgcttgaatcatcccaaaaccatcccctactcccctagtccacggaaaagctgtcttctgcaagactggtccctggtgccaaaaagattgcagaccactctgctaggtagaactgcattcttgtgattatgtattttaatgagcgcatttccttttcatatggagaagggaaccacattgccttaattccccaacttctgccccaaagctttctaggccaatatggctgcattcgagttgctgatggctgtgctaccctcccagggctgatgtacagtttcctgcctgggccgtgtcaccaatcactagggtttaggaggctatagtcagatcttgcagaatatgtcagtctcattctctgtagaattttttgtttgcctgtttttttcttctctttggcactggactatgggcagtggcagttagtggtagatccagggtggagagctgagacctaacaaagaatttttttttctttttttttttttttttttttttttgagatggggtctccataggtcacccaggttggagtgcagtggctcaatctccactcatggcaccctccgcctcctgggttcaagtgattctcatgcctcagccacccaagtagctgggattacaagcatgcaccaccatacccggctaatttttgtatttttagtagagatggggtttcatcatgttggccaggctggtctcaaactcctgacctcaggtgatccgcccgcctccgccttccaaagtgctgggattacaggcgtgagccaccacacccagccaacaaagaatttttaggttcccactattccaccccacctgtgctagaccctgtggtgacaacaaaggtgaaacagacatgctgactgtcattaaaacactgacaatctaaactaagaaagatgaaaaaaattaattgaatacccagtggaaagtaagaaggaatagttttaacctccttaaaatgcttttgattgcattataaactattcctgaagacttaatgatccaagatactacttgtcaatgtaggctattcgtcaatgagtggagagactggtaaattggcagttcatgtgatacatacgctttcagagtaaagagaggtttcttctaataatgagaggagcgcctggccagagagacccaggaaacatatgcaaatactagaaatagccccaagtagcaagtgtggctatagatggtacacgtgaaggagagtagtggggttagaccgtgaagccacgaagaaccaggttaaggaatttagacttttatttggtaggcagtggagagatgttgaatttttttttcaaacagtggagtacagtgaggaaggcaggagactttgcagaaggaaatcaggaattccaaccaatgtgttgagtgtaggattctaaatccagcacaaaaaaaccttcaaagcagcagggaaagggtttggctctgattcagcctcagtggttatactgttgccatcagggagctgggcttgggggtggacagaggctggtggcagagggagggatggagggacagagctgagtttttccaaagcagaagaagacggttttgcaacctagcacaccatctgggtcagatttatcaaacaagattatttgttgacagaccatggttatttcccatttaaaggaagcaatacatatattgtatccaaaatggctccccaaaagcagcgttgagctgatgcaaaagatcagtccattctcccagcaaaagagcagtctcttgacatcccaggtaggagggattcatgtatttcacaaaatgtgtccaatgcaatcatcaggcaaataatattttaatgttttcttgacatgctgagagtaaacttgcttcgatgcactgtctccttctaggcacattactctggagtaaaagaagagaggaaagagacagaggaaagaaaaaatatgtaatcacatatgaactgcaaaagaattctagctgaggttcttagaactataaattcttctttttttttttttttctgagacggattctcgctctgtcacccaggctagagtgtggagtgcaatggcgtgatctcagctcactgcaacctccacctcccaggttcaagagattctcatgcctcagcacccgtccccctcccccaccccaactagctgggattacaggcgcacaccactgcgtctggctaattttttgtatttttagtagaaatggaggtttcaccatgtcggccaggctgctctcgaactcctaacctcaggggatccgcccaccttggcctcccaaagtgctagtattataggcgtgagccaccgcacccagccaagaactgtaaattcttaaaatttgggaggaaccatcaagaaagaaagcctaagccttgtaaccatatgccaacctacattggtctactccctctgccacgctaggcatttcacactctcgtacactctgagggaaactcgagaaacaagtgtaataagaaatattcccgctagagcatggcagccataagctaccaaatttttgttataaaatagaaatatacttctagatgtaaacatgtatatgcttatatctaacctctctaggataacttttgtaagtggattttaatataactaaaactggatgctaaagaaatagccctctcttaaagttgtacttgggcacgtctaggatcaaaaagttaatagttttgtctgtgatcaaggagttaattttttgctgcaatatgtttacatctaacattcttttgagctatccacaatctggttatatatcagtttatccaaccttatttctcctttcctacttcaaagacctccattcaagccgttctccaagctcttgcctaaataagtagttttgttttgttttgttttgttgttttttggggttttttttttttttcaaattttttcctcacttctaagtttcattcagggactacctttccccacttcccctcatcattctctttttctaaaatctatccatccttcaaagcccaggttgaaatttgtcctcttcctgaaatcgccccaaaaatgtgccaaatcattcagatctctgccatctctgagtcttataaatcaaattcttagtggcattcatttgactaagaataataaatacatcactattgttataatcaccataatacctggtgctgttgttagatgctttacctatgttacctcttatccagacaatcctgtcctatcacccccattttacgtgagaagaaaccgaggttcataaaggttaaataactagtccaagttcacatagctagcaagtgacagtcataatagtggttcagacccagaaccgactggcttaaaaatccatggtccttcttctgtgccatatggcttcccaattatggatttcttttttttttttttttttttttttttttcagattgtgatttaggtttattcttttttttttatacttaaagttttaggatttcttacattactttttaacaaacgtattttgtgcatgattctaagaggtagtacactttttttttttaattgtttgcctcattttcccaccatgcctacttttcactttgctgaacccgtatagagtgtctggttaatgttagagaaattgaattgaattcctgacatttgggcccttttcttgagttcctcttctttgtccatagatgaatcatcccattacatctaactccgttggacagcttgcttcttcctcaattgtatgtgaatagttttcaatccactttactaaaatctaatagtcaccatctgtgtctgctatataaatgtgaactcttgaaaacactaacatttgtgggtcagaaattagaggacagtaaaataaaccactggaactgtgaagagggaggaggcgtgaagaggcactcccctctctgctgtctgtgggtcaacctttccggcctgcctgtttctcaaactgagtgagacttgtctctgaagccccattttttttttttttttttttttgagacggagtttcactcttgcccaggctggagtgcagtggtacaatctcggctcactgcaacctccacctcctgggttcaagtgattctcctgcctcagcctcccgagtagctgggattataggtgcacaccaccacactccactaattttttgtatttttagtaaagacggggttttgccatgttggccaggctggtctcgaactcctgacctcaggtgatccacccacttcggccccccaaagtgctaggattacagacatgagccaccacacctggcctctgaaaccccatttaattttccaaatgaaggtgatgtgtcccaggcatcatacataggcaagaacccacaaagtggcagaggagcaggagcaaaggggcctgggcaccccctggaaagtcatcatacagctttactcaactgtcaccttctcctggccttccttgaccactgtttttaattgcaaatcccactgcatgatgccctatccctcttccctgacttattcttctccataactcacattttcaaagcattctatgcatttcaccaaattgtttgtggcccttctcctcccaccagaatgtaatttcaagagagtagggatctgaggtcgggcgcagcggctcatgcctgtaatctcaacactttaggaggccaaggcggttgggtcatttgaggtcaggagttcgagaccagcctggccaacatggcaaaaccccatctctattaaaaatacaaaaattagctgggcatggtggcgggtgcctgtaatcccagctacccaggaggctgaggcaggagaatcacttgaacctgggatgtggttgcaatgagccaagatcgtgccactgcactccagcttgggtgacagagtaagactccatctcaaaaaaaaaaaaagagtagggatttgggtctgttttgtactatgctagatacccagcacccataacagtgtcagacacataggacatgtattgaatgaatgaactgatttataagcagaatatttaagactgttgagaagccatacccattctaatcaggcagagcagaaggttaaaaatccacaacgcttacttttgagttgtgttgaaaccattgaaaatatctgtgtcaaactgattaattacctcggtttacagaatcagctttttaacatacatagcaaattctatatgctagccaatggcaagccagatctcaagcaaggccattcttgtaaaataaatggacagatttttgtcttttctattgtataagattctaaagccttgaaagcagtaatatagaatctccttaaatacaaatttaagcatcttttcacgtttatggcctcagtgcctgtttataaaagtagttttgtaagaaaaacagtgtaagaaaaacatctaagagtagatgataaagacctatccttgtgtgaccttcagatggaaaagcatagatttaatctgagattccagaacccacctagtttttaacttcatttgtttgtctaacttaagaacgtgagtcacaactaacaaagaccatctggtgctgttcttccctcctaggagaatgtctccagaagtaaataaaggagaatcttgtccatgcaagctactctcagttccaatagaaaaccatttcagcatctaattcagagagttgcacaggagatggccaaaggcactatctgccatatgtctgcgtctccagcccagccatgaccccaaaccaatagatttatttttaggtagtatcatgtaaacatagaactttttaaactagcaagttggggaaacttcatgattagtcaatctgctagcacatagcagaagctggtgggtgccttcccagcagccagctcctctttctcctacctcatagcaccccagttattttcaggcatctaccctcctccacacagccaagaacttcagggaggctatttccttccccaggcccaaggagcacagcgtggaaggggaaagagagaggttcatggacggctctaccatgatgccatgtgtctgctagtaaacttctactgactgactgagcatgccccaggtgaaataccctccagtacctccttctgtttttggacttacctgttgtctttctccaacctggagactctcaacccttactgcaaattactgccacgtggggagcttttaaaaacctgcagacacccaagtgcacccaagagagcctgtttcaatggacctatgcaaacaggtttttttttttcattaagttctctgggtgattgtaatgtacagccaacaatgagaaatgttatactaattccattactttgaccctgtctttgagatgctttgggagagcttggcgctcaggaccatctttggggatcttttccatcatccagagggaagctggatcttagagtctggcctctcggttatgggtcctgatgttttttcattgtgtatggtttccatgatctgtcctctgcaataaaacagacattgctttctatatgtaattctactcatccttttggggtctctcttcgttaccatctgcccttccatcttgccatctcactcctcactcccatgattctggaccaaactaaccagcattcctaatctagtctcttcttgaaaggatttgaaacggggaagcagctcttcaggaaagaaaataaatagagcaaatgggccgggcatggtggctcacgcctgtaatcccagcactttcggaggccaaggcgggcggatcatgaggtcaggagatcgagaccatcttggccaacacggtgaaaccccgtctctactaaaaatacaaaaattagccgggcatggtggtgggcacctgtagtcccagctactcgggaggctgaggcaggagaatggcgtgaatcagggagatggagcttgcagtgagccgagatcgtgccactgctctccagcctgagcgacagagcgagaccccgtctcaaaaaaaaaaaaaaaatagagcaaatggaatgaagaacctctgtagggctgtgttgatttaaggcagatgtgggccacagttttggtgttcacacccaggtaaacaaggcagcttccttctgctcatacacgtgctcccctctggaagagccaggtttgcaacgggctcgcagtggctttctcatcctggcagcatccagtttcttgtggacgttgctgcatcccaaccacctagcagattacacgaaggagtgaaatacctaccactgaaaagaatgaacccacagagaagggtggcctcactgctcccaggggctgctgcagtggcccgtgggcagctagactggcctgcaggggactgaccctggtggacgcctgagtctatgtgccaccatctaccctgtgataagtgtagctccgacatgatgtacctttgcctgttgatttccaaggacaattattttagcatttcaaaattcagctcaagtgctggacgacttctccctgagttttgctgtttgccagcagcctcctcttggcatgctccctttccaacatcctcactgaacttgttactattaccaccatgtacttagagaatgcaactatcaagtgctattgaacacaccttgttttgtaaaaaccctgttgtaaattgcctccttattcctctgttccatggccagtcaaatcacaccctcatgtaaatagtgacaaagacatattacccaacttcaaattccagacacctgagtcacaggtgttgttaccactaccccaaaccacaaagtgggattatgtgtctcctagaaccgtattataatagacactcactgtcttgcaaattgctcctaacttgggtagaatattttgtatttattacttttgaaaatctatgggtttctattgcctggaaactcaaggattacagcagaattagagaatctggtctctggatcacagatccccccactgccctgcaccgcccccacccctttctcatggagacctaatcatctccacactggatccactcacatggatcttctgaccttgatccagagtttacaggtaaaatgtccacctgaggacactggtttctgttttgacaaaggtagttagggccttggaaagttgtgaaggaatggcatatctcccagaaccctgacttccatcagcatcttattccaggagctctgaggaaacctctaaggcacaagtgtggaaataaagaccacccagatgagaacacgcagaggctatttattcagagcttgctgtagcaagagagtcagccatcgtcacttgtgcctggcagagactctgaggcaagcggggagtgggaaagctttcaggtggagagaggggaaggctggggtgtgccggggctggagcttgttggcccgggaaagctggaggagggctgcctgacacaggaggcatcctgtgtgattggtgaggggattatatttggctccctctggttggcctaaagttggcagcagggacaaaattagggaatctggtatcaattgatcatttggggccagcttcctggaatgtctgctgcagattgtgggtcagcgtgctgttgtcgcatatggccaagctgttgtctgtctgtagattccatctcttggtgttcaataggccttggggccatgaacttgtagggagggttttctcaagacctgggttatggaaccagcattgaggttcacagaactcacatccaccctcaaatcagggctgggtcacagacagtttattcaagtgctccaggcacctgtcccagggtcattctccctagaaagacccaaacaagctgggcgcggtggctcacacctgtaatcccagcactgtgggaggccgaggcgggtggatcacaagttcaggagtttgagaccagcctgaccaacatggtgaaatggtgaaaccccatctctactaaaaatacaaaaattagccgggcatggtggcgcacacctgtaatcccagctactcaggaggttgaggcaggagaattgcttgaatctgggaggcggagcttgcagtgagccgagattgtgccactgtactccagcctaagcgacagagcaagactctgtctggaaaaaaaaaaaaaaaaaaaaaaaaggcccaaaccatcccagggaattcagttcaagccacttctccctcactgtgttctccatgctgctgcctggggctgctggccccctccctgtctgcaacggactctgacccctggaccaggacacccagcaggctccccaggaccacagattctgtctgaccttggggattctctggtgtttctgaaaattgctgaaagcttccagtggccattgctatgttatttgctagtcggctaaaaagttaaactccatttttatatggtctagattagaagagaggaagaaacactccagaggcatcagaggctcaagaaaatgcctagaatgaagttcagaccatcaagaagtccccggtggctcaggcacattcactgtttgttcattcctctgacagtcacggacagccccctgtggacaaggcatggtggcgggctggggacagtcttctactaggaggatggggaagacctgagaacagtgcaggaacagaaggaacaaatgtgcgggctgtgggtcacagtataataggaacacaggacagaggctgaagatggccccaggatttgagttacgaggccagtgctgtgctattagcaaccaaggggacctggaaaggattggaaggggaaggtcttgaggagaggctcctggtaggttttttctgatcaatagtcccaagggtcaaaaatatcaacagtgacagtcagtgctgggatcattctccctcacagatctgaacccttgagtatgttgattttaatgacagggacgttctttatccagccttatgcctgaccaactctgattcatccttcaagtgaggagatatctcttcaccctcgaagctttccctgatgcacaccccccgggccagggcctgccccagagctccccactgccaccatcacttccccagtgcaggcccttacccccgtctggcctgttgggcttattgactgaggcccccaccctccccagccagcagcatgcctgccccacaaagctatccagcaaatacagattgagacacaaatggatgaaagacatggaaggaatgtatggatggaatggagggatggagtggacacatggaatggatggatagatggagtggatggatggagtggatgggtagaatggatggatggagtggatggatggagtggacggatggagtggacagatggaatgggtggatggagtggatggatggaatggatggatggaatggatggatggaatggatcgatggagtggacggatggatgtaatggatcaatggagtggatggatggagcagacagatggagcagatggatagagtgaacagatggaatggatggatggagtggacagatggaatggatggatagatggagtggacggatagagtggagggatggagtggacagatggatggagtggacggatggagcagacgggtggagcagagggatggagtggatggatgaagtggacggatggagtggatggatggatggagtggatggatggagtggatggatggaatggatagatggagtgcacggatggatagagtggatggatggagtggatggatggagtggacggatgaagtggacggatggaatggacacatggagtggacggacggagtggacggatggaatggatggatggatggatggagtagatggagtggatggagtggacggatggagtgggtgaagtggatggagggaatggatggatggatggatggatggagtggacggatggaatggacagatggagttgatggatggaatggatggatggatggatggagtggagtggacagatggaatggacggatagaatggatggatggaatggatggacggatggagtggctggatggaatggatggatggaatggacggatggagtggatggatggaatggacggatggaattggatggagtggatggatagagtggatggatagagtagatggatggaatgaacgcatggaatgaatggatggaatggacagatggatggagtggatggatggaatggacggatgggatggatggagtggatggatggatagatggagtggacggatggaatggacagatggagtcaatggatgggatgggtggatggatggatggagtggacagatggaatggacggatggaatggatggatggaatggatggacggatggagtggatggatggaatggatggatggagtggatggatggaacagatggatggaatggatggatggatggagtggacggatggagtggatggatggagtggatggatggagtggacgcatggaatggacggatggaatggacggatggaatggatggatggagtggagggatggagtggatggagtggacggatggagtggatggatggaatggatggatgggatggatggagtggacgtatggaatggatggatggatggatggatagatggagtggacggatggaatggacagatggagttgatggatggatggatggatggaatggatggacggatggagtggatggatggaatggacggatggagtggatggatggaatggatggatggaatggatggatggaatggacggatggagtcgatggatggagtggatggatggaatggacggatggagtggatggatggagtggatggatggaatggacggatggagtggatggatggagtggacggatggattggatggatggagtggatggatggaacggacggatggattggatggatggaatggacagatggagtggatggatagaatggcctcctctttgtctaaaacccccagtagctacgaattcccccaacaactactacacactgccctgcacatgatcacgttcggtaagttgtgtgagagggcaggagggagaaaatggagctgcctgcctgcctcacgagcacctttcaccattttgatcacatttccagatgcagcaccaccctctgctctcacttctttcctcccagaccagggaagcattggatggtggttcatgaggtgctggaggagctaaagaaattgctgtcatcgttttgtcaaatccagggcctttatgttttaaaatagatatacaaagagatcacattttacctggtaaaatcatgacaaactgagcggacaaaaaaaaaaaaaaaacctataaacatttggcacaacagagcaaaaatcataattcctataattatttttaaactgtgaaactattgtagagcattgaatagatgtatattaaagccatgtatgctttatttgcttatgacatgaaattctggtttctgtgtgttccaccttcctattttattcttaggataataggatatgatgtgatgctttactcatagttagagggagaattgactgtgaatgagcagttcagagagaaaggatcttgggcttggcaagggcaggggcctccagcgttttgagaaaaatgaattgagcctcagcttattttataaaaatcttgacccagagcgtggcccttctgaactcccaccatgtttatgcatggtaatatattaaaaattggacttagctagtagccaaatacagtgctgtgttctggatactaaaacaaactaattctccctgctaagtaagaaaaatttcacacattatcgtcagtcagacatggaaagaggttctccaggggaagagagagaagcaacatcattcatgtgatttaaaattacaccaggccatccatttatctgcctctcaggctgtttgtccttttttgaacgatgcttcagggctccacgctggaaacggggagggtggatgtagaacagcttgtcaatgtaatcattttactataaatctgcaaaaaaagaaacagagcctaaaccaagtataaaataggatcacagaacctcctatgagcaactttgtaagattatcctttctagtgtgagtactaccacaataaacatgatgacatatcctttatcactatgttgcccaaagattttttttcagatttcagtggactcctcccctgccactcttaacagccctgctcctccaaacatagctgtatggagagagatgtccatcacagggatgtttatacaaaaacatcaaaacactcattttttcaggctggaaacggtggctcacccccgtaatcccaacactttgggaggacaaggtaggtggatcacctgaggtcaggagttcgagaccagcctggccgacatggcaaaaccccgtctctactaaaaatacaaaaattagccaggcatggtggcacacgcctgtaatcccagctactcgggaggctgaggtgggagaatcacttgaacctgggaggcagaggttgcggtgagccgagattgcgcgactgtgctccatcctgggtgacagatcagattccatctcaggaaaggaaaaaaaaaacactcattttttaggtgaagttaattgactgggaggactttatggaacattttggttcttttcctactgctgaaatttgaatagaaaggcatgaggtaacctcatgccatcactacgaaaggctaccagaaatgatagaaaacctcacacagtatcagctacattggtggagtccacctgaatcccagaaattcagttcaacaatgtcactgagttcaccagactactgggaaagggattcatgtagagacagttgtaaaaatattgaccctaacagagaaagattcactgcagtcagaagagatgccacgaagtcaggtctcaactcctggagaggctctttctgtgctgtgcaaaaatgtatgtttatccgacttcccaggccttgaggtacagcaaggaatgccagtgttggatgttctacaagtgaggacactggagcctcaagaaataatctgacttgcacaactcctgtcactgattagtggctaaggacatcctgatttctgctccagaactttccccatgacatcagtcttcccatccttgaagagttttcagttattcttagcgtgacaagtgattgctagagtttgtgtaattttcatcataatgggactaatgacccacaacagcagttctagtgacttccagaagatgttgtacatccccatcctaatgaatggcagcagcatgacttacgttcttttatcagagagtctagtttgatctgagttgtgtctgacctggaattcaggcatgtctggggctaggaaggttttgggttcgaggaggctgttttcatgagggatcccagggtctcttgggaaggaattcactcaagggaggacagaggcaagagaagcacagttcactctcggggctgaaggcagcatgggttttaggtgcagcctggtgacagtcaatcgggtggcctaccatgtagtgattaagactttggaaaagcaggctataagcaaaaatctaaatttgctacacaataacttggcaagacaatggagcagtggctggcaccatggaccttggtaagaaacactagaaaagttaggaaaaggggtttttccaggtcagagagagccagtgcatgctggtggacccacagttctgtagctatgagaaatagccccatctggttgtgcaggaaccacaggctgcactagctgctttagttgtgaccgcagaaagcaccctgccccagcatggagcaccagggcctgcacacctttgccaggccccagaagcactgccactgccatgatacccaagaagagagagattagcaagtgctttgtaccagaggggagggctgcccatgcaaaggcctgcctgggggaactccagcaatcattgggggagactttgggagagtggagagaaggggcctcctgaaaagacacagccaggggaaacctactttcatgatatcaagactctaattttagagggcagtgtttgcagatcctaccaatgactctttgtccttgagtctgtgtttgaggtggaaccactcaaagacggggaagatgaggcacctggagccaggcgcctggtctttgtgtctgcacttagccaaattccctctcagctgtattgtgtctggaggaaatagaagcatgactaagctgatttgtattctgccaaccaagggaaaatataattaacacggcagcaagactcagcaaaccccatgggaaagtccaagaaggaaagagctcccgtggctcaagatgatgtcagaggcaaagagaggccaacccactctaatcccacagcaggtctcctctctaatacctcaactcataaagggaaaagacaatgaaatccaggcctgccatgcctttgaaaagaacacacagcctctaggagtgattgcagggattgagcagactgtgatgggggttttctcatgatgggagtctcctgctgttgctgagtgctgccaatcactgcccacacctccagcagggaggtgacttcctcaggctctgctactccacatcaactgattaacgcagctgtgatagcacacctagcagagacaagagactcccagacactaggcaggagtgagaccaactgctgtatcagatatacacctagcttataattacgtgtcaagagaaggaagattaggcagacatcagtaaccgcaagaactgaaatgtgatggctggtatccatcttcagcctgctccccagctaatcatcccctaaaagaaatgcgggagaaagctgcctcctaatacatttcattggcccttcatctccgtctgctgactcacatttgaatttagagacaatttgctaaactttctagatttttatttacttaacattgccttagcctttttgatatattcaactatagtattctccaggtttaaatattgtacgttttttttcacaactttaacaaattagtgctcagttctcctggcttgaaattcccatatctttcatgaagctgttgaaactaaaaggcttaggaggaaggtcacccacctccctcattctccttcccttcttgcccagaggaatttatgtctgtcttcctgccccaatatctacatatccagccatgactacattgtttggtttaagtaactgcctctcattacagaactagattcatttattcattcattctacaaaaacttgaagaacatttatgctggatttgaatccagtgtcagaattgtctttgattggttctatcttatttcatagatttggggtttgaatttaatagctaagcatataaatataattttatgcaagatagcaccttaattctagtccttatttaatacaaatagtgatataatgaaatgatatagttttatctagtttcatctagagaaatatggaaggaaaaatacaaatagttaaaaaaaggaggaaggctgaaaatatatagcagttgatatgcttctcagagtcatcttttactaatcagtagcagtggtgatggtcttttaaaaaaaaaaagtttcggttgcttttaaaaagagatttccagtgggaagcctgtgagtactgactggctcctgtctaacctacacttcctgtttggttgatgaaaaagaaaaaaaaaaaagccaaaactaaaaggtacattccagaacaagtagtcattttaacaactggcggagccaagaaaatgcgatctagtttccctctgtcccccagtctagagccattattaaataatttaatgccatagaacttatatcaaaaatagacacattccttaggaaacatttgaaacttactggttttgaccttaaaatgtaatcattcatgaagagatcaatctttcatatgttttcaaatatgaaacactcaagtccattgtcagaatcccaatagtgtggaaagaaacctaccagggcaggcttatctctgctcattctttgctaaaatatccattgcatttgctaactgtgaaacgatgggtaggttacttcacttctctgagcattgaagatgccctgtctacaaaggataacagtctctctcccaggggtagctgtaattgtgaaattaggcaacatatataggaaggtgcctaatggagtggcaatcatttattcattcattcccgaaatatttatcgattggccacaatgcccaggcacagagcaaggtgctagtgatatcaacacgggggacacttcacatttccccccattcctccctaacggtgcagcagacaccccactaaagctgaggaggcccctgctgctccccctccctctctgctccctgagtctgtgagaggcatcgctccagcctcccaagaaagccctccccctgcacatccaagcagctccctcttatcctgatgccctgacccgcctgcccacaaggagcctcctccctgagccgggaggactttccttctctcctatgacaagccctggccctaggcagctgaaaacaatcacccaggaagctccttcaccgtcagattccctgacagccctggatctagcgagaatcaggtgatttcgatgtgaaacgaggtttgggaaccactgctttcagtcacattctttttgtttgatcttctcagaatcagcaggcatttccctctgctactttgtccaagatccaacccttctcatctgcgtcttgccagtctctccactttagagctttgttaccagctacttctaacctcttgcacagaaatctctactcaccactgtggagagtgaaaaaggaatgggtttttatgtatttctagccagctcttggccctgcgccatgcagagtatatgctgtacattggactttcgggacacttctctgttaaattctaagccttatgtctgtggtgtctccacagtgagtaagctcttaatcacattccctattgtaccttcttagatgaaagagcaatgggtcagggggactttttaaatgtccttaaacttgattagtttaatctttattatggctacagaatgtttcttaaatttacatacgataaaatccactattttatattaagtagagttatgagttttgacaaacaaatatattcaggtagccaccaccataatcaacacacaaagcaatccattacccccagatttcccttacatcctttgttgtccccctcatcctgtacttccagcccctgagagccacttatctgatttctgtcccgacagtttgccttttccacaatgtcatgttatataaatggagacatacaatatgctgatgtgagcatttagaaagatcatgtatttaaacaattattagagtaagggctggctatggtgacttaattttttggtttctgacacctataatctgatttgaagtgtgtcattctgtgcatcatgatcctttttgcagaacctgtgtctattagaaaatccagatgaagcaggctcttcctgttgtccttcatttggaaaagacagaagaacagagcgctttacgaaagtcaagttacagcttcctaattttctctcccatggacaaactcttccctccccccaccccgacctagcctcttacccactatcctttgcaaattcctatctcttatattgcccagtaattggggcgtgggggggtgaggggggggtgagttactgctgatgaaccaggaggcagagcaaggtttattttgctaaaggcttcagctgctactgcctggacctcaataagcattttctgctctttcctatcactactgtcttccctttctttgagaagcaacataaagataaaaagaaaaatacttgattttgtagcatgccagaatattaagatgctcctgaaaagtgtgggatttaaggcttctcaaaaaagagcagaggagggagtgagagaagaagacggagaaggaggagaaggggaagagaaaggggaggtggaagaagaaaaaaccaccatcagaaactgagtattacacaggacgtaacctgtgctctgagagtgaaggaggccacacagcagtagaaccccgacaggaaaatcagaaaacattatattttttcccagatcccagagtatcagatgttccattcagaaataatccctattgacccagtctctgtgtctctctctctgccaatagcatcaagcacagtaaccctttccatgctaatcccgttattaatgccatccacaacaagcgtagtgtaagtaagacacgaagtgtaaaaaaactttcttccccgcagtccgggctctcagagccctccttgtaggtcaacagtatcaaaggtgcttaacgcagatacaccaggaggctcaaagcccaaacatcgaaaaaaaaaaaaagacccactcttgtgctgtgtgtattgcccacgggtgggaggatgcaagtacaattacgttttttaaaactccagtccagatattggcttttccttggatacttttgtgtggctctcccagtacagtcagatccgccgccgcagcctagcgctccaccccgggttttgcgtcctcccctcacctgcctttcagtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagaggcaagtattgcgcgcgggctggctcccacatggagctgcctcccggtgcaagtgttgcaagggtgcgctgctccagcccggggagcgcgggaggcggcggagagagcgtccgggtgatgagcggggcactgtaactggattttaacacctctgcaagcagcgcttttggtcaaaaaatttccgattcttgatcttctctctgcaaggtcgggggttctttggggagtaaatcacagcgtttgggtttgcattcgaagcactaccaagtctactccacagggtcactgcacggggagcaagtaaaggaaaacgaggagaatctgagagtgctccttcgtgcagtgtgtgtgtgtgtgtgtgtgtgtgtgtgtgtgtgtaggcaaagctgagatttacatggtgtgaactgttaaatgttaacagttaaatcccacacttttcaggagcatcttaatattctggcatgctataaaatttttgagacttgtttaaagaaggggacttcctttttaatttagaacaaattagtagttgttataacattatagatactaatcagtaacaatactagtaggtaatgctttctgtaagtagacacaccccaaaagtatctgaaaagtatcaccaaaacggagcgtgctttcacactcctgcaaaacaaattagcccttaaacagaataattaacatcccgagggaagataaagcatataggttccttgaatcattacgttacatttaaagtcggtcctgttcagtttgcctttgtccctaaggagtaaaaatagcatcaaattgcttgtttggttttccccttttgaaactcagcatagtgtttggttatccatgaaggtggctttaatatttcaccctcatatttggcagacagttctggacttgctcctctccccgtagggactgagtcccactggcagtgtgtggagaatagaattgattctcgctttttctttgcataatacctaatcatcaccattagcacttcagacgttcacagctttctgaataggtgtcatttcttccacataccctattgatttgcatcattaacaattgaaaggaagctcttcttttgattaagaagccaaacaattaggaaagcgtggattctttcatagtatttattgagaggcgtctccacctgatctaggctgtgtttaatgggatgagagagactaagagagaacagaaagtgtaattaccgcctctccaggcccgtctttactttttccagaaacagagaattatgaaattatttgtaatgttacaaggacccttggagctcttctagtgcaagtcaagtttatttcacaaacgggaggtctagacagcctttgtttcttctgaacgggtctgcaaggccaagatctggattctgacccacagcgactgctgatccaggaattccatgcacatatgctatgcacttagcgctgattgtgaagaaacaccaaggtggcccgtcaagacctgaactaccacaggtctaacttgggaaagcctcattcctcacgttctttccgcttctactgtaatggtactgtgcctcttgccagcccacacttattcatttgaaatgtgcactttggaagttcactgcatttaatcgattcagaggatttcttttttttttaattttttttttaatcagtagctgagctatactacctagttctaatccgtaatagtgtgttaaaagactgttttctgtgtagttgctggctgttatttaaatcccaaggctgctgaaagttggtaatagaaccaataatagcaaccattactcaaaagtctattgcttactattaactataataattaactattaagtattgatattgtccccatcaatttttaggcgttacctaacattatccccattttacagatcagaaaacggaggcttcagaaaggtgaagttactagcccaatgtcactcaccttctaaggtggggagcagaagccaggttggtctgacccctaagctcatggtctttctatactaccttagtagtatagaaatgttctaactttcacattcccggatgtctgagctcaagacaaattttaaataaattagcgtggctttgatgttctctcactagtgaaagggtctataacactttaggcaaaatgcattgaaattatgttaaaccttcatacactgccaataagcaatgacttcccagaaaccatactccacatttgacccagtctctaatttagtgagaaggtgagatgcatggaaagaaggcaaaggagagtgactagtgacccccagaaaagggaatctcttcccgaggtttgtgttgtgccctgtggagctgagaggagagtagggaattgatggagcagaggcttagccaacgcatctgaaagagaagagtgttttatgtctttaatttcttcttgtcagaatcaaccaagcccagagctatttacgtgttgagaagggtctcccatggagaggccttcccagtggcccttctactctctgctgcggtggtttatcatgtcttcaaaacagactcgccaccaggcttccaacaggataatacaaatgtgaaatttttgtcctcaataaagagtcagaaatgatgaccattctgccactttcatcattttaaaatctgtattcctgaaaactggcctcgaatttatttctgtatagtccaaggtattgatttgaaagtgagaggctagcatgaaagccaacacttctcaactttaaaaaaaaatgccttaatatttagtattttctcattctaatgtatcctgtaagtgttctttctgtacttcttgttaaggcatggctgtgtaaacttcagagggttttgggaacagcctccattgtcatccacttttcattctaaaatcttggtatatctgtgcatacatgcacaaggcctcccatgattgcactgcttttacgaataatcatagtcaaaattcattttttaatactgctagctcaatttttatttcttattcctttgaaattgatcatcatttggacagggactgcattaaagctcaacactgaccttcattgtggccacaggaagaaaagatctgctaaatgaacaaatactgtgatcgatattgtgcaatggcttgagggaaaaaggaggttttaaccacttaaagtaagcccttttagaaacaaaaactatttcagtgaaaatgctaatcctacacctctccaaagtaaatgtgcttagaggacaccagccagagtttctttacaatgggaagttgccttccaacaagaaagggttttcaaagtgcagaagaaaactttatctggaaaaggtgagaagcagagagcctccaggctccagccccacacactctcatcttcaattaatactccacaaagggaaagttccattgtgggccacagcactccctgcttgagaacctgtagggacttaaccgctgggtttatccaatgaagtgtctgaggtccccgctgtttagcttggccctccactctctgttcccaatttcgtaaccactacctcagccagtctccccagcagagcacttttatcttatagccatgaggcatctgtgacatgtcccacaacacatcacaaactctatttgtcctccaatgctcagtgaccttattttcccaggcaaaagtggctcccgtcccggtgcccactaagccttgataccagcccacagtacagtgcttctcagactaggtcgtctcagcatttgtcaatgtattttatttatgtttcgacgtccagtctgttcatcttcagtacaggactgggtcatactcatctttccatcctttcccttgtccaccttcctttcttcgatttgaatattttctgtagttgctccattaatcagtaattaattaattgcagaaatgtatttcccaagatgtagataagtcacacctcagaatgctacaaacatttgtagatgtgactgatcagtaattgtcaggagactttgtcaatctggagaggtgctgaaaaacagagacaagaaaatgtcaactttcaaaaatactcatttaaaaaagtagtttccaagaaaagcgtagactggcaaaaggatgattgacaaaattctggactagattactaaataggtgatatgtgagaatttagaggagaatcgtgtgatttgcataatccaacatgagttccccggaatcaagccatcccatgtgaaccatatatctcttttatatataggttctgaaactggtgaaatggggaccacttgaggttagagattcgtaattcagtgttgcctctgatcagcctggaattgtagtttatatgccagcaactgcatgtagcctgagggctcccatgactgggctacagccaattgatcacaatctaatgatacccctaggagtgccttgggtgagagcgttgtccggggcaaaccttatgaaactttgtcagatggtcttcacacagcatttcttgattttagcagagcctttgactcagtctctcctagcagattttttcacttactccacagatatttatttaggtgtttattcagtgtcaagcattgtattaggtgttcagtgtttgtggctcagaagcaaattctgacttagttgataatatggagagcaaaaccgagtcaaaaattgattgcctgaaattatctttggaactgcaggaagtcaatcgattgatgaattcatgtgtgtccgggtctctggggtacactgtgtgctcccccattcactccagtccctgctcagagtccttctccaatcacctcctctataaaagcaccttgccccatcatttcctattccctcatgctgttttatttttcatctttgcacattttattctctgcaatgatcttattcacacaagcagtcctgtagttgcctgctctctgcccccttgcttggaatgtggtatgaatctagggaggcatttcacagggctgggtcttttgttccttgccgtccattcaatatgtctatcagtgacaattgttgtcattcctgctaatctaatttgcagatgatagaaagtgaggaggcagagctggcatggtaaataaggggatcaaaatgtacatcagcagcatatgtgaaagcactttgataattgaagaattataattaaatgcaagttatcattttttaagtgcgtataaatctaagccaaaaccaataaaatgaaagtatcaaggttaaatataagctcatgcatttaggttcaaaaaatcaattacacaaattcaaaataaaggagacctaagagggcagcacagtccatgccgcgatttagccatgagctgggcgactctagggctgcaacacagtccccgagtggtggagccatggctggaaattcttcgaatgttatcagttaggagggccacatggtgaggtggacattaccaagcccgagtgtggccagtggagggtcactcagaacagcagcaggaattgggacgtttagcctgaaggagaggggacttagggaggtggggacccatctttaactctctgcggggttcacatggaggagacgggcatgtgtgtgctgagtgctaagttagaacctctgggtcctggggggcagactttcattcaaggtacggagaatgatgggagcccagggccagaagcctataacccacagcatctggacgaatactgagcgctgtcactagattctatttttatttgtttgtttgtttgtttgtttattttttgagacagagccttgctctgtcacccaggctggagtacagtgacgcaatctcagctcactgcaacctctgcctcccaggttcaagcaattctcctgcctcagcctcctgagtagctgggactacaggcacccgccaccatgcccgactcattttttgtatttttactattttactctactattttagaagagatggggtttcgctatgttggccaggctggtctcgaacccctgacctcgtgattcgcccatctcggcctcccaaagtgctgggattacaggcgtgagccaccgtgcccggccgtcactagatatttaaagagaaactggacaactgtggggcagaggccagctcttaagagggatcctggctttgggttggatcttcaattgtctttgttctttgtctttccaagtctaacattcttatctgttctaaacttccgtatttttatttgttctgactgatttttttttcttggtgtgacatttgatgtaaatagtacttagcaggcttagcaactcctatatgaaagtgctttgaaatttgctgggctttggaatctctgttgtttttgcccattaagtaattccctcccatccctcttcaatgttcccctttccctatcaaccagccctttctgcaggttggagtttgatagacttggcacttggcacaccccctgagcgccagtgtcaccctctgcgttgtgaatttatagatggagaccccttcatccttttacagtcgtgctctgatcctggggtccctgaggtccagagcagaacctgaactctgagtatcaggcaagcgcatcttacttcaaaaaatgggaagaacaatttaaaaatgcaacttggatatgtttttataagatattcccgctttctgttttctacacttatttagcattttaacattttcagaatacgtgaaaattagatttagtttcttttttaaatgtgaaatataagaaaattatgattacccgtaacacatttgtgattaaaagtacattttttaggaaaaaagtattgtttccagggaacaattttctattaagttggtgcagtaatgattgcgatttttgccattgaaagtaatgcttaggccgggtgcggtggctcatgcctttaatcccagcactttgggaggccaaggcaggcggatcacctgaggtcaggagttcgagaccagcccggccaacatggtgaaaccccatctctactaaaaatacaaaaattagccaggtgtggtggcaggcacctataatcccagctacctgggaggctgaggcaggagaattgcttgaacctgggaggcggaggttgcagttagccaagaccgagccattgcactccagcctgggcaacaagagtgaaactccatctttaaaaaaaaaaaaaaaaaaaaaaaaattaatggttaaaaccacaattacttttgcaccaacct

SEQ ID NO: 2006 - DNA, 64464 bp, Homo sapiens
attttctcgagccgcctgtttcgggtgccgccatgttggtgaggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacaggtcgggaacccttcttgtctgtctttctgtcggatgagaggaggggtctggggcggcgggagcgggccggggccgggcgcctcctgcatgacctagacgtctctgtgtggctccgtcagttccatgacgcgcactcttatgtaaactgctggatcgcggccgcgggggaggtcggcccggccgcgcccgcctccccgagccggggtcgctgctcgccagcgccggccccgcccccggccgggcacgtgcgagccccccgccccccgggcgggctccgtgtgcgccgggcggctctcagcgtcccggctcggtgctgaggtcctgcttctgcccgtccaggtgtcggtgctcccggccagataggaccagccaggaattttcaggaatgggtgttttgatatttgactgcttcccgagaaccgagaacacctctaaaaaaataaacatttggttttcagggaagttttaagcagcaccaaaaggccatctgttgtatacagtcttatcccttggaatttgagatggcaagtttcaagtttaatatgttaacacaaaatacttaggctttgcagaaacttagtttagcacagttttaccctaacgtaaaaactccatggattattccggctagcccaattttctagatggtgtgtatcacttgaatattgagattctgattttttattttttgctctgtgccttaagaggcacattcttgtttccattcgagtttggggacatttacaaagtatactgtagcatacttaaattttggttataattcaaattttcattcgtatatatctttaataatgcgaaaggggggctttcattcattaaacttactgaaacaaaatccattgcatctgattcttacttagaatattaatttgaaaatctagaacctcacaattactcctttgtgaatagaagtaagaaaaaatatacgttttactatagactatatacattgctgaagttttatctgtagtaatgtgatcggcttggtaaagcatcctaaacacgttttttaaaacccagaagcaaaaatcacaaacactgctgaaatttgaaatatctaaatacctagcaatcttgagagggataaaaatggtatttcaacaacttcagtattgtaataataaaagtagattcccagagggcacgtcaatcaaagtgtaaaaatttttggaaagtaaaatgcacttttaaaaatgataagcttgcacttggcacatttttaatgatttttttaacgttatcttttgtattaaaaaggaaattcttagaatgggttgactaataccttgctcttgaggtatggacaaaccaatgatggggttttgctaatggagcctaaaatcctttttttttttaatatggaagaatatctgttcccctctcttagtgcacaaagtaacttctatatatggagttatgtattgtacatcatgaaaaaacaatgccatcaaattcaagtatcaaaataattttgctggtaaggaactgtgatgacagaccttttaaagaatttgaaattttaaaatactggtttagaggttagaaaactttaaagaattatttgtaagatatgttaataggttggtagtaggagctaaagattaagattagtctattttatttaaaattcggactaaaagtattttctagtgatttctgaaacaaaaaggttagctccactttaacttagccaattgttaagtggcatcattgtgctgagatgaaggagatggtttttttttttcatgctttttttgtcaacccacatgaaaaacaaaacaactacatcaaaaacaaagtgaactagaagtcaggagaaattctacaagatcagatcaatggttctaaaccttccctggggaactttttttctttaaagtattggcgctatttctgttggtctggacctcagcctgggttttaagagttctaaaagctccccaggaaattctaatatgtgccaaattgagaaccgctatactcgatcagtgtttcccaatgatagttaatcatcagaatcactttggggaataaatttttgttctgcccagagcaactgaatcagaatctctagggtatttttcataggctccctgggaaattcttaagaaatttggggaaaaaatggactaatctgcgggcttccaaaatactgtatctttccatataatagctattttatgctgttataaaagtttctgtgaattaagtggagaaaaatatatgaaacttggtatatggagctaggctttgtctcaaggattttattttatttattttatttttttgagacggagtctcgctctgtcgcccaggctggagtgcagtggcactgtctcagctcactgcaagctccacttcccgccttcacaccattctcctgcctcagcctcctgagtagctgggattacaggcacccgccaccacacctggctaattttttgtatttttagtagagaccacgtttcatcatgttggacaggctggtcttgaactcctgacctcaagtgatccaccagccttggcctcccaaagttttgggattacaggggtgagccactgtgcccagccaaggatattctttttataacattttcaaaaattaaggcatattgtgtatgcaggaaaaaaaatgaagcctatgatttatatttacaattgctttgattttatacaaattaaaatattactgtttatgagaatgagattctaaatgtaaatggaattcacagaatgcataatttttttctcgtttaaagaaatagagtctcgctatatgcctaggctggtcttgaactcctgggctccagccatcctcccatttcagcctcccagagtgttgggattacaggcgtgagccaccacgcctggccttgtacatgttatatagtgaacattttgcacaagattgtttgccaaatgaataatttaaaaaaaatccatttagtgtactttcctttaaatattttcacacctggagttaaaacattgtattttataagatgttattaatataaaaatacttctaattctacttgtggctatgtagaatgtagtagaggacttttgcataagcccagagcctagtttctaaaggtctttagggatttagggaaatcagagggaggtataattctggtctctcgtcgttcagttctttttcattcagttctctcaggcacgactccagccgctcagttttatatttcaactggatgttgacccaattaaaacaattcacaactcctgaagacgaaatactatgagtccctgctttggacacatctgtagtagagtaggaaaagataaatataacccaagtaattgttacagaattttctgaaatatactaatggtaaaaggttttgtagggcttgtactggggaaaaagataattttttagcatgaaccttttaagagcttgtgagtctcaaagagtctttaactgataggtgatatggataatactcccctttgggaggaggtttataatacataaacaacctccccacccttccctcgcagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagcattacaaggttcagtgaattgtctgagatctcataaatacaacctagataagaacccaggtattattattttcagtcttgcaatattattttcctacttgcaatattatcttcactcttcattaagtttgcacagcaaagtaatggaataagttctgggctttaatccttgagtagtttggaattgtaatgtgctacatttgagagagagcccttcattttgaataaaaccttggtactgatcctgatcttctaacttgggttaatgctcttccccttttcattatttttttcatttgtgaaatgaagtagttgcactagatcattttcaattttccttcccacttaaatcaattttaattaaaaaaattgcagatgccttttctcagattagagtacactttttgctccacacaatatctggtttgtaaattagtatgttccgtggagtaaataactttcctgactagccattaacttacttctgattcctgaatccactaatttaactattgttgaaattactaaaggaaatttttctttagcaaatgtaaaacctcgtatcaggtctcaggtttgatgttgtaaagcactctgactctcaggaagactctttttttcccccaacctctcataaacaaatatttcattcattataaaatttcattcattacattttcattcctcagacttaacagtgtttcgtctctgctaagtatagtgttaagcactgacaaaagaactctggacacaacatcatgaacttgctctctgggatcttataatctagttgcagaaacagattggtaaatacatagtatagcacaagtactataatggaggcctgaactgagtgctgtgggggtacacagatgaaggcttctgggagacatcatggcataactagacctggaggatgaataaaactttggccaagtaaatacagagatacacgaaaagcatggataaatggcacaagtaggttcagggatgataaaagtgttagtatgtggagagtgtacaactattttggggaatggggaaacggattaaatttggggccagaccctgaaggatgtggggatcccatcaaagtcttttaagcaggagaatgatcagatgcattttttggtatactacctgggggataggaggaaatggactacagaaggggagatcagtagaaggaagacaagttaggaagcttttcagtcattttcattaaacatgaagcttaatatgtattgttctaggatcaggaatacagcaataaagaaaaaacttggtgtaatgaaacatattttcttgggagagacagaaaataaacatgaaaaacagatgtgttcaatggtgataaagcagaaagggagatggggagtcaagtggatgtggggagggtgtttagggaagcacttatgaaagagtaacatttgagcaaagagccctgatacaagacaacaattcagacccaagacatttgaggaaagagcatccatataaagggagtgggaggtagagaaagcctggaccaggaatgagcctggtatgattgaggaaaacacaagggatttcactcttgagtgacctgggagctaatgggggattaaacagaggagggacaggatcctctatggtatatggtaagtgagtagtatggtaaatgaggtaaatgaatagtaaaaggaactgctgtggtaatttaggtaacagatgatgatggtttaggtgaaaatggttggattgtggatatggtttgattggttttagaaccaataggatttactggtggctggatgtggacaatgagagaatagaatgaaccaaagctattgtaaacgtctagaaatcagatgaggacttgaccaaaggcattggcaatgagaaagtaggcacaattcatgaggtatttcttagcattgatagagttggatataaatatctggaatttttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacactccacagtcttatcattcatagtttcttggcaaactcaccactcaaggtgtgcctcacttatttaggagatctgcctcactagggtagacattttaggtttatgactcttaagttttcacctggacagattggctaccaaaaagaacctcacaggtgggtgaccttgaattcaccaggtcatgccatcagttcagagcggccggagaactctgttctcttgtgcattgatgcccccggagttgtgaaacacagtggccctgctttagtttttttagatttagaaactgatcagtgtcagagcgatcagacacaggaatgttaattcatgttcaaaaataataaccaggctagcatttgtttagcacttgctatgtgacaggtactgttttaagtgctttacatgaattgtttaatcctcacaacaaccctgggaaataggtcctattattaggcaccctttctacagatgaggaaacagacaacagattggtaagtttcccaagatcacaaagtaagtcagtgggaactcaaagtaacctgactccagagcccactctcttatctaagcatatacattcccatcacaagagaacgccagtttattcaagtaaaataaggactagaaatttacatcaagaaatatattctttcaatgtagaatgctgaatggaaaaccaaatttcaatagttgcctactgaacaagatcatgagataacaacaagggagttgattataaatgactagaagttttaaatggcatcggcgctgataaagtgataatctcagctccatgatatacttgtcaagcagttacttacatcaatctgccttctaggatatcctttctcctggttgatgcttatatgatagtgttttgtacctttcctttttcactgcttccattgctgaccaaactactcacctccatatttctggtagatatattttttctcattgcatgttagtatcttaaatttagtcctatcttttgcttgatcctctgggcttgacttcctaatctatgttctggtttatgttttagtttgacagttgagctttctgaggacattcttattcccagtatctttttttgggtggttgggttctgggaggtggtatttgactgctgctgatgtgtaccaaccaagacagtagtcattaagtgactaacaataatgatttcagcagattattattactcttggcaaaaagcaagctttctctattataaatgattttatatttgttttgtttttctttatttgtaatttgagttctagcttaacattaatacttcagataactgttaatacactttcataaatcatacccacattcttgaatggcaaataaataaataatcaagttccgagtagtttctaaagagagtaaacattaaaagtaaacataaaactacataaaaatcaatcacagtctatttataaagttggtatgaaaacaaagatcctagatttggaacactcatgatactcaatattttacatatatcagagtttgtaatttccataacttcatttggtagttagacatatagacagagaagatattaatatattcattttatagtttaggaaacagacttggaagggcaaataacttgtctaagatgactaagcagctgagtgagaaccacagcctatctgtggcattcagtctcagccatctttcccttgcttcataaggatcgttactctggtatcagttgctggactgggattttgggcatttataaatgtttttattttggatatcactgaatcacagacaatttcatcttagttaaaaattcatctgacgtgacacttgtctaaatcttaaaatattaaattttaatgtataaggatgttaataatctttatattttaagagactatgaagtcaagtctggctaacttagatctggaagtttttagctgtggaaagcaattctattgtgtacaggtttcagcctgtgaagggaattcattgaaaatgcatagagatcagaagaactaacacctttcttgcatggatttttcttgattattggcagttaacaataaaatgttattagatcactggtgcttctgtgtggggttgagttttttatgatatctcctgttagacccataagggaggctgtgagttgttttctacatccttggactatataagatcctcttttaaaattatattttatataagcacatgaaaatggaatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatgtgtgtgtatacaaatatgtatacacatacataatatctggagcaaaaatgattatgttgtacagaacttttggaggttttcctccttataaaattctgaagtggtagagttaacattctgcttttaatttatctccaaaaaaatgtgaagaattcccaaataagattttctcatagaagattcatggattttgagtctgagaaaaaaaaggaagaaaaaaaattcatggtataaaataactaaaaattaaatatagtctttagaaatgattttgtttagtataattaatactggtatgacaactgaatgcaattgaaattatgatataaaatttctattctgctttgtatttttcgttaaagtttttataattgtcatctgaaaaaggatttaatattcttcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctcaaattggaaaatgaatattcagatactgagtaaatttttttttttttttgagatggcatctaactctgtcacccaggctggagtgcagtggtgggatcttggctcactgtaacctctgcctcccgggttcaaattattcccctcccttagcctcctgagtagctgggactacaggcccacaacgccacgcccggctaatttttgtattttttggtagagacggggtttcaccatgttggccaggctggtctccaactcccaacctcaagggatctgctggcctcagtcttccaaagtgctggaattacaggtgtgagccactgcacctaaatgacatacttgaaaaaatattctcgggccgtgtgtggtggctcacgcctgtaatctcagcactgtggaaggttgagggtggatcacctgaggtcaggagttcaagaccagcctggctaacatggtgaaaccccatctctactaaaaatacaaaaattagctgggtgtggtggcatgcgcctgtaatcccagctacttgggaggctgaggcaggagaactgcttgaatccaggaggcggaggctgcagtgagcagagattgccccactgcactccagcctgggcgacagagcgagtctccgtctcaaaaaaaaaaaaattctcactttctgttgttgttgtttgtttaatgattaatagatgatttatttaagcaagaatacatagtcatcattgccagacttaatatgacaggttaaatgttggacccaattttccttcccagataagtttttctttcctatccatgtcagttttaaaaacataataccagaagaagaggggcccaattccacacagagctcccaagagtgagtttttaggagtgggtctgaaattaggaaagacacttgctgatcttgcataggtccagggaatcaaggcaggattttcgatgagccctcggcagttagggtaagcaggtttcagccaggctcttaatggtcaaccacttggcttgcgcccgctgggtttccaaaaatatgtcctgttcggctgggttgagggcatagtggccaggggcgaaggagtatactttgggaacgacatcttggcgacccagcgcataactcacttttttttggaaacaaggttggctctgtcttccagactggagtgcagtggcgcaatctcggcgcactgcaacctccgcctcccgagttcgggcgattgtcctgcctcagcctcccaagtagctgggactatgggcgcacaacaccacgcccagctaaattttgcatttttggtagagacggggttttgccatgttgcccaggctagtcttgagcctcctgggctcaagtgatctgcccgctttggccttccaaagtgctgggctcataggcatgacactgtgcctggacagatttttgttatactgtttagatatgatggtaactgaatgatcatgcaatctctgaccatgtgacattcagggataccaaaaatgacttgagatgggccaagggagaattggagaagcatactttggctgaatacttaggccaaagtataatttggaacatttcttttaaaaaatctactcccctatgccccccacttgcagtaccttacaattacagttaatctagtagcagatactggattgggatattaggtatttacagaccaaatgcccattgggatattactaggtaacaggcagtttcactctggttcattgtagattcatccagtaagcatttctagagaactgctatatgaaaatattgtggaaagtatcaactttttaaacttttgatgtcatggcacctagaagattattttctgatactcatattctaagggaattttgttttctgagatttgtttctgtggaatttctagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggcaagctaattcagtttgacttattcatgcaatagtctgtctctgcttatgacataaagtataatatattttaggaatagtgtggttttcttcatgatgtcaaacatacaagcttatggatatatttaaaaattcttaattttctagattaatgttcagcactacttccatcttgcattggatgggggcagataattaataattatcagatattttcttatcaaaaacaaatttgttggaaaaaaaattttttttttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatcttttgttgctggttattctcatttaacactcctattttaatttccaggttcaggtgacctcactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttattaataaaatagttttcattctttgagcgttcctcttctcactgcccacccccccgccaccaccaccctactgactttgatgagctgaactgaaccactcttttttttcttttttttcttttttttttttgagacagaatcccgccctgttgcccaggctggagtgcagtggcacaatatcggctcactgcaacctctacctcccagattcaagcgatttctggctaatttttgtagttttagtagagacggggtttcaccatgttggccaggctggtctcgaactcaagtgatctgcccacctcagcctcccaaagtgctagggttacaggcatgagccacccgtgccaggccctgaacactttttttttctttttctttttttttttttttttgagatggagtctcttgttcttgtcgcccaggctggagtgcagtggcgcgatcttggctcactacaagctccgcctcctggtttcatgccattctcctgcctcagcttcccaagtagctgggattacaggcgcccgcaaccacgcccagctgatttattgtattttttagtagagacggggtttcaccgtgttagccaggctggtctcgatctcctgaccttgtgatccgcctgcctcggcctcccaaagtgctgggattacaggcgtgagccaccgcgccggccctgaaccactcttcatcaacttatctgggaccctgaaatgaaatagggtgacccattttctagctttatatgattttctggcttcatatgatttaaatatttttaccgttttttgtttgttttgttttgttttgtttttgagacagggtctctgtcacccaggctgaaatacaatggcccaatgacagcttactctagcctcgacctcccaggctcaggtgattctaccaccccagcctccagagtggctggagccacagccacgcacctaacacctggttcatttttgtatttttttatagagacggggttttaccgtgttgcccaggctggtctcacactcctgggcttgaccagttcaccctccttggccttccaaagtgctgggattataggcatgaaccaccgtgcccagcttttgaaaaacctgtacaataaaaagtttggactaatgttctttgagcccttaaaaaaatgctattcaattaaaaaaaaaacaaacctatagtgtcttataactccaaatcccatactgtcacccaactggtctgccctggtgaccaccatttcctgacaaacattcaaatcactcctgaggaattgaagaaattcacatttatgacccagtgacactggccttgtctcagttcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgctcatagcaccatttacctacttcgtatacttgtgtggttattttatgtttatttgtgtgattctttgattggtgtctgtgctgtcccaagattaaaaacttcatgagagaagaaaccatgtctttttcttgtttttgtttgccattgtatccccactgagaacatggtgaataaatacgtgttaaatgaatgaatggccttttttttttttttagctggaaggacataaaattcttacatacatatagtttttaagaattatggctgcagatattttggatttcatctctggattaagtcagaatgtcagacaattgtgtacttgcacagtagtactttgttcctttacataattgttttttcttaattgaactttggtagtgtgcccttggctcaaattggcatatgctgtaagcaataaaatgttgcattgattgtatggacactcttgaggacagtgtctgccatatcaagtactatccattatatcaggtaatatcatcaggacccagaggagaaatttctctctgatcttactcccagaaaaaaaagtgtgcttttcttgagcaactggtctgtttttgtctcggaagcactgttgtcttaggcctaacttttgtttcctgaagctcaaagtcagatttgtgactgacatctaaaaattagttaggggtttctggcataccctgtgtaagctaatctcagttttagtttcatcttaatctctagaattttaactgtgattatgtgattatttacatattttatagtttgttcaataaaatactttttttttttggaacagagtctcactctgtcggccaggctggagtgcagtggcacgatctcagttcactgcaatgtctgtctcctgggctcaagcaattctcctgcctcagcctcctgagtagctgggattataggcatgtcccactattcctggccaatttttgtagttttagtagagacggggtttcgccatgttggccaggctggtctcgaactcctgacctcaggtaatccgtccgcctcagcctcccaaagtgctgtgattacaggcatgagccaccgcgccaggcctcaataaaatattttataaatacctttaaggaataatacaaacacaaccagagcttaaataaataaatgtaaatcagtctgcttgctggttaagtaatgagttcagtgtttctctccgcacagaaagtgggagagatagatgaagaagaaaataaagcttattacatgttgggaaggatgctaggcactaagttcctttttttgagacagagtctcattctgtcgcccaggccagactgcagtggctcgatcttagctcactgcaacctccgcctcccaggttcaagagattctcctgcctcacctcccaagtagttgggactacaggcacctgccaccacgcctggctaatttttgtatttttagtagagataggggttcaccatgttgaccaggctggtctcgaactcctgacctgaagcgatctgcctgccttggcctccgaagtgctgcgattacaggcgtgagccactgtgtttggccagttctaggcattaagttctaattggttcatttggggactcgaaattctccattttattttattttattttttctgcttttgtcacaaaagcacagacattgcttaacaaagaggtctgagatgggatatgaatgttaagctcagggacatagggtcaacacttttgagtgcacagactgggaacctggcacagttttaacaatcccctcccctattttcaccatcccttattcctgtagaagtagagcagatgattacgtattcactgctatatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgtgagacaagaataactagaacgatgataaggagacactggaagtcactttagattgatgaccaaagatttccttattttgaccaggaggtcagatctcaagggtccttctgagtccacttttgattagccaaattgtcttttctttcagtttgactataggttagtcaaccttccctccacattcatcagggaatgttagcaatatgtcatatttttttcttggtgtaccattaagcaatctaaagctatgctgttacctgtaaccacttggattaattattttagattagttggttatacttctaggttttatggctttatcttttcagtcagcattattaaccaagttttggtagctttttcaagttttgtaacccccatccagggagatcagtgtcctctcagacactcccaggtaagcatgatctcctggaagacgtgagaagtctcttaaatcatctaattattacattggagctatataataactccagtatacctggagttattatgcatatatgcaagttaggttctaatgaggcaaatgtaagtaaatatgttgttgattcaggaggtaaaaattaggagagccatgtgtagttttaagaacaaaagaggaattacttgtaacaaaagtaagtaagaaaggaattctcagttatctcttgggtagagataccttgcatagagttcagcaaaaattccaaaggttgtcataggactatggaggccattaggctaattaaaatttataatattgcccatatatttgtactaagtctcattcctgaaggattttatatttgggttgaggctttgagaaattctaagactggcttgagcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttgaagactattgatactcatcagattttaccactgataatttttcaagaggaactgtttatgaaactgtaaagagaaaatggagatacaaaaagccatccaagatgtaaatgccgaaggccaagttttgagataaacagaaaatcacgaaaactcatgtctggtggatcttccatggccccagtgtgagcagacagtattttccttgaggagaaatactagtttggtgggggtaaggtagggagttagtttaaggattaatcaagagaactatacatgtgctatttaggttgagggaaaagatcagaataggcatgggcaaagcctagactcaaatcaagttatctatcaagcaagctgacatattcagacagtttattaattacttagagaaatgcatgatcagcatagtgtcagctcctcatgtccctcatccgcagggtaacactgaaactaaacgggaccacatgataggtaacatgagtggtgggcactctggctgaggaacagtttccatcctgtagctaagtagttttttagcctacagctacatcctaaggagtgggcaaggtggtgaatctcagacctcatggaaccagggaaggtggatgagaaactgcctcccagcaggctcccacaaaatatggaggttggtaagaaatagccttgtagcagcacctcacaatactgcctatctttccatattctgaaggaacacagagcattctgccaaagcttaggtcagcctatcgttgggcttacgtaagtagcctatgtggaggcatgcgagttttccagggcacgagtacagagcagttatcctaccttatcatctatagtaaggaagaaacgaccgtgtgaattagtacaaaagcatgaaaagaaaaatgttataagtaatcatttcaaacatctaggaaattttgttctgttggtcttaggataagcattctgcttctattaagttgtttgctcctggactgcaaagaaatcctagagattctgacacagtcacttggcacattctgaagattgtctttttttgtggtgatcatattatcccaagaagtttgcattcatgagtaatgtcattgtactatcatctatcaggagtacttgtatagtcttttatagaggcttttgtgtttcttccagaagactcagtttctgatctgtagcttgtaacaggagcctttaggcaagcataaaaaaaaagcagaaactactgtggaggtaagactgaatagttgaggttaatttattttaatagccatcaatatcagagtggaaaaaagtagaatcctctattaaggcatatcagtttgtaaagatttaatgaataattaccttagaataagaacatcatgggtgacgagggtactgaccattttcagagtcttgaatttttataccatagggtattatgattttccccagttgtctcaatctagatacttagatctagagaaaaaatatttttaactattttttaaaataacagctttattgagatacatttcacttttaaagtgtacagatcactggtttttagtatattcagagtagtacagtcattaccactatttaattttagaacattttcaccactccacaaagtaaccctttacccactagcattcactccctatttttccctctaatctacctggcaactcctaatctactttgtatctgtatagatttgcctaagatataaaatcttttaaaattattgtttattaactgaacagttatttaccagtcattggtacaagaacatgaatatgctccttttttaaaaaggacataatcagtctattgtgtttatattaataaaacgtcacatatataattaattgactgaggaacttatctatttgatgtattacattttttaaagtcttgtgtttagtaaacaaaacagctcttatataatagtattaagctagttcaaaatctagagaatgataagaactcttaattatttctattacctcttctaggtatttcccaagatcactaggttagtatctgatacattactaggtgttcaattaagaaagctttattttattttggtgatagagctggaattagaatccagctttcctcccatggagtctccttctctttccattataccacacatgctttccacatgcgtccaaagctgacatttcaaagggtttggaagcagttcatagtgtgaattatttttctctatttcctctttctctcgcattttttgtagccatacaaaaatatacaagtttaaatctgctattatatgaatgctgaaatgataagtaggctaagggaaactaaaaaaaattttaaaagcttgcagtgttttatatctcgtaacaaatataaatgacccacatttcacacttaaataatgtatgtaaagtaggacatgagtttatgggcatttttagcatgtttactttgtttttaaatagctctagttaaaatgctaaatatgaagcagtgatttccagatgtaattttttttatgctttaaggagctcacgttgaaggagaggcgcagtaaaagaaaggataaacacttatagattttttttgtcatttgtgttttaaattttattgtggtataaatgtagatagcaaagtacacaatacttaaatgtataacttgatgggtttttacaaatgtgtataatgtatatatagtaatcacacagattaatatacagaatatttcagtacctcagaagtttccttaatacccctttttttgtcacttgcactcgtgcaagaggtaatcactattctgacttctgttatatattggtttgtctgttttcaaagtgcatatacatgaaatcatacagtactgtcttgtgtctggcttctttcactcctcattatgtctataagattcctctatattgtttttttgtagcagttgttaattttttctttgtagtattctatgatataaataaagcataatttatatatctatttgcctgttgatagagatttgttatttataattttttactattatgactacagctgtcaaaaacattcttatacttgtcttttggtgaatatgtgcactcattttctcggattgtaaggttttgtagtttataaaagttcaaaacattttaattgaaatagccagaatgccaagactgcctcataagcaattttcaagtctaagtgaatattacctctctgattttatagtagaagctggggaaaattccagtgactttacagccactttagggtcgtatcatatgcctcttctatgatgcaagagttatgggtattatacattcagggattcagtaaatagcaaggtgccatgctaggtgctagagatacctctgtaaaagacagtcatacaccctgctttcaccaatgaacaaacaagtcatttgacataatgtacagagtgcaatgataagagaaatgagaactagcagaggagtacttagaatgaagcatctcacctaaatctgggtagtaatgggagacatcttgtaggaaatgacatctaaactgcatccgaaatactgaattggaattagccaggtgaaagaggtgtggtgaggctggtgacatgagctgggcattgagagattttaggcactttttaaggcttgtagacttgagaaattgaaagtagctgggtgagcagagggaaccattgaagattatctttttattatagaacacctcaaaaagaatagaatgaatcctcgtatacacatcccagtttcagcagttaccaactcatggccaatcttattaagaccacgtccactatccgtagtggattattttgaagcagatttgagatatatcatatcatatcattgaagatttatggcaggagagtgacatgatcagttttgtatttaagaaattacacatacctggtaattctaaattacctttaaaatgcccacaccatagtttagttgtttttcatttgctgccatttatacatagacagttacctttctgcatgtactatttgtagtagtttgcactttttcaaactatagtgttttggaagtatgattaaatgttaaaattgttttatgtattcatctttccatgtgtatcggttggtttatttgcattttaaaatactattaatgaatattttggtttctatctataaaatgtcataatcaatataaaagtcagtttgtttctaggattcagcctccataatagcaaagatactagtatttggaaagaaattagatttatagttctactatgaatcttttttacagattcaagttgaggaattgttttgtggcttgagttttgttactatctgtgtatgaaaatttggttttttgtttgtttgtttacttagtgtttgttggtaagaattaatattgactggctgggcacggtggcttgcacctgtaatcccggtattttgggaggccaaggcaggcagatcacttgaggtcaggagtttgagaccagtctggccaacgtggtgaaacccccatctccgtaaaaatacaaaaattagtcggatgtgatggcgtgtgcctgtaatcccagctactcggaggctgaggcacgagaatcgcttgaacctgggaggtggaggttgcagtgagctgagatcgtgccactgcactgcagtctgggtgacagagtgagaccctgtctcaaaaaatatatatatacatatagatagatatattgctttttaaaaaatttatttttttcagattatgaaaaacatttgtattaaatatgaccaacagtactagttttgaataaaatgttttacacagataagtttaaaaaaatagtatgaccccaatccaaaagaaggacggtgacacaaacaggcaaagtatgcaagcaatataacaggcagggaaaattcaacttcactagtcatcaaagaaagtaaaattttagacctattaagctggcaaaaaaaaccaactgaaattccaccaccaacattagtaaagttgtagtaaaactaatctgctgattcactgctaaagatgatctaaattggtgcagcccttgtgcaaagcatcatggcgatacacgtcaaaattcatgagcatggtaatttctgtagaccagaaatctcactcttaagtaagccccatatcaagaataaaattcaaccaaagaattacttcatgcttaaaaatgcttattgccgagttatcggcaagcaatcaaatgcccagctctatgtgaattatttatgatataaaagaacttgatcaaatgaatatacagccatgaaatgtaaaatatttaagtacaaaatacaaattgtcgtatgcacaccaactaaaatttctgaaaatatgtaagcacaggaaagggaacaatacaataaagaaaaaagttatgattcaaatgaagaaatgtttaattatttgatactgatacagtattttttaacttaaaatgagacagatccttatgtgccttttgaggtttccctttaagccacatgcctgtattatctattgaaagaattattttttagaaataaaaataaaaaaagaataatttggccgggtgtggtgggtggctcacacctgtaatcccagcactttgggaggccgaggcaggcagatcacgaggtcaggagattgagaccatcctggctaacacggtgaaaccccgtctctactaaaaatacaaaaaattagccgggcgtggtggcaggcgcctgtagtcccagctacttgggaggctgaggcagtagaatggcgtgaacccgggaggcggagcttgcagtgagccgagatggtgccactgcactccagcctgggcgtcagagtgagactccatctcaaaaaaaaaaaaaaaaatttaagaactgtatgcatagggacaagccataagctgcaccaactggatcctagatcctctttcgccaagggcagcccattcttggttcttagattccttttattttaaaactatagctgtctatgagccactaagttaaaaataccttcctgtaagtcgagtgtttcttagagcattttagtttaattcctttttttgaagaaaatttagtagatggtaactattggagtactttgggatagcactgtatttattcatgcattcattttgtgagaatcagtgattttaatctaagaggtttgcaaacttcggctgctgataatggttcttacattcttaaaggaatgttaaatgaagacgaattcgcaacagaaaccatatatggcctgcaaatgtaaaatatttactatctgggcctttatagaaaaatttttcaagtgcttgtctaaatgaatataacataaatccttggcatatgctttttttcttttgaaaatctttctgtaagatttgttttagaatgatatttgaaaattaaaattttccttctatagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggagaaaacgtgagaaacataaggttagttagaatctactttttattcttttgataaatgtttatgaaatataaaatactgaaaattagaaagtagaagtcattattttattataaaacatgtggattagatattttcatttatgtgattaaactttctaaacaaagattatatgaattatcttaaagatttaaaaagtaattaagttaaatcttttttttttttgagatagggtctattgtccaggcttgagtgcagtggcacaattttggctcactgcagccttgatctcccaggcttaggtgatcccccactcagcctcctgagtagctggaactacaggtgcacaccaccacacttggctaatgttttatttttagtagagacagggttttgccatgttgcccaggctgggctcaaactgctgggctcaagtgatgtgccaaccgtggcctcccaaattgctaggtttacaggtgtgagccaccacaccgggcttcaagttaaattttaacgcagattgaaataaataatattttaattgatggaagcttgtatacatggatattggaagattaaggaaagagagtttcattctctacagatacagattagcagcattggcattgtccatctatttattattcatttaggtatatgatcgagtgcttactatggaaacctttatgctgtatgctgagggttatagtagtgagtgaaatagttggctcttaaagagtttacattgcaatgggaaagctatgaaaaaaacaacaaggtactggatagagaattatgtggatttggggtagggaagaaggggaacctatgctgactgagaaatcatggacaagttggcagcaatgtaggagcaggttttgaaactccctgaatttcctccattaaaatcacatcaattaggataacacaaccaaaacccattgacaacatctacaaaaaaaggaagaaacaagttatctctaataaacctaaaaagtacaaatgactggagccaaacgatagacagcaacaagagcagtgtaacaacagcatcagtacaaatgaagcagagggaaaataaagggacttccagaaaccaagttgccaacagatattcacctcaaatggtcagtgcccagcacggaaacctcatgggcctgagaacagcaacagaaactgggagggggctgtgctatcaccagttcatgcatgaatgtaaggtgaccacagaaattggatggtgctgaaaagatctggacctgatgaaccccaaatatgaatcaaccaaattcctttttatgacagagtcccacactgaggaggtaactgctggaagtaaagtctacattgagaaacaggcatatagggccaaggaaagaaatagtcagataacaaatgggggaaggaagcagaagaggcatagctcagaaaatagccatatttttgaatacttcatgctaacaacagaagagataaccctagagctatgaagctaggaaagctttattggcccattccatccatttttttcacatgagaagcaagataagactatggtcacattccatagttgttattgtaagataaaagagaataatggagagtaagtcttccagaaaagaaagcatgcccacaaagcatatgaaaaatttaacctaatattttaaaatgacaaaaaattaagaaaacaatataagctatgctcaaacagcatagaataataacaaaacaaaacaaaaccaaaaggaagtacttaataaaattataagcagaagtgaatgaattagaatgaaaaccaatagttttttaaaaaagatcaacaacatatatatcattgaccaaacttatcaataataaaagggaaaagaaaaataaatgtatatatgctgagggtgaaataactatcaaaaaggaaattcaaatcataagaaatttatgtatataattttatgaaaataaatattaaaagcaagatgaaatggaaaattttctagaaaagtactacctaacaaaattaattctagagagtcaaaaagtctgagactttttggagtttgtaatctaccctaccaagaaacacaaggaccaaatcttttcagagtataattctattagtatttttcaggtgaaaggttttccttagagctggagctgacttctgatggtgactgagcaaacatggcttttaaatagacactatttattttaaatcctagccaagaatgattagatacttaaagttgaagcatttgacagcataattataaaaatatttctttatgtcacctatcaaatcaacaaagacaaaagcaataaaatcataaaaaccaaactccagaccatttaggaacaagatggaggaaagcaatttgtctttcctaaaataacatttcaggatggattagagaaaaacagagccttcccttgtaaaagcatcagagttcaatcatttcagcaaatttttactgagtttgtactagatctagatgctgggactgcaatgataataatacacagagccagtgttttcattgctaggaaatgtaagaactctttaaagagaatgctcaactcgggaaggtaatcattctgaccagatggaggagatttggtcccattttttttgaaattgtattaatacttgaaaaagcttactcttgatatcaattatcattgtacttgacatcaataatcattatcaattacttatgcttttcatttcacttttgttcaattttgtgggccagatttattttatttttgtaatttgtaatgttttggtatcttttagttttagggtactcatgcaatagaataagaactccaaagccattttaggtaaaaacaaattaatacatactctactcatgttctatgacctttcttggtgatctaggagccaattttactttctttaggtttagcttaaatgtagatcattttagagcataggggcagaatatttctgtttaggtcaaagggatgatgaggaaaatgtcataaagtctctgagcagagaggaagatagacttctcagaaaacctcagcgaagttggaatggtggtggcctttggggcaagaatttttcagtagtacttcagagtctcctggaataatataatctactggttggtacctctggctgaaacaagcttatctaattactagttaaattttcttccttttgcaaatgtaacatatttgtctttcccctcccttcagcataattccccatctagtgatgatagttcggactacagccttgattcagatgttgaacatacagaaagttcccataaaaaaagaactggtttctacagggattatgacattccatttactcaggtattgccatttttttgttttgtgataaaacatagatagcataaaatgtaccattttaacccttttaactgtacaattcagtgatattaagtatattgacagtgttgttcaatcatcaccacttatccatttctagaaattcttgatcattccaaacagaaactcagcacctattaagcaataacatctcgttttcccctgcccccagcccctgaaaaccactattctattttctgtttctatggatttgcctattctaggtatttcatgtaagtggaatcatacagtatttgttcttttgtatctggcttatttcacttaacataatattttaaaagttcacccaagctgtagcatgtgtcagaatttcattcctttttaaggctgaataatattccgttgtgtgtatatatcacattttgtttatccattcatctgttgatggacacgtgggtgttcatgaaaaaaagcttctaccttttgctattgtgaatcatgctgcttatgaacatgggtattcaaaaatctttttaagacttctttcagtttattggggtatatatttaggagcagaattgctagatcatatggtgattctatgtccaactgtctgaggaaccatgaaacttttccacagtggctgcactattttacattatttacaatgtttacatattatttacattacaataatgtaagtataaaaatacatttacattatttacataatgcctgagggtttcaatttctctacatccttgccaacgtgtgttttttttctttgttttcttttggaaacagaaaatgagtatgaagtggcatctcattgtggttttgagtattgcccttttaagagaaaaattaaactttcaattttattctttctggtattttatcagacataggctgtaaatttgaaatctttgaacaaaagaatacataatgtattagtttgctagagctaacataacaaaattttatagactgggtggcttaagcaatagaaatgtattttctcacagtctggagtctagaagccccagatcaaggtgccagcagggttggtttcttttgagggctgtaagggaaggatctgtgctaggcttctctccttggtttgtcactggcctccttctcactgctttgtcctaacatggtcatccctctgtgtgcaggaacccctggtgtttctctgtgtccaaaattcctcttattatagggacatcagtcaaactggattagagcccactttaacagcctcattctaatttagtcacctctttaaaggccctatctccaaatatacagtattttgtgctaggcaagttatgatgcttctcagagtcactaggaagtatttggatcagtgtgcacttatctgaaaagccccaaagtttctgagttctcgtttttgccagtctcactgttctggtctacaagagcactattttttctcctaatttggtgttcctaatctcttgtgagtttagaaaccaaaatactatttttgttagagttatttctatagtctgattcactgttgccgcctttatagttgagattgctaagtgaccattaaataaatgaggttttattaaaatatcttctcttaaaatttgaaaagaattatacactagttaataattttatctagttgggtaaatatcagaatgtttataaggtcaatatgtccagtgattttagagtcagtggttgttgctatttctcagaacattttataactgttcattaaaaatatttttaccacaagtgacaaaacttttaattcagcaacactgatatgtagttagatttattctttagaaatattcaaaagtcatttggagactcttacaatgaatgaaaagatgctaaggatgggcattattatttcaagtgagaagacatttgaaaatatcaagtaatgagacaggttctggattcataagttatcactgaaagtaaccccaaagaggaagttccaaatatttaaaatagtggcagcattattgtaataagtacatagccttctatgtggccactgtgggaggcaagatggatttgtatgtataaacaataatgcagttgttttaggtatctcacattttttaaacattatgcagttatttattgttaatattacgctgactattatatatccctgtagacatactgttttatttttgcttcaaaaaaatcagttaaagaaattaagaaaacggatggtcttttatatttatctacatttcatttccagtgttcttcactttttttgtagatctgagttttaatatgataccattttcttttagccagacgcactgcatcgtttagcctttgcttagcatatcttatagcacaggtttgctatcaaattctctcagtttttatttattaggccaatgtgtttattttatcctcattttttataacttttcattttgtcataatttcaggcttacaaaaaagttgcaagaatggtgcagagaactcctgtatatctttcatccagattccccagttaacgttttaccacatatgctttacctaatctttcttctctagtcttctcttcccttcagagagatctaatttgcctttatttatttatttgagacagagccttgctctgctacccaggctagagtgtaatttgcctttaaacctatctattaagtatttttcatacgtagaaatttggttctttaaaatcttctaagtcatttttatagtttcaagtttgctgctgaaatgttcatattgtcttttacttgaaaatagcagacttcagatacaaatttctatatctgaagtctgtatttcttttttttttttttttgagacggagtctcactttgttgccaaggctggagtgcagtggcgtgatcttggctcactgcaacctctgcttcccgagttcaagtgattctcttgcctcagcctcccaagtagctgggactacaggcatacgccaccacacttggctaatttttgtatttttagtagagacagggtttcaccatgttggccaggctggtctcaaactcctgacctcaggtgatctgcccacctctgcctcccaaagtgctgggattataggcgtgagccaccgtgcacggcctgaagtctgtatttctattgcctgttattttttgctggttctctttcatgtgatcctatctcttcataagccaatttttgttttcagttttttctattctgtgctgagcattttgtagaaataactttaggcctaggatgatgttcttttccttcagaaaggatttttacttacttctgccagatttctggtgacccttacaaactttattccaatttcaggatttgagacctctgagccactcagattcctgaaggctgggctgcagtctgtgattcgcattttgagatccccttataattgaggatggggtttactaagcttccaccttttccagactctggactccaccttttgtttccatagacaacagagacagtctaaagtgctgttggatctctcacctggttcttcctgatggggtgatactctcggagcaaatgcagctccaaatgctgcccacttctcaggattttcatctactccatgggtattggtctagtaatccttcactaatttgttagctgtctgatgtctacaaacggatttaagaaaaatattttgtctatcttttctactttttttaagagagacaactagtctgaattgcccagtctgctatttacaagaagagaaagttcagtaccatttcttccatatatatattttagagttgactcactgagaattaagattatatcctaattacatccaaaaatcccttttcttagataacaagtatctgctatataacttctacaattacagggcaaaatttgaatatactgttaaccccccagcagttaaattagagaacttaatttagcttcttttttcctcatcttttttcagggcctccttttcctttatttgtttccagtgattgctgtggggcttgtttttgttttacagaaaccaactctatccctgcagacattctagcagtttgtatagccaaataatcagttggcaaagtgattacaaaagctatctatttttgtggaatttgttgtctttttcatttatcttctctcggttggacttgaaaaaatacctgctagaccctcgcccatgagtgcgttttgttcatcccaatgatgaccatatgaaccataaggaatatatgaaccactctagaaaagcggggctgctctgtcacccttcattcatttcatgcttcctggaaaactcatacaacgtggtgtgaatgcgaatgtgaaggaccttagcagtccacactagaagtctttaaccacaaaaggagccctgggatggaacgtgcattcttaggggactattaagaatatttacagttgggaatctagggaggaggtaaatgaaaatttagggataattctacttaaggtaagaacacagagattattttgataaagctatgccaatcagagaactgaattaatgttaagaatttaaaacttgtatgagaagcatctaatctccagagaaaaattgatactcatctattaacaaagtaatcttcaatcataaagtgttgaaatatatcaagtattaatatagtcacagttttaataaaaggaaatataaccatcatttaactagttaatttaatcttcaacttaatctaagcaattattttttgttttgctttagttttcatagtggctttaaaaaatgtcagaaacactgttttggctacaatcataaattcccttttgaacttctgaagtgctagactaagaatggagttcataaactttaaaaagtactacttaaaacaaatcaaaaatatgatagtgtttttaaaatttaaaattgatgagtgaattggttttcttgattagttatgcattttttctctattttataattagaaagatctaatacttcattgcatttcattaaatacgtagtctcatgttggtattttgccagagtagtattttattttattttatttatttatttatttatttatttatttatttattttgagacaggttctcactgtgtcacccaggctggagtgcagtggtgcgatcttggctcactgcaacttcctttcacctcctggattcaagcagttctcctgcctcagactcctgagtagctgagactacaggtgtatgctaccacattcagctcatttttgtattttttggtagagacggtgtttcaccatgttggccaggctcttctcgaactcctgacttcaagtgatccacctgcctcagcctcccaaagtgctgggattacaggcgtgaaccgctgtgcccggccagagtagtattttaatatcacatttaaaatgcactaacctggccaggcacagtgggtcacacctgtaatcccagcactttgggaggctgaggcaggcggatcacaaggtcaggagttcgagaccagcctggccaacatagtgaaaccccatctctactaaatatacaaaaattagccgggcatgttggtgcgcgcctgtaatcccagctacttgggaggctgaggcaggagaattgtttgaacccaagaggcagaggtcgcagtgagccaagatcatgccactgcactccagcctgggcaacaagagcgagactctgtctcaaaagaaataaataaataaaataaaatgcactaagctaaagatgaattatttggtttggatttgtctagatccttaagttgtaattatgtgcaattttttctcgctttactaaaaaaaattgacagaggatacaatagaactaataaaaatatttcagtgaatagagacagacctgaatactgtcatttaataaacttctagtactaaagtgtattctttgttttcacatgctttagtaaggaagcaataaaactaatcatgtttgttgtaataaacagtttctaataagcaacttattcactagatgtttttcactattagggaaagctctgttttttctattagacccttgatatagacattttctttttataaaattttccacacatacagttttttattaaatataatgtaatttgagaattttccagtgttaggagaaatagtatgttttaccacactcctccaccccaagctatttaactatcttttccctattttcaaaaaggccttttcattttttggaggaaaaatttatgtatgattgtgtgtatttttactttttcctgtgtgtaagatactgagacatagaacatagaaagcaaaggctaaagcataaagataacaatatttaattatctcagggtaacatttaggcttttgaagttagtgttaagtagtatcatagataagtactgatcaagagtcagaactaataactgtcttttctcctttctccaaacttgctggggggaaaaggatgtcctgtgctactgtcaattgctatatataattgaaaaatcctgataatgattgtccattttcacttagcgtggacatatatcaggaagctacataacatcaaagaagggtcaacataacaaaaaatttaaaagtaaagaatatgatgagtacagcacctacagtgatgacaacttcggtaactacagtgatgacaactttggtaactacggtcaggaaacagaggaagattttgccaatcagctgaaacaatacaggcaagctaaagaaacctcaaatattgctttagggtcatcattttctaaagaatcaggaaaaaaacagagaatgaaaggagttcagcaaggtaagtttgaaattacagtctgtcttagaatgtgagaaccttattaaaacaggcagctatggagtaaaaacttagaaacttatccctgttcaagattagcttattcttgtagaacctaaattcattttcttttattttgtagaccttgagaacagaatctacaaatatttcaatctgtatgatacatgaatatttcagttggaaagatattctaatgatttaaaaatacataaaaatgcaatacaactttcttatatttttccccttgcttctgtgtcatgtcagtatacagttatctctgttgctgtatgtattgctttaaatttagaccagctgggaagctatacttttattaggctttaaaatacagcagtcatttttgctaagcaagtgtgcatggactatgaacatcttttaaaattggagataaaaacataatctaaagacatttctgcactgatcacctgtttatctgcaatattgaattacatggtccctggagagaccaggacaagttgccagctcttgacaataagtgaagaaactatgggtcatgtaagcctcaaatcagccttaagtattggctagtcaatgtatctgcttcaggaaaagtggagcaatatgagactgaaatgaagtagtgaggagccacactctgtataactaccctttaattatctttgcatacaggaatcagttatgagtaaatttggttatttctatgactttattttttctcgatttcctagcaggatttctttgaaaaatatgaatgtaggctttagctgaaataaagggaaaataatttttctacacatatgctgttgtactgagcaagtttgttcctgtagtctagatgttgtggtatcagggatcatcccacttggacaataagggtaatgcaaaaaagtcttgttcatcccttcccacctggggcttttcttttcaagctcctacttgtttgtgctcttaaagaactgagtattggccaggccaaaggcttacaccttaagtcccagctactcaggaagctgaggagggaggattgcttgagcccaggacttcaaggttacagcaagctatgttcttaccactgtattccagtctgggtgacagagtgagaccctgcctctaaaaagaaaaactaatttttgtaatttgggtatctttttacatacttttaaataccaagtttttcaaaaacaaaagaagtataatttttcctggagatatatgtgtatatatctactcaaaattaccagtggaaatttgatttgctgctaattaaccactgatacctacaatgtcttccttaaataggaatataatatttgattctcttaaaaacagaaaggcttgttaatgatcttatgctaaggaaaattaaaaagaataaaacttgatttcgcttctctagccatgtgtatccttgttccttgccttcctatgttgttaacatcccttaagaagcagtaccaaggagataagatacaaagatttaatttttttcattgaatctagaaggaaaaaaaagaatgcactgtatattatagactattaaaatgtgctgttccttataaactaataaattgaaaggtatgctgtttttcttttaaatttaagtacattttaacttttctaggtattgaacagagagttaaaagttttaatgttggtcgtggacgtggcttgccgaagaaaatcaaacgaaaagaacgtgggggaagaaccaataaagggcctaatgtgttttcagtatcggatgactttcaagaggtactaagaatttatgtataaggaggggaggagctttttcatcttttaatttatttgatggcaaagaaagcattgtgattttaatgatacttctctagtaaatgaaaaattaccagctcagataaaatgagtatcaataacctccaaaaaatagttgttaattagttgtgaaactaatttacagattttgctgactttgaaataaaattgttatgtttgaaagaacctcaaaataaaattgctaagtttaaaagcaaaaatatatcctctattagtcttcttttgtgcttttctttcctaggaatcatcttccccagatgtaactggcaatgaagtgctaatagctcaatatgtaggggggacaagaagggaggcagtggtaaattaacttcctttttagagttgaaaagattgaaagagaagaaagggggatataaatggttggaaaggtgaacttatgtatgttacatgttgtagatattcaataaatatatgtcaaattgagttgaactctgaacatgaacttttaaccttgtagtgactccctggattactgtggtccaattcctgtgttctactactgttctagtaagatttgattgaattatagaggcaatagtgggtcattaaaagctggagctttggctgggcacagtggctcacgcccgtaatcccagcactttgggaggccaagtcggacagatcctgaggtcaggagttcaagaccagcctggccaacatggagaaaccccatctctacaaaaatacaagaatttgtcggatgtggtggtgcacatctgtagtcccagctactcgggaggctgaggcagaagagtcgcttgaacccaggaggcggaggttgcagtgagccaagatggctccactacactccagcctgggtgacagagcgagactccatctcaaaataaaaaaaaaaaaaaagctgcaactttgtgtgagagctgagagggatagctatatactataatttgaaaatgcttggttttctgatctctcagtttaaagatagtgggcagagatttcttaatatgcactccttagtatactgtttcaggagatgttaacaggtgtgacctaaaaaaagaaggtcagacccaaataaatttgcgaaacccagcacatgccatctgcttttggagattctcagttgacattaatgtagtaaagcttgtgagcagcttaggcaaaaagaagcttattttgttcaacccatcatttactcaactacaaactatttttttccctacacacctactaacattcactgagccactcactgttccatggaacagcagctttggaattactatggttattattttagaattttggggtgactaaaaacctgcctgtcatcttcttagacaccagtagacctttagaatatgctgatttccctaacccaaactaatacaaatgctttctaagtaagcctgcacctatacccagttcttacaccctatacctttaaacaaaattagcttccaggaaagtgtgactttgagcaagttatacctgtctctttgcctcaatttgcttaatctgcaaaatgagggtatagtattaagttaactctaagggccccatcaagcacagcattttagatgtctgtagatctgggctatacctaaaagataatcatataacagaaaaataaagataaaaatacattatcagtcatgtcaatttattggctatcacgagagacatttcttatgattccagaaacaactgggagtgtgccagagcccacggaagcagttcatgttcaggaatggtctgcaggtggcccatccagaatagcatgaacatggaggccacagcagagtggccaagatagatccgtctctgtcctaggcctttcagagactatgagagtctccaaagccaaatcaattcggggtaccttcagattcatcataatttttttgaaaaatcaagagtagtcacaaagaagcaaactttcactgaattttaaaggcttcttcattttattggccataatactcttaaattgttttagtatttactgtacctattacatttttttgtaataaatattattttcctggtagatccttacatttcctctacctgatatatattaatattttatgctcttgtctcttgtatcaatatatcttctaaagtaaataagttttaaaatgaccaagtacagtaggtagcttggttttttttctccctccatctctccctctttctctccttcattcttgtatttttttttattcgcagtactgtcttgtaatgcaaagaatataggaggagttgcaaggcacaattcctgagttctgtcagtctgctaactcaccatatcttctgggcacttaattttgccctaaaaatttatttgttaaagttgctttagattttctatagtaccttgattatagtcaggtttcccatagctgtggacactgacatactttctactcatttaagtggaactaaactaaaaaacaaaacaaaacacttcctcaccacaatcctctattaaaacaatgaaacattatttggaagtaatgtatacagaaagagtaagttattaatgaaacgctaagtacaacttgttgcatttttcagggtgtgtgtgtgtgtgtgattacctaatttttttactttttaatttcagagttatattcctcaggttgctcattgatttttgcataatttactttctttggctgtttattttattttataacagccatgattctttgtatagaatgcctatgtgagctggtcatttatatctgcttattctaaacgaatctctaaacataaaaatgtttgtgaatcaaatttatatagatttgagacactttaaatgattctgtcatagtatattataagcaatttcattgtgttttcctggggtaaattaggtatgtttatatttttaaaacgaatctctaggattatctgtttactttgtattcttgtaccttttttagaattcttacagtaaaatgtgatttgagctgtgaatgctggggatcagatttcaatttagacatctattgcctcaatgtttgctgtgaggcaatctcttgttttcagtagattgaactttatgctctatcttttagcaaattaagagaaaagggaaaacagaaatcaaatcagaagagtaaatagtcattgaactcctatgatatacagggcacagtgcatgccaggtgcatgaaaaataatgttgttttttagagttgatgaatgtaactcattacatttagcatggctaagcatcatactctgccttgttacttaatcttatacttaaagcagaagttgaataggggactcaggagaagtaaggaaaacaagtagggctataagatttcttttcctttaattttcttaagtttttttcttaactttttatatttaaaagttaaaagtaatacacgccgcctgtttgtttgccctttttttcccctaaagaaagtacaaaataaccacacacataaaatctctaatcctgccatccagagacatacactgtaaaatatgggggtatattctttttgtcttttttcctttgcctttatttattattgtagaattgggatcaattttttacttcataaaatattgtaaactttttttttgttttttttttgtttgtttgtttgagacactctcactctgttgcccaggcaggaatgcagtggcgtgatcttggctctcactgcaggctccacctcccaggttcaagcgattctcgtgcctcagcctcccaagtagctgagattacagaggtgtgtgccaccacacctggctaattttttgtatttttagtatggacaggatttcactatgttggccaggctggtctcaaactcctggcctcaaatgatcccaaagtgctgggattacaggcatgagccaccatgcctgatctgtaaacagtttttatgatccaaagttgttgattttttaatgactgcataatattctaccacctaagtgtatcataatatatttgaccagtcttctagttttaaatgtgtagagtgtttctcgttttgctgtttgttttactatgtcagtattttattatatgactagatctttgtgtctccctgataattctttcaaaataatcccaaaaagtacaagttgtatgtcaaacaatatggatattttaaagtcttttataacatacctatcaataatatgagtgcatattttattgtgtctttgcccaaattgagaattgtgaatttttaaactttttataattttatttaaaaagttattcatcttcattaaaatagaaagaaataggcttttttttgcgatcactagtagcataagtagattactagacacatatctctctccaaataaatgaatagcatcagaatgttcaatcttgatcactttttgtagtcaatttgtacttttttccagatcaacttaatcatacattttgatacctattaatatttcatatgctgcattcaaatggaatttttttcttgcagtataataaaccagggaaaaaatggaaggttatgactcaggaatttattaatcagcacacagtggaacacaaaggaaaacaaatctgtaaatacttcctggaagggaggtgtattaaggtaaatttatagaggtatcataagtcattttaacttccaaaataatctttaaaattaaagtcttttgggggatggttaatttttttctcttctcatatagttgtaataaaactgggtctttaaaatgtatcttgcatggaaataccgtacattagagctcatttaattatgttctgggacaataacataatttgttgaaatcggatttgtttaaaagacacataatgctacgtggcaagtactgttcaaagtacaactaatattaaatgatttaatcctacagtgaccctacaaagtagttaatgttattatccccattttattcatggcaccaagaggttaagtaagttcccatggtagctcagcaagaaatggtgagtgctggttgccaattcaggcagtatcctgtgaggtcttgctcactgtgctgccttaatgcatgtagctacatccactgtcttgggcaggaattctaaggggtcatttgagttattatttgttcattattaaagactgaagataatgaccataattttaccatgagacaccatgtagaaaattcagctgttgtttctttgtttctcattgtttcttacctttttttcttttttcttttttttttttttgtgaatagggagatcagtgtaaatttgatcatgatgcagagttggagaaaagaaaagagatctgcaaattttatttacaaggatattgtaccaaaggagagaactgcatttatatgcataatatcctttatttaaaatgtatgttaaataaaatgctggggttttaaagcatcattgaggttttaaaaaataataaatacaccctataaagcctagtttggttttaaatttaaaacaacacattacataaacccagtctagtcaaactttgtacttcaaaagagcaaactgacctttattctttagggaaatgagataactgccctttggaaaaaattctgtgaagggaaggtactttaatataatcagcttaaagtatttcaagagattgtgcttcctgaaggagtagttggcaaaatacttattttattccataattattttacttaagttcgggagtaaaaaattatcattgtgaagattataagtcttatcaaatcttaccactcaatgatagatgctgtatattcttccccactctcccttgggaaatatatacatttaaattgtattcctgctcctacccaaattggaatttcactatatatagtgttctggtcctttaaaaaaatgtattctgcaatttttccatgttaattttcccccaaatatctgtcaggttgctcactacgacttatgactaatgaagctttcccccacagaattgaaactctatcacagacaaaatgtttacatatatggatttttcttctggacttcgtgtttggctccatggatttgttcaccctcatgtctgtcttgctttgctgtgattatttctgccacaacagccacggtaatatttggtagattctgatgtttatttttccagataaatttttaaattctgttgtcgtgtttaaaaaatgtgaaaaaaaagaaagtgaataaaatgaaaaatgcctgttatcatagatcaaaatgtcaaaaaatggaacgatgtaattaccagaggaatacatgatgaattggaacagaaaaatttcctgtctcaaaatccagaagcaaaaagggaacagattgaaattttgactccatgaaaaagcttgcatttgcaaaacaaatacatataacatgagctaaataataagataaataatgaagtgagaaagattatgtgtaatttatatcacttacgaagaggtcatatccttaatatatgagtttctaaacattgagaagaaaaatgagggaagagatacagataattcccagaaagagaaatgcaaatggtcccaaaacatacagaaagatgttcaatcttgttcctaataaggggaatgtaatttaagctacactgagataacatttgcagctgtgtcacgtttgcaaaaataaaaaaatcgtgacagtgaagtttgttagcaaggatgtgagaagaccttgatgctggcaatgtcaaaatggtgcattcctatggaggagagcttggtaaatgcaatatgcatttaccctttgacccagcaatcccacgttttgcagtttctccacaatagacctgggcagtgattactgatggctgctaaaatcatgaggtgaaaagttaattaggaactttacaactgatggatggagctgacaacacctgaaaggactgatcagtcttaacattactaaaaagaaacaaccagatattaaatgccttttgatatgatacagtagagagtatttgaataccatctatgaccaatattaaaattaacaaatgatacaaaaataaaagggaaaggggaacttctagaaatcagtaaaagtaacttgggagatgtattaactagatacaatttgtggatcatctttatgtcctgatctgaagaaaggaattataaaaacatacttttttaaaagtctggaaaatttgtatattgactggttactagttgaaattaacacattaattttgccagggtggtaatgaagtcgtgattggtaagaaaaagtattcctggccaggcatggtaggtcacacctgtaatcctaacactgggatgctggggtgggaggattgattgaggccaggagttggagaccagcctgggtaacatagtgagacacctcccccactcccataactaatttaaagaggaaaggggccaggcacggtggctcatgcctgtaatcccaccactttcggaggccaaggcgggtggatcacctgaggtgaggagttcaagaccaacctggccaacatagtgaaaccccatctctactaaaaatacacaaattagttgggcatggtagcgtgcacctgtaatcccagctacttgggaagctgaggcaggagaatcgcttgaacctgggaggtggaggttgcagtgagccaagatggtgccactgcactccagcctgagcaacagagcaagactctgtctcaaaaaaaaaaaggaaagaaacaatagtccttatgttgagaataggtatggaaatatttacaacaaatgatgaaagttgttgaacctatgaggtcaacatgagagggacttcattttattattctctctactttggtatggttaatgaccttcaaacaaacttagaaaaaaaatcctaagtaatgtcatcctacagagaaccatacttggagtatggcataaagcctttcagactttttttctatgctggtatgtatgtatgaatggatgtgtatatgtttatacacataattttttatttttgtgagacggagtttcacttttgttgcccaggctggagtccaatggcgcgttctccgctcactgcaacctctgcctcccgggttcaagcaattctcctgcctcagcctcccgagtagctgggattacaggcatgcaccaccacgcctggctaatttttgtatttttagtagagatgttgtttctccatgttgatcagactggtctcaatctcccgacctcaggtgatccgcctgcctcggcctcccaaagtgctgggattataggcgtgagccactgggcccagcctatacacataattttttagaaaaatgaaatctataatgattgtgaatattgtatttttaaatttaacatttacattaatatggactgtattttaatacacagtgtgttaataaggacctttattcagatgattaactcattgtcttatctttactgatttaaaatggcatcttcaccagaccctaaattctcatttgtacacagttctgcttctatactactcttatctattgtggtatttgattattcacctctgtaagagtatgtttgatatttggtaaggcaaatactccttcctttttaaaaaaaatgttgtaatagtctcaggtcagaagtgatttggcaaataataaaaacaaataaaatgtaatgaatttgtcctattcaagaaaaataaattttttcagatttgacatatttctttagaaagcaaatactttattctgtttctgaaagctttccatctattcttatggggtttttgttatatagtcatgctgtttgtaaataataataattttacttcatttacaatatttatacctcttatttaattttaattgtattggccacatttccagaagaatgttaaataatagtgactgtggcagacataaaacatgttttaatgatagtgcctttttgttttagcttgtggctgcagttttaaagtaagttttaaaaaatcaattaagaaagtatatttttattttactaagaggatttttttaaacctaaaaaagaaatctaaaaaagattttgaattttatcagttgccttttgcatctgccaaaatgatcatataatttttttcttgaccttatcagtgtttacaataataaatttcctaaaaccatccagctattccctgaacatacatcacctgagagtggtatatttttcactatacttctagatttaatattttctttatacgtttgtctccaaaatcctaagattagtctgtagttgattattgggatatttgcctttaacatgacatattaagcctcttaattttctttataaatataagctcttgctacaaaatttatataatattttattttattgtgaaaagtaacagagcttatgtaattaaaatataatagtgtttgctataatagtgataaatgttttttttcctttaaaaagtggctttctagttttaatagagaaaaaagctgtttgaatgtttttgtataattaaaatatctaaccttaatagaattaaaaataagctgatgtgattatagtaaattcagtataatatataataatacagccttattgattcagcacagttgtggttttgtgtgtgtgtgtgtgttaagaacacttagcatgagttctactcccttaacaaaattttaagtatacaatacagtattgttgactataggtacaatgttacatagcagatctctagaacttaactatcttgtctaacagttgtaggttttggtttaaaaaaaaattagaccttgattttacttggtcttttccttaatatttttatttacatgaatttccatgcaagttctatcatagtggagcaaaatgttaccagggagacaactgtaaattttcccatgatgatctaactaaagaaacaaagaaacttttggacaaagtgagtaatatttttgtaccttgattatgtctctccacaaatacatttgacttgaatcatattttataagtgatattttatgaaactgctgagaaattgaaagtttactattttatattttattctatttgagcaatattctttacctttttgaacctcattctgtttataaaaaatgaggagttagctatctccaaaccatttcaacttttttttttctttctctcccccttccctccttcccgtcttccctccttccctccttccctccttccctccttccttcctccctccctccctcttgcttgcttgctttttctttcttatttctctctctctctctctgtctcttttcttttcttttcttttggcaaggtctcgctgtgttgtccaggctgggtgtagtggcgtgatcttagctcagcttactgcaacctccacaccctgctccttgccaaccccctgccctgcaccgccccccacccctgcccctggggtcatcctcccacctcaaccttctgaggtgggcactaccatgcccagctaatttttgcattttttgtagagacaggggtttctccgtgttgcttgggctggtctcttgggctcaagcgatccagctgccttggccttccaaggtgttgagattaaaggcgtgagccactgcgaccagcccatttcaactttaatattatttttctactaaccaaacttaagtcttctagttttaaatgtgaggaaaagactcgctttgaaatagtaatctttgccaattatttttaggtgttgaatactgatgaagaactcataaatgaagatgaaagagaattagaggaacttagaaagcgtggcataactcctcttcccaaaccacctccaggggttgggcttctgccaacccctccagagcattttcccttttctgatcctgaagacgattttcagacagatttctctgatgattttaggaaaattccatctctttttgaaatagttgtaaaacctactgtggatttagcgcataaaattgggaggaagtaagtgaaaaactttcaaaatgacatcaaatatttttttctgaaaattatcattaagaaactaagtcatactccaagctaatcatgtaattaaacttggttagagatagcacatatctggcatgcacgcagattgttgcttccacctttgttttcggttcccacctgctgcttgccatcagtgctttcccatatggaatccttatacagcttctgaaacttctcagcatagtaatcctgaagaaccctgcctggtgggtggatttggcattttcacttgattatgaggctgcattgtcattgataatgccttcagattgtgggaaataggtctccacatatttgattattttgaagagcaattccttaggctattggcggaagacctctggatccagattttcattttctaacaccaccatttcagccctgctgccagtccccaagcgtctgtgcacctgggccctaagtcacattgttgagcattcgtttagtcctgacaactcaggaaagcaaggaggtctcagccaatgaggaacaagaaatctatagcaaatatcacaattcatttgaaccattaaaagtatttctactaatgtcaggaagataagtatgtccactattttggtaatattatatattgtatcctggtcaatgaaataagagaaataaaagttataaagattagaagtggagtggcagcctaattatttgggaagtttccctcaacccaaaggaatcaacagacaaaactattggaaataataattaaattagcaagatgtcaggaaagaagagcaacattcaaaaactgaatgtctttttatatgccagcaataaccaattacaaattattataaaaagttggatgtttatatagtagattctaattttactgtaaaaggttatatatgcctgaaaaagaggactagtaggagagaaccaataaaattttatctctgggtagtgggattaggggtgattcttatttatctttgtacttttctgtgtttttcaaaacagtaagttttagaacagctaacggtaagcagcaagtgggctaaaatgaaagcatgaggtctatttcgtgtttctacctatcgacgctatggaacaaattgcttcttaaacacacagtattctattctgatgtaaaaaaagtacttaaccaatatctgtttagaagtgttaacattcttgtttgtttctttttctttgaactaagaaatattattatttctgtctacaggccaccagcattttataccagtgcctcaccaccaggaccacaatttcagggaagcagtccacaccctcaacatatctatagttctgggtcaagtccaggtcctggacctaacatgtctcagggacacagtagtcctgtgatgcacccaggctcccctggacatcacccatgtgcaggacctcctggtctaccagtgccacagagcccacctttaccacctggtccacctgaaattgtaggtcctcaaaatcaagctggagtgcttgttcaaccagacacatctttgacaccaccaagtatgggtggggcttaccactccccaggctttccaggacatgtgatgaaagtacccagagagaatcactgttctccaggttcatcataccagcaaagtcctggtgaaatgcagctcaacaccaattatgagtccctgcaaaacccagctgagttttacgataattactatgcacagcattctatacataattttcagccacccaataactctggtggtaagtttacttttttgaaataatttattcctaatttaaaatacagtcctatttttcattaaaagcatgacagaaacgtaagttttaagtaaagctgagtaaaattgataagattgaaaccttaaaatgttttcagtttgccaaacttttgaaacaatagaattttagataacttttagaaatattttaaatgatataatttgataatccagtgtgcctgtgatgaaagctttcatttcttatgactggtgaagttttgtgctcactcaatgactgtctctccccatgttatacatgtagatgggatgtggcatggtgaatttgcccagcagcagcctcctgttgttcaagactcacctaaccatgggagtgggtctgatggcagcagcactaggacaggccatggccctctgcctgtaccaggcctcctccctgcagtgcaaagagctctttttgtaagacttactcagagataccaagaagatgaagaacaaaccagcacccaacctcatagggcaccaagcaaggaagaaggtgtgtcagaagttattaatagcatcttacctatttggatgggttaaaatttttaaatggccgaggcaggtgaatcacctgaggtcaggagttcgagaccaacctggccaacatggtgaaaccccatctctactaaaaatgcaaaaattaggtggtcgtgttggcatgtgcctgtagtaccagctactctggagcttgaggcaggagaatcgcttcaacttgggaggcagaggttgcagtgagactaggcaacagagtgagactcagtctcaaaaaaaaaaggattaaaaatgagctctgtcttctatttccaatgtatttcatagccactatcttgtgattgattgtggtttcagtgccattaattgcattaatacttaattgctaaaggtttgacttgaagcagtgaaaagatctgaagctagagttcaaggttgtgcagacttgcaagtaattaagccttttgctttttttttctgaagaaaataaatagaacaggaaaaggacaactttcagtttaaggattttgaattctagcccaatttcaaaatgattcagttattagagatatttttatgtcataggctctataattaaggatctgctataataagaaatatttttaaatataaaaagattatatggaaactaagtttatcttagtatttttgatactggtaagtatacaacagttagttaattcagtaaaggatgagaaaagtttaaagcatccagttctgtttatgaattacaaaactgatgtttggccactcttaaacatgacatttatgaaaaactatgtaaaactatgtaacgctaggtagctgcaagctattatatgagcatttaaaatatatatatttataatttttaaattatttttgtgggtacgtagtaggtatatatatttatggagtacatgaggtattttgatagaggcatgcaatgcataataatcacatcagggtaaatagagtatccaccaccttaagcatttatcctctgtgttacaaacaatccaggtatactcttttagtttttttttaaatgtacaattaaattattattgactatagtcaccctgttgtgctatcaaatactaggtcttattcattcttttaaacttttggtacccattaaccgtccccacttcctccctatctgccagctacccttcccagtctctggtaaccatccttctactctctatgtccatgagttcaattgttttaatttttagctcccacaaataagtgagaatatgagaagtttgtctttctgtgcctggcttatttcacttaacataatgacctccagttccctgttgttgcaaatgacaggatctcattcttcttatggctgaatagtactccattgtgtatatatgccacattttctttatccattgtctgttttttgttttgttttgttttaagacagagtctcactctgttacccaggctgggattcagtgacacgatctcggctcactgcaacctctccctcccaggttcaagcaattctcgtgcctctgcctcccgagtagctgggattacaggtgtgcaccaccatgcccagctaatttttatatttttagtagagatggggtttcactgtgttggccacgcttgtcacgaactcctgacctcaggtgatctgcccgcctcggcctcccaaagtgctgggattacaggtgtgcgccaccgtgcctggccattgtctgttggtggacacttaggttgcttccaaatcttggttattgtgaataatgctgcagtaaatgtgagagtacagatatctctttgatatactgatttcctgtcttttgggtatatacctggcagtgggattgctggatcagatggtaactttatttttagttttttgaggaactttcaaactgttcttcatagtggtcgtactaatttactttcccaccaacggtgtatgaaggttctctttcctccacatccttgcctgcatttgttatttcctgtcttttggataagacccattttaactggggtgagatgatatcttactgtagttttgatttgcatttttctgatgatgagtgatgttgtgcaccttttcatatccctgtgtgccatttttatgtcttcttttgagaaatgtctattcagatatttcgcccatttttaaattggattattgattttttcctatagagttgtttgagctccttatatattctagttattaatcccttctcagataggtagtttgcagatattttctcccattctgtggattgtctcatcatttgtttccttcacaatgcagctttttaacttgatgtgatcccatttgtccatttttgcttggttgcctacgcttgtgaggtattacttaagaaatctttgcccagaccagtgacctggagagtttacccaatgttttctggtagcagtttcatagtttgaggtcttagatttaagtatttaatccattttgatttgatttttgtgtatggtgagagataggggtctagttttactcttctgcatatggatatccagtttttcccagcaccatttattgacgagattgtcctttccccgatgtatgtttttagcacctttgtcaaaatgggttcactgtagatgtatgggtttctttctgggttctctgttctgttccattggtctatgtgtctgttttttgttagttcatttttttgtttttgtttttgttttttcttaagacagggtgtcactctgttgtacagtggtgcgatctcggctcaccacaacctctgcctcctaggttcatgccattctcctgcctcagcctcccaagtaggtgggactacagatgtgcgccaccatgcacagataatttttttgtatttttagtagagacacggttttaccacgttggccaggttggtctcaaatgcctggcctcaagtgatctgcctgcgttggcctcccaaagtgctgggattacaggtgtgagccactgtgcccagcttatgtgtctgtttttatggaggtaccatgctgttttgattactatagctctctagtataatttgaccaggtaatgtgattcctctagttttgttctttttgctcaggataggtttggctattctgagtcctttgtggttccatataaattttaggatagttttttctatatctgtgaagaacactattggtattttgattggaactgcattgaatctgtagattgctttgggtagtatggacattttaacaatattgattcttccaatccatgaacatggaatatctttccaatttttggtgtcctcttcagtttcttgcatcaatgtaagtgaacattttttgttacattttcaaagaagatattattaattcttcatttacctaacatcacaggagaatgaaggattcctaataagtgaatttcctgtacaatttcaattataagcattttaatagcaatctttcagccgggcgcagtggctcacgcctgtaatcccagcactttgggaggccaaggcgggtagatcacgaggtcaagagatcgagaccatcctggccaacatggtgaaaccttgtctctactaaaaatgtaaaaattagctgggcatgttagtgcatgtctgtagtcccagctactcagaaggctgaggcaggagaatcgcttgaacccaggaggcggaggttgcagtgagccgagatcatgccattgcactccagcctgggtaacagagcgagactctgtctcaaaaaaaaaaaaaaaaagtaatctttcgatagtcttaaaagttttatgttttcataaacaaagatattaaaacttttagataatagaaaattttattctataatgttatataattggtagtgttctatgggagttgttggctctgatacagaaatattttgaacagctaggtttacttgtgtttgtgttaatttttatggattttaatgcttttatgcattttatctctgctttgataaaagctgctaattatcattttttatctaatatctgttttccaccagcctgtctctattcttctactctccctctgttactattttcactctcatttaagaaagattttaagtatgctttataaatcatgaaatatatatataatgcttataaaatatattgatatgggaatgaaaagaaagtaaggatagaagtaacaaatactatgaggagtgaaattactatacagaaatatttaaagtaattgcagcaggtaaaagtgaatcacaaatccatctgtagatttccttgatgtcaaagagaagaaaagagatctagtgtctagaagtagttttttcagatattgagatctgagtaaaactttttgcaattgtgacataccatatgctgttttaatccacattctaccctaaataccaatgcttgttttgtaagcactgctttgttcaaactaaccctgtaacactaaagttccatgtagtaggcatgcattagtgagcagtgagatgaggtaaaaatgagaatatctaggatagtctgctgatccaagatactccaggatggagatacatatatgcatatacagtatatctatacatctgtattccatgttctgactcttacgttctggcaagaatgtgaacagtagataccttgtggccaattcagagccaacctgtgtatattttaatggagaggagggagaatcacccttctgaaacatcagtttgtaattccttctgctagagaaaagacttacgataggtaggcttctttaggtaggcttcttaaacttgcatctaatatgctagagttaaataggctttaagagtaagactcaaagtgttctcataaagtatgtaagttttaggatggtaggtttttttttttttttgagatggagtcttgctctgtcgcccaggctggagtgcagtggctagatctcagctcactgcgagctccgcctcccaggttcacgccattctcctgcctcagcctcctgagtagctgggactacatgtgcccgccaccgtgcacggctaatttttttgtatttttagtagagacggggtttcaccgagttagccaggatggtctcgatctcatgacctcgtgatccgcccacctcggcctcccaaagtgctggaattacaggtgtgagccaccacgcccagccagttttgttatttttaaagttaatgtttgaatagctaatatagtcacacaggtcaaatatctaaacatataataaagagtaaatgaaaagtctctaccccattcctcatttgctcagtttccattgctaccttaaccatcactttcagtgttttgttttctttttagtccattgttaacttgataaattcagagctaggaagcttaaggaatgcttgatttgaagagacctagcatattttagaatgctaacagcattttcctttctcctacagcccaccacacatacaacacacatatctgaattccctttggccagttggaaggaaaggtcctgccttttctctgactggaaggacattacacatattctagtatcaccccacttccttaatagagtataatgactgaatcgatagttttcttaccacatcttattttgttccagtattgaaatctggcatttttgttatgcattttcttgaagttagattatacttatttcagaaatagtatgtgttttttaatattaattaaggctacatataaatgtagccatattataaagaataatttataattataatataataattttattatattataagtttataatataaagtttataataagtttttgtctgcatttagatgatacagttaactggtattccagtagtgaagaggaagaaggaagcagtgtcaaatcaatactgaaaacattacagaaacaaacagaaactttaaggaatcagcaacaaccttccacagaactcagcactcctactgatccaagacttgctaaagagaaaagtaaaggaaaccaagtggttgaccctaggcttaggactatcccaaggcaagacattagaaagccttctgagtctgccccactggatcttagacttgcgtgggatcccaggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatacaaaaagtgatcttcatcaaaatacagtgtccattgatccaaaattagcagccaaagccaaaattaacacaacaaacagagaaggctacctagaacaatttggagactcacacggttcaggagctaaattaggagatcctagactacaaaaaaattttgatcctaggcttcacagactgcccaatacagagtctcatcaagtggttatgaaggattcacatgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctggtaaggttcaggtcccagcagtgcacagccttcctgttcaggcattaacaggcttaattaggccacagtacagtgatccaaggcaggcaaggcagccaggacaggggagcccgaccccagataatgatcccggtagagaaacagatgacaaatctctgaaagaggtttttaaaacttttgatccaactgcttcaccattttgttagctattgtgtaactgagcaattcttttcactcttgtgactatctcagtcctctgctgttttgtaactggtttacctctatagtttatttatttttaaattataaacacttttcagctgctagtatcagaaccacatgaagttatagcctctaaagcctgtggtattttatataatatttttataactttaagagactgtagtaattgacctaaaaacttatgttagcttcagtaaaagtacttttattgtaaataaacaatcatgaactcaacactctgcctgaatatatgccagttgtctttcataatcaatgtttagataaatgattgccactttttatatggttgtttagtttcaagcaatatgatgtacattacttttgagaaacagtattttgactaggacctctcttatttgtcagcacagaactgattaatatgtaatgctacctgctaattaaaatgtaaaatcaagtaaagaaaacattttaaaattacaattagcagagcagttcatgtttaagggcatcacttttattagtattggcaatattatttgtgtaaatgaagcatttgaatgtcatatctttttaaagtattttattgtatactgtatcatagaagttggaggtatataaatagaacattttgctaaagtgaaaaatttccaagttctctagcataactttttacatttaatttttcatatgaaatagcaattagttactgctgtgttacattgtgatgtttatgtatgtcaatgtttttgtctttaacagcataatttatattgctttttcaaatgatgtagctgcattaattgtgttcatcatgactttggcgatttttaacaaaatttttaaagacccagtgagagtctgtagtgattattacacggataatgttttaaatgtctaggttctgtatttttttcttaaatagcaagaaaatacagattgctagtatagtcaacagtatttggctatcaataaagaatctctttaagatctcacccggctggcattctgtaacagaggggattacctggtgttttaagtatttaatgtcctcatagtgtggaaatcccctaaattgattagaaattgtattttatgaaaaataacttgtattcattcttgtgtatttattacaatatataaataatggcaactctttgttttatacatatataatttataactgaatctaagtattagactgctactcatattttgaactgcaggtgtaggacagtgtttgctggtaacaactccaatgtgtattaataacttgaaaaggagcatttcactataaaagataatgaagtaggtaatgaaatcagtccttgaatgaaagcagtgcccttgagaagggatttttttttaaatatacagtaaaatatttcgtgggaacctaacactcacatagcatatggtttattaataatgcatatcctttctaatcacttcttcaattctttttgctgcagttctgtgctaaaatggggttgtggttaagtgaacgagaactctgcctacctaagaagttcattgtgttctaagtggaaggagagttactgaagggaatgtgaatttttaccgtttgtacttaagatacatttgttgtctaaaatggctctggataacatttttgggttaaaaaatgtaatttaaagccaccatagaaagtattttctgatttactgtccaaatgaattttgttgttaattgagaagtcaataaaatggattaaactgacagaaaaaaaacatatatatatatcccaaggtgtaatttactcttttgtcaggataaaatcagaaaaatggctgattttagtaaatgaaatttttagcaaatctttcattcatgtagtttataattattgtgtcaagcagtgctgtttacattttaagcatcatacaaaaaagataatttggcttgctaaacatcaaaatagaatccaaactcttaaccgaatatcttttttacaactaaaagagatattccaagatttattaaagagtcaggtttaaaagttattaatgcaaattatgtaatgttcatttattcagtattcttgagtccctgttacctcaattggtgttctagaggctattttacaagaaagtttgaacttagtttcaaatttgacaatatattttatatgaaaatgtttatgtttaaaataacttatttattatgcagcatttttattgtgataacgttagtttatgggatattctgtcatatcctgtaaacatagtttatttttcttcttttttcccattttctcatacaaattgaataagtagccattttcccccaatgaatacctcttcttttaggtcaattggtgtttttagaatccatgtaatttgatttgcactgttagattgaaaagtaagttacgttcctgttcttagaagccacacatttagagataacagaaataacttgagtcttaagagtatggataggctcatccaatgagatgtaacttagctattcatactgtttgtgatggaaattctatacctgtttactgtgatgatgaatacagtggatatagcagggggttgaaatggaacacacagaagatcatgacaattgagattcagcaactgctgtctcatatcttggttaagacctcattgtgaaccttgaacacaaatcagatgttggagtgatttcaaactctatttcaacaattgggtctgtttctatatggaccctctatttcccagctgaatgtttcaaacccccaaattaggctgcaaccgaaagagcctaattgtgaaatgatgtgcgcttatgtttctgtttatcctttagccatggaactttaaagagtagtgttcctcctacttactttaagctggaagaagagttgagtagtaaatcctgtgtgaacttttagctcagctactctgctgaattaattagaggtaggaaggacttacaagggctggaagtttaaagagaataaattcatattttttgttctgaattgatttctgtgtaatttatatcagtatctagttgcttatctgtgaaattgggttaatttttattgatcacatttgatgtaaagaatgaattatttttgtaaagtatttgtaaatataaaattgctttataacttgaatgaacataatcattatgctcccattagggtgcattaagttgtacaaattccaaaataacatggtatggtttgtatggtttagcaattttacgaagcttcagatgacatgcactggtgacacaacagtagaatttcctgagaggttgagtgaatattaacccatcaagttagcaatttccttaactacatgagtatcaggaagacaggacttccctgccttagagctatatagacttgggcctcttcaagatctgacttctctgcacattctatacaggttggatattgatggagggttaaaaatgctatgacagttcatggtgcatggtgtgtttgtttaaatcatagcatgtttaggcaaagtggccagctcattcaatataagagccaccagctcttagaaacaacagatatattcacacccagtctgtaatatgtatttcttcaggcatgtcacactgcggtcttcctgaaagactacttacttcataaaggtattatgtttctttaattaatggccactagaagttaggaagctcctagggaccaggatatgagatcttaaagaggctgtcagaatctcttcatttgcatgacatagaatctgtggtggagatgttttccctgatgtttttggagggttggactgtgttgaaggctgtaccttggtgggggtggtctgcagtcatgcagtccactgatagggtcccccaccccgcaagcttcaataattgagctttctgttaatttcttgaattatcttttcaaaaatggtttggcagcacttgatgacattatgttcaaaattaagtccagtaaaatatataagcatttgtaaactataattatagtttaaataagacttagtttaggaaatccaagttttgacatatataaccaaacggcctaagagttcaaagctattttcttaggtgttacaccttagcatttacataatgccttctccccaagcagtttcatgtggtttgcagaaagttttggcagctaccagtcactatattgctggagttttgtgtttgagtatgtcatttatgtcatttatcagcagtatctgccagttgtgacaaagccctccctattatcctgcctttcctggaaaggatacagacccaagaaaagttaacatctacatagtacttagaatttctaattttaaaataagaaacaaaaagcacatttaaaataatattttatgcttttggagacaggacccacatgtatctccttatttttatacttgccatagaaacaagcctagttgtaggcctacagtgggtgctttgttaactgcttgttgatggcttcctgacatccatccaaatgtcacttttacagatgctgtcacccgttaaacaggtgtggcagaagtattccatgactgcattaggaagaatgcaccttatgggttatatctcttttggtagacagcccacctgctcttttttgtccccaccctcagcccaagcaatgtgaagacagattatggcaacttaggagctccatgtttccataataattcataactttaagagtcctccagacttacaagattacttcatggtgaaagtttggattgatcaataatttattcctataaaggtctgcaggattttttctgtaaccagaaaagtaactgcatagccattctttttttttttttttaatttgttgttgtttttgtttgagacagagtcttcattcttgttgcccaggctggagtgtaatggtgcaatctcggatcactgcaacctctgcctcccaggttcaagtgattctcctgcctcagactcccaagtagctgggcttacaggcacgtgccaccacacccagctaatttattgtatttactagagacggggtttcaccatgttgatcaggctgatcttgaactcctgaccccaggtgatccacccgcctcaacctccaaaagtgttggggttacaggcgtgagccaccgtgctcagcctgttttttatttatttttttgagacagtctcactttgtcgctcaggctgaagtgcagtggcgctatcagctcacagcagcctccgcctcccaggttcaagcaattctcccaccttagcttcctgagtagctggaactacaggtgtgtgccaccacacccagctaatttttgtatttttttggtagagacagggtttgaccatgttggccaagctgatcttgaactcctggcctcaagtgatccaccagtcttggcctctcaaagtgctgggatcacaggcatgagccaccacgcctggcccagtctttttttttaattattatttatttttatttatttattttttgagacggagtcttgctctgttgcccaggctggagtgtagtggcatgatcttggctcactgcaacctctgcctctgggttcaagcaattctcctgcctcagccttctgagtagctgggattataggcatgcgccaccacaaccagctaattttttatatttttggtagagacacagtttcatcatgttggcccggctggtctcaaactccttacctcaagtgatctgcccgcctcagcctcccaaagtgctgggattacaggcgtgagccactgtgcctggccagtcttttattttaaaataaatacttagtcctaacctagtgaattatcaatagcatttaaaattccttctatcctgataccatgaacagtaattttcccttttaagttatgatttgactctaattttgggtcttgtatctggtctttaaacacctttcgttaccctttggaatagaacaatcatgctactgttagcaaaattattgtaggcataaggaagagctgtgagttcaaagaagattgtgagttcttggaatagtattttacagcgttgtttattcttgaccttcttgttttttaagcttagagtttataagaaaaaagtgaatatatagctaattatagcattttagaaaaaattagctctgcagatagtcaggccccatacttcttggctcattactgattttaataccttcatgagagtattaaggttgaaaggaatggtgaaatttgcattatcagaggtctgatatgtaatttattgtaaagaaattaaatatatagaggctcaattaaaaaataaccatattctcaaacctccattaccactaatatcttggggttgtcaatgatagactatatatatatgtatgtatatgtgtgtatatatatatatatatatatatatatatatatatatatatatatatatatatatataattttttttttttgagacggagtcttgctctgtcacccaggctggagtacagctcacagcaacctctgcctcccaggttcaagcaattctgcctcagcctcccgagtagctggaattacagacgcctgccaccacacccagctaatttttcgtattttttagtagagatggggtttcaccatgttggccaggctgatttcgaactcctgacctcaaatgatccaccgacctgagcctcccaaagtgctggccttacaggcatgagccaccacacctggcctagactataccttttatacactttttaaatagagaaagtgaaaaatgataaactaaccattataaaatagaggtttgagtccacctgtattttacagaaatttgccctcaaatgtttgagagggaagtcacatatgatagaaaaatatcttttcaagggtagaatgatatttccttataaaagtgacaatcaaaaaagactcatttgtatacttgccaaagtttaaaagttttttacattccttaccctaaacccactgccccatccacccagaattcagaaagggtttggcatagatccagggctccagggcccaggtcattttgttattagtctagggcttttgtcctccacagtctaggcagggcatctttgtatgtgtgttgctggttggggccagggacgggggcaggcgggagttgtccaggtttaagattgtttgttttccatcagatccacaagcaatatctgtgggctgaaatccaggttatacctattcactatgactttttttttttttaactttctactgtaattatttcagttccccgaagttgtatctcaaatgttggggaaatgctgccttgactattttactttggaaggttttactagatatcagtttagtagattaatgacgttgttaatctgtctgctcaaaagacaccagcaagggggtatactttgctgaactgataaattattctattaaggactaacccagtacttggcaaaattaggaataacttttcccctccttctttactaataaattttccaagttgcatactgttgttgcaagtttctgtaatttttttctgtatacctttctattgtctgaatttaaataaaaatgtttctaataatatc
